United States Patent 7,745,391 (HUMAN THROMBOSPONDIN POLYPEPTIDE) - sequence listing, part 68

SEQ ID NO: 239072 - DNA, 558 bp, Homo sapiens
cagaccaaggtgcttcctgctgcctgtttcacaagtgggtttctcaataatttattattttttaaagaaagtgctagccttaaaaatattgtttgttcatgcatatcaacagcatcactgaaatgattcaactactccatactgcttggtgttctctgttattcctagatgctataacaagtttttttcttttaagtttatatttctttgggcttttctaaatagaaaatagtggacttcattgtataattatattccaaaaaagcactaaatttcataaaatacaaaaggtagactttgcgagttacctgcagtgaaataggttttttgtcatttatgtatgtgcaatatgcttatgggtaattatgggcaagagaaatggaaacaaatacatttttaaagaacttttagtagagacatccttttactgaaaatgtgcaaatcaagttgcaactgcagtattataatgtttaaaacatcattatgactaaattctaattgaagaaagccattttgcttttggccagcatgcacttaagattggcataagcaaaaaca

SEQ ID NO: 239073 - DNA, 495 bp, Homo sapiens
  misc_feature (7)..(7): n is a, c, g, or t
  misc_feature (27)..(27): n is a, c, g, or t
acgcggnggtttggcgactagacctgnggatcccccgggctgtaggaattcggcactaggtggctcatgcctgtaatcccagcactttgggaggccaagggaggaggaacacttaagcccaggagttcgacaccagcctgggcaacataataagatccctgtctctacaaaaaaaataaaaaatagatttttaaaaaactgaagagtcttgagtgtttctgtccatgtgatctcattaggtcttccttggtactcccatgcatatcacaactattttggagcatgcccactaccagttaggacatgttgtgtctttgtacccagtgtccatttgtctgtgctgataagaaagtaaatagagcctaccaaaagcaaaacggtgaaataattcatttgtattgaccttctctagcctccacttctgctgcttcttgttgcttcaactgtgggaaattgtctatctctttttgcattcaggctttctctccctatcca

SEQ ID NO: 239074 - DNA, 466 bp, Homo sapiens
ggagcaaagggggtctgtggagcccagcaggggcctccgttcatcagggattctgaaggagcccagatgttccctcaaactcaccagagacactttcttcaccaaactcctagtcctttctgaagcttgtgcagacttagaacaaatgtttgctgagaacctaccaggggccaggcactttgagaggcactaaagaaacatgaagaagtaagagaattgtcttcaagcaaccatttttcagagacagaaagtgagtcacagagaggcctcaaattttactaaagacaacacagctaagaattcaacccccaggctgcctgatccctgcaggttatctcccagggctccaggccgggtgagactagcactgggatgtgaataccaccaaaatcccttccagacacagggtatggtcagctctatgaaactgggatctattaaaaacaggcaatcagaatccagggca

SEQ ID NO: 239075 - DNA, 1124 bp, Homo sapiens
caatgcttgccatctggatgataaacagaagatccactaaaacatccacaggattaacagagcttccttgcagactaagcgatgacaccacactttggacatttaaattcactctactgaataggaggaagcctttattttccttttcctgggaaagtaactgtctcttggaattatctgaccgtgaacttcctcttctagcaaactcacatgaaagccctcactgttgagaatcccagctccactgtcaagcctgtttggggattttgcctcagctgtgggcttccctagagtaggttcaggggaatactcagcctgattatcttaaaattgaagaagtgccaccaaggccttcagatctaatgcagatccacagaccttgctcctggtacttgttcagcctgtgctggggagccatggtcctgagttcccggggaggctggcagggtcaagccaccctgcccaccaccctcccacttcccctcccctttcctctccagcattgggatccaaggaaaatctgcatgaagccaattttgagggtagatttgtgtggaaaataaatcattatacagtaagacctggggcttgaggggtggggaatggggagggaagggcatagcctgctcctccatgagtctgacatctcagaaactgtgcagctgccggacgcctgggtcaggactccaagaccccacctcttaaggacaagaaaatgcctggttcctcagaaaagaccctcagggaagaaggtgaaaacattacatccaaggattctcctgccacaactggattggaagaaaaggctgccgcatcatctcagcgaggagtgaaggaaccatgtcccggggaccgcgctcctccacctgcactcaccccctcacattctcttaagcaccctgtggcccttcgaggcctggcagaatggtggtgcccaccgggttgggccagggctcaacgggcaaagttgtgcacactaaaatatcaaatcaaggtgcttggttttaaagtaaatgtttttctaaagaaagctgtgctcttctgctgacccagatgagtagggcacagccctgtaactgcacttgccttctgtcatttggaatgaaataaattatgagaaaggg

SEQ ID NO: 239076 - DNA, 2010 bp, Homo sapiens
  misc_feature (744)..(744): n is a, c, g, or t
  misc_feature (1784)..(1784): n is a, c, g, or t
attaagctccagaaccgagggagggagccacagtgtgggaggaaggagcctgggaaaatcgcctctggatgcagatctggggcttctattcccctgcgcactgaggcctctcccggcccagccacagccctgctccaggccctgccagaaaggcaaatgctttgaaagttttggtgttggaccagccagccatgcgctgagagcttctctgaggccttcatcagctgccagctcagcctggctgcttggctcctgctgccccagcttcccacgggccacctccaaccatggttcaccctagtcactccacaccctgcagcctcacaactcagtgcccacccactgggggccaccctgcatccaagaaacctgattgccaggaacccctgaccctcatggcagctcatgcacccttactcagggtgcagccgcctgcccaggtcaaaaccaaagttttctgggcgtatatagtttggctgtccctggtcctgctcagggagaagccaatcgcaaagctcactttagcaccgtgcagtggccagcaccaagtgccatcgcccatgcaaaggatgacgtcagccccctccagcccacacagtgcctgctggacaacatcaagaagaaagtagtgcccctgtgttagcggggctccggctggaacactgcccctgagaaggagtatttcccctgactcttaaaacttttctctgggtgcttgaggtcctctgcctctcagacctgccntcagagtttgagagtccctagcctggtactttcctggtcatgcatctccagaaaacagattgtttaggattgatgagggtgggggtccaacaggacagagtgttccaactccactgcttcagccttggacaagaagcacagacccagggagatccgattccctcacttggtcaccccaccagcctagagtatcgtcagggaccaggctccataaagacagtccctcagccccttgaactaagaccagactgcctcatctctatctgcctactgagggagggcagcttgcagcctgcctgggctaggtgctgccctggagaaaatggaatcctggagtcctccaacctagacccttgtcagttcattgttgccagcaccttggcatgcctgggcaagggcttggtcctgccctgccctcacaccagcctgcctgcctaggctttggccacctcttgcctccagtagataatgcagggggcggggggcagtgttcttggacgaagtggcctaggcctatcagcaggggctcctacccagagagcaaggagaaactggcaggggagctagggaaatacagtgcccccgcctggcagggggcagtgctgcgcaggcgggagggtgctggtggagtacggtagcggcatgtagggccagccagaaaacagcactgcctccctccctcgcattcctgtcacactcctgtcctctcatcgtccctggctcagctggtcgcccgggaaacacagactcaacgtgccaggagtcacgtagcatctacctgaagagccaagcacttgctgtcaccttcacccactttcttactgcaactgctgaacaggctgagcccagccagctgctgtcaccgcctccaggactcggggaaaagccccctgcagacttggtgctgcaggttcacagcccccgctctctcttctctccccaaatccctcctgccccctagcagccactcttctccagaagctgtgttttgaggatgtgatgggtacaggttggtaaatcaggaggggttcctcctgggnttcctgggcccacagggtctcacccaccttgctagtatggaaacctcaggctagggcgtacttactctaattacattctcctgccatcctggaagaaaggcagctctgggattaagatcgagggacagtaggccaggctggggaccagggctgtccaggggcaacagatggctcaaaccctctcagatgagcaccaacaaaatttttgtcacatacaaaaaaaaaa

SEQ ID NO: 239077 - DNA, 451 bp, Homo sapiens
attaagctccagaaccgagggagggagccacagtgtgggaggaaggagcctgggaaaatcgcctctggatgcagatctggggcttctattcccctgcgcactgaggcctctcccggcccagccacagccctgctccaggccctgccagaaaggcaaatgctttgaaagttttggtgttggaccagccagccatgcgctgagagcttctctgaggccttcatcagctgccagctcagcctggctgcttggctcctgctgccccagcttcccacgggccacctccaaccatggttcaccctagtcactccacaccctgcagcctcacaactcagtgcccacccactgggggccaccctgcatccgaagcagttgccgcatccgaagcagttgccgacatccgaagcagttgccgacatccgaagcagttgccgacatccgaagcagttgccga

SEQ ID NO: 239078 - DNA, 427 bp, Homo sapiens
gtcacagatgcccacctttgctctccaccagcatcctgggccgtgtgctctgccctcatttttccatagcacctgctacattccagcatgccatacaccctttaaaggtgtgccattgtcactaatgtagcacaggtgcctgcagtaggaactggaatgtagtaggtgttgaggaaatgggttaagtactgtcttcagattttgtggaggtttgctgtacttctttcttgaagtatgttctcagtgctttaatacattttaggaattcatccatttgaattcgcttctgtggagtgttttacagcctagagtagtaatgccatctacatcataagataaattgtaactttttgttcaactagaatttttaccagtatttatgtttattaggtaagaaattttagaattagctagaagatagcagtaa

SEQ ID NO: 239079 - DNA, 2113 bp, Homo sapiens
cctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgttgtgctgggagtgagcccaggcaaggtggcccatggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtacatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtatggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgacagcacctgtaatgtaggcaggcaatgggctcctccaggtggcaggaacaccgtgaggagcatgcaacgtgctggagaccatggggcatgtgacctccgggcacaccctggacagacctgggtgagaggtgggctgggacgccaggacggtgaggggcttcaaggtgtgtttgtcctttgtccttatacaggtgacctgcatgggcgggtgaggtccatcagaatgctctagaacaggacaactgaggtcccggctgccccgctcaacacgccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcatgcctgtaatccctgcactttgggatgcctgaggtcaggagttcaagaccagcctggccaacatggtgaaaccctgtctctactacaaatacgaaaattagctgggcgtggtggtgggcacctgtaatcccagctactcgggaggctgaggcaggagaatcgcttgaacccgggaggtggaggttgcagtgagccgagatcacaccattgcactccagcctgggcgacaagagcaaaactccgtct

SEQ ID NO: 239080 - DNA, 159 bp, Homo sapiens
ttagtcagctttttgtgtaactttatttatggaaactgaaggtcattatagtagtttaaaaagctgttgtgaagtgaccaaaaaaaatagcatgttatgtgtcatagggaaaattatttgaaatgtcacgtgttgattaatgtttgtaatttcatttgg

SEQ ID NO: 239081 - DNA, 449 bp, Homo sapiens
caggaggatctcctgagcccaggagttcgaggctgcagtaagctatgatcacgccactgtacccagcctgggcaacagagctagaccctgtctattaaaggaggaggccgggtacagtggcttacgcctgtaatcccagcacattgggaggccgaggcaggaggatcacttgagggcaggagtttgagaccagcctggccagcattgtgaaaccctatctctactaaaaatacaaaaattagccaggtgtggtggtgtgcacttgcagtcctagctactctggaggcttaggcagaattgcttgaacccagaaggcagaggttgcagtgagctgagattgtgccactgcactccagcttgagcgacagagtaagactccatctcaaaaaaaaaaagaagagagatgaaggaggaggaggaagagaaagaggtgggggaggggaaggaag

SEQ ID NO: 239082 - DNA, 153 bp, Homo sapiens
cttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacac

SEQ ID NO: 239083 - DNA, 541 bp, Homo sapiens
acacaattcagtccccagcacattctcccctgggagtaaggaggtctttccaatagctctttctgtctccagattcaagcaacaggtccctcctcccactcttccaagcctaggtatgtgacgagcaatgccccaccttgtcaccgcctcaagaacatgtcctcaaattatccaatccacatcagcctccaagaattcaggctgtgcatacagaccaaaaagtcaaatccatctccagccaattctcttgggtcaagaaagaaatagtaggccaggtgcggtgactcacatctgtagtcccagcactttagggcactaagatggcttgaggccaggagtttcagaccagctggggtgacatagcgagaccctgcctccgcataacatttaaataattaggtgtggtgacacgtgcctatagtcccacctacttgggaggctgaggcgggaggatcacttgagcctttggcctcccaaagtgtccaaggctacactgagctgtgatcgtgccactgggcgacagggcgagacctcatctcta

SEQ ID NO: 239084 - DNA, 452 bp, Homo sapiens
gtcaagtcacctgattttgctgaccgttcatttccttgcctatcccatgtgtaatctatgagaaaagaaagggagtgctaggaaaaaataatggcagaaaaaaaaaactggttctgaataattttcttttggataactttaatacatcagtataattttaactggaggctgagaggtcagaaaacgtgtttttgcaataagtttctttaatatatttgcatccccatgtttttttttatagaagttttgtaaggtaatataaaaatgctatgtcaccaaggccacataatgataaatatttcaaatgtgaataccaattagtagacataaagtcctatttgttcctgttaaaggagcagtgaggaaaaataaagacatcttaataaactatttttgatgtaattataatagtttggtttcccaccccatctgcctttgaaaataaattaaaa

SEQ ID NO: 239085 - DNA, 1700 bp, Homo sapiens
  misc_feature (2)..(2): n is a, c, g, or t
  misc_feature (9)..(9): n is a, c, g, or t
  misc_feature (11)..(11): n is a, c, g, or t
  misc_feature (20)..(20): n is a, c, g, or t
  misc_feature (22)..(22): n is a, c, g, or t
  misc_feature (42)..(42): n is a, c, g, or t
  misc_feature (1599)..(1599): n is a, c, g, or t
  misc_feature (1616)..(1616): n is a, c, g, or t
tnagtagananggggtttcncnatgttggtcaggctggtctngaactcccgacctcatgatctgcccacctcggcttcccaaagtgctggcaggtagatcacaaggtcaggtgatctgcctgcctcggcctcccaaagtgctggaattacaggcgtgagccaccgtgcccagcccaaaagtactttttcaaacagcatcaaagtctgatattattacaaaaatttaagaatatttaataccacatttagaacataataggcactagataaattacatctattaatagcatctaaatgtgaggtggtattagttaggtttcagagaattacttggagtgagcaaaggaagccattttttccaagaggagggaagagaatgaggatgattaagccaagaagaaagaaaaataatagatcagtggaccccatcttacacatttcccaagtgggttgaccacttgtttttctaccatcttagcacttggggaaagctctcttggagatgggcttactacagcaggggtgaagagaggggcacactatctcccttgggggtttctaagaatagcccccagtgggggagaagggaaggggggcaaaccaggcaacttcccttcctggccccaggagcccaagaggaaaatgtgagtcacggtggagggaaggggaagggggacgagactgaaataactctgtacacacacatccctatctgactatgagaaaaaatggatgccaggggaccggaggagactccaagctgggcctgggtcactgggtgacactgttcagtatgtctaaatgagtgggtcggtaggggacaaagtctccttcctgtgattgtgagtaggggtggatctgggaaggggctgcccaagtagacgaggaaggaggccacaaaccccacctgtctagaaacccacatacccaaatgggcacagggaatgtttctcagcccagaggaagttgtatgggcagctctggccccaaggactggcacaggggcagcagtgaatttcgccactgccccaagaatgtgcctatcgagatccactacatgaagctgtagccagacactcctggggagacgggcacagtcctggcctccctgggactgcacctccccagtcaggcactgggcctggctctgggcaccatgccagtcgagagcagggaacagatgcccacccagcccatgcctggccagagaggaagggggaaaggagacaccacctctaagctccttccccaggagggcagtccagccataaagccctggttgagagccaccctggaagagaagctttggggcagaaggacctggccctttaagatgtctgacagtgccctaagggcacgtgctccacaaacaaacgggctataaagttacttttaaaaaggtacgttctggcattctggcattctggccaggtgcggtggctcacgcttgtaatcccagcactttgggaggccaaggcgggtggatcatgaggtcaagagatcgagaccatcctggccaacatggtgaaacttgtctctactaaaaatacaaaaattagctgggcatggtggcgcgctcctgtagtcccagctactcangaggccgaggcaggagnattgcttgggccctggtggtggaggctgcagtgagccaggattgtgcaccactgaactctagcctgggcaatagccatagcctg

SEQ ID NO: 239086 - DNA, 519 bp, Homo sapiens
atcaaaacacccacattcaacatcaccttgatgtctgaacaggtgatacgtatcaggagctgtgtcaaacccccttacatgctgttggttggaaatataattatcattcccaatacacaaaatatagaatgtgataattgtaagctgttcatgtgcattgatgctacttttaatcccacaacaagtattctattcgtaagggctagggagggggtatggataccagtttctttacatcatccatgggagtcttccccctctatacacatagtcaatgaagttcttaaaggtatcctgaaaagaacaaagtgatttatttttactgttattgtagtcattgcaggtctaattgcggtttctgcaacagtggcaaccgctggagttgagatccacagttctgttcaaaccactcaatatgttgaagcatggcaaaaaaactcctccagactttggaattctcagactcaaattgatcaaaagttagctaatcaaattaattatctccaccaaagtgtaata

SEQ ID NO: 239087 - DNA, 2147 bp, Homo sapiens
  misc_feature (1522)..(1522): n is a, c, g, or t
cgatatcatgactcaagcacgagggtcgtcttggccacgttccccctggtttatccatattccacgtaaactgtgttcatcatactgaaaacagacccctggaggaattctgaggtccaaggatttgggcaaggtcattacctcctttttcctggaccatcttcttcaattaatgcaacctaagactgcaataagctcttttacaggtatataattttgtatcatttggagcatattcttagaattgtttggtgttctttcccccatgtatgcagctgatttttaaaaacagatctgtgatctatagcaagttgctcaatctctttaagccccacatttttggtgagtaaaataataatagcacagacttcatggcattgtggtggtgaacagatgagcacctacgcttctcaatacagcgtcttctacataataacttcaataaatatgaactagtataattattgtgttattggaaaattagaaattgcaggtgagcaaaaggcctttcttccaaacatttttttttgtgtatttcaatgtaattaattttttttatttaaatgattcccacaatgctgatttaggcattttacattttgatatgcatttttagctggttttcaaagtcacaaggctctaaggaaaagaactaatccttagttggcaggaaagtccctccccaaatccttggattaaaatagaatctgccgccagggctttccttgtcttctgtgattgagatctgtctcaggtgggaaggcatccagtacctgtgcatggcaagttcattctttagagatagaatgtgcaactttaatatttattgataggcacactaattctcttgctgatggtaattaatgaggtgcttatatcttattttgcggtagtttaacgagcttcgggctataggagagatccggtgcttgctgtaaatgctgagaatcaaagatgctggaggaaaatgcagaaaatggagcagaaaaaataaggttttagcagataaaatatctcagattaaaaacactctcaaaacaaaccttggtaaggcagaagcatttaaaaatcagggagagcttgccagggaggaaagtcgcaggttccctattccttgttccctaagcatgctgttaattttgaccacccatttgtctttctacccctttggcttcgtctgtgttagcagtgtgaagtgaaaaattgataggaaaatgtattttttttcttaaggcttagatagttacagccaaaacattttgtcatattgggttttgaataattgtgtcaaatctacacttaattttgccttagacagctagccttatgaccctagttaacctgtattttctcttattctttcatcctttggaaatgaggttcacagaatacaaattcagaagagcataaattctaactccttagaagacaggaatagaagtcaaagtgacctcaataaatcaaaagcaagttgaagttcaatagggacaaatgtaaggtaggatacttatgcctaataganggactcacaattttaaaatcatctgggcatgattgtgatggaaaagtgtctctctgtcaaggacatgaggaagccacatccgcagccttgtctaaggacctactatgtgccaggcattttgcataagtcagcttgcttacaaatacactgtaataatctcaacagtaactctcaaagctgtgtataatttgtgctctcattttatagatgtggaagctgaggccgagagagggtaaataatttgctcaaatgttcacagttagtgatttaactggttttggatcctgctgtatctacttgaccaagagtacttcattacagagctgttatttaaaaagccaacccggccgggtgcggtggctcacgcctgtgatcccagcactttgggaggccgaggcgggcagatcacaatgtcaggagatcgagaccatcctggctaatatgatgaagccctgtctctactaaaaatacaaaaaattagcctggcgtggtggcgggcgcctgtagacgcagctactcgggaggctgaggcaggataatggcgtgaacccgggaggcagagcttgcagtgagccgaaattgcgccactgcactccagcctgggcaaccgagcgagacaccctcc

SEQ ID NO: 239088 - DNA, 2201 bp, Homo sapiens
  misc_feature (1576)..(1576): n is a, c, g, or t
cgatatcatgactcaagcacgagggtcgtcttggccacgttccccctggtttatccatattccacgtaaactgtgttcatcatactgaaaacagacccctggaggaattctgaggtccaaggatttgggcaaggtcattacctcctttttcctggaccatcttcttcaattaatgcaacctaagactgcaataagctcttttacaggtatataattttgtatcatttggagcatattcttagaattgtttggtgttctttcccccatgtatgcagctgatttttaaaaacagatctgtgatctatagcaagttgctcaatctctttaagccccacatttttggtgagtaaaataataatagcacagacttcatggcattgtggtggtgaacagatgagcacctacgcttctcaatacagcgtcttctacataataacttcaataaatatgaactagtataattattgtgttattggaaaattagaaattgcaggtgagcaaaaggcctttcttccaaacatttttttttgtgtatttcaatgtaattaattttttttacttaaaaattttgaattaatatctcaacttataagagcagctttgtcagtatattttaaatgattcccacaatgctgatttaggcattttacattttgatatgcatttttagctggttttcaaagtcacaaggctctaaggaaaagaactaatccttagttggcaggaaagtccctccccaaatccttggattaaaatagaatctgccgccagggctttccttgtcttctgtgattgagatctgtctcaggtgggaaggcatccagtacctgtgcatggcaagttcattctttagagatagaatgtgcaactttaatatttattgataggcacactaattctcttgctgatggtaattaatgaggtgcttatatcttattttgcggtagtttaacgagcttcgggctataggagagatccggtgcttgctgtaaatgctgagaatcaaagatgctggaggaaaatgcagaaaatggagcagaaaaaataaggttttagcagataaaatatctcagattaaaaacactctcaaaacaaaccttggtaaggcagaagcatttaaaaatcagggagagcttgccagggaggaaagtcgcaggttccctattccttgttccctaagcatgctgttaattttgaccacccatttgtctttctacccctttggcttcgtctgtgttagcagtgtgaagtgaaaaattgataggaaaatgtattttttttcttaaggcttagatagttacagccaaaacattttgtcatattgggttttgaataattgtgtcaaatctacacttaattttgccttagacagctagccttatgaccctagttaacctgtattttctcttattctttcatcctttggaaatgaggttcacagaatacaaattcagaagagcataaattctaactccttagaagacaggaatagaagtcaaagtgacctcaataaatcaaaagcaagttgaagttcaatagggacaaatgtaaggtaggatacttatgcctaataganggactcacaattttaaaatcatctgggcatgattgtgatggaaaagtgtctctctgtcaaggacatgaggaagccacatccgcagccttgtctaaggacctactatgtgccaggcattttgcataagtcagcttgcttacaaatacactgtaataatctcaacagtaactctcaaagctgtgtataatttgtgctctcattttatagatgtggaagctgaggccgagagagggtaaataatttgctcaaatgttcacagttagtgatttaactggttttggatcctgctgtatctacttgaccaagagtacttcattacagagctgttatttaaaaagccaacccggccgggtgcggtggctcacgcctgtgatcccagcactttgggaggccgaggcgggcagatcacaatgtcaggagatcgagaccatcctggctaatatgatgaagccctgtctctactaaaaatacaaaaaattagcctggcgtggtggcgggcgcctgtagacgcagctactcgggaggctgaggcaggataatggcgtgaacccgggaggcagagcttgcagtgagccgaaattgcgccactgcactccagcctgggcaaccgagcgagacaccctcc

SEQ ID NO: 239089 - DNA, 391 bp, Homo sapiens
agttatttttataaaaaaattctttcttctttaccgactccattccaaatcaagcaaaaaatgttagtatattaaatcaagtaccagtagagaaaatattatatgcaaaggattattcgaggcactgtggtagttaaaatataaattccaatattctaggaatgtgcaatcaggaagtgaagcaaaatatactactttacatttttatttaataaaatctaaatgtgcagacactatggtgctagaaaattcagatgggaaataaaataaaatatacttcctcttctgagttcatccctttggtgaccccagctgacacccaacctctccccggcaacctgcatcccacatttttttgcttggttaactctattcactctttaggtctcag

SEQ ID NO: 239090 - DNA, 479 bp, Homo sapiens
tctgtagaccaggctggagtgcagtggtgcgatcttggcctcggcgtacctctgcctccccggtcctggttcaagcaattctcctgcctcagcctcccgagtagccgggtttacatgcacgtgccaccatgcccagctaatttttgtatttttagtagagacagggtttcaccatgttggccaggctggtcttgaactcctgacctcatgatctgcccacctcggtctcccaaagtgctgggattacaggtgtgagcaacggcgcccggccggaacatgcccatttctacagagaattaacagaggtcttggagagagagtaagagtggctcggataaagggttctgggagcagccctggtgcccagctcctcaggtcaggagagcttcctggcccagggtggacccaggctcacagggctggtcctggaatgatggaagctgatggagctgccccaggtccccgcgcagcctccagac

SEQ ID NO: 239091 - DNA, 425 bp, Homo sapiens
tctgtagaccaggctggagtgcagtggtgcgatcttggcctcggcgtacctctgcctccccggtcctggttcaagcaattctcctgcctctgtatttttagtagagacagggtttcaccatgttggccaggctggtcttgaactcctgacctcatgatctgcccacctcggtctcccaaagtgctgggattacaggtgtgagcaacggcgcccggccggaacatgcccatttctacagagaattaacagaggtcttggagagagagtaagagtggctcggataaagggttctgggagcagccctggtgcccagctcctcaggtcaggagagcttcctggcccagggtggacccaggctcacagggctggtcctggaatgatggaagctgatggagctgccccaggtccccgcgcagcctccagac

SEQ ID NO: 239092 - DNA, 683 bp, Homo sapiens
cacacactggggcctgtcatagggtgggggaataggggagggatagcattaggagagatacctaatgtaaatgacgagttaatgggtgcagcagaacaacatggcacatgtatacatatgtaacaaacctgcacgttgttaacatgtaccctagaacctaaagtatacttttaaaaaattgaagttgattatttaatactagttgatctaatcaggcatttaattgtgtggataagggcataaaaagacagaaactggtcattatgaattatgtagaaattatcttctgtatttttagagtatctttttcttgaggataaaagataaaagtaatccttcaaaccatttatactatatttcttttgtcctttttgagcaataaacacacacacaaaattatgtgctatgtagtctgacaaaacatatggtataagacttagaattgtggttcaagactctagtcattaaacatatgtagaatttgtactatgtgtcagttactgtactagtccttggggaaatttagctgaaaaagactgtttcccaactcactttctttttgggaaagtttgtatacataaaaccattatatgatcaattataaaaagtacaaccatagactaaggagaaaagtataaaaggagcaaatggagaaggccatgaattcttactgaaggattaag

SEQ ID NO: 239093 - DNA, 559 bp, Homo sapiens
ttcttagaatcattcaatgacttcccattttacactaacaataaaacctacactccttactgcagcttgtaagtccttatgtgtctgacctttgatcctctttctaaccccattttatacctttttctctttactcagtactctgtagccattctggcattttcctgttgtttggccccatcaggatgttttttcagtttggggcctttgcacatgctgttccttcctcctcgcttgctcttccctgactctacatggcagatttcatcttatccttcaccccttggctcaaatgtcacctttacatagggagttttccttaattactatacataactagctccttcccactactctatccccctatttatttcctgcatagtacttactgaattggaaattattttatttgcttattgctcattttctgtttttcactattggaatgatcaggtttatagatctgcccaggcatagtagctcatacctatcatcccaacactttgggaggccagaagtttgagactagcctaggcaatatagctagacccttctctac

SEQ ID NO: 239094 - DNA, 350 bp, Homo sapiens
actcctggactccaaaattgtgagataatttctgctgcttatgccactcagttggtggcattttgttatgacagccccagcaaactaatatgggcagccaagactcacagcacaagctgagttggcatcaggacactcactgcttctctcacaagtgactgactgctgctgatacctggaccaccccactccgttcaatccctcttctaacagaaatttagctcagtacctatggtggtctaaatcactggttgcaaacctctgtcggattaatgatggtattcttccaggggaagtatataaatttcttgcttatgaaaaataaacataatttttagttcaaacattta

SEQ ID NO: 239095 - DNA, 230 bp, Homo sapiens
tagatctctgtttgaccaagggaatacttacgtacggtaggagacagcacaaagctttctgtactcttaaattctacatttctgtcctctcaaccctacttgtggttttacactgttaattacactatttgctctgttttgtattgcactcagatcatttacctcagatctagttaaaaacatctctttaccagtaattcagcatttaaaaattaaattattcagaatta

SEQ ID NO: 239096 - DNA, 358 bp, Homo sapiens
tctggatctcacacaatcagcatcagtgtaaaagccgcagagcacccagcaacaggtagtgtcccatgatgatgttacttttcttttcttttgacagagttttgctcttgtcgcctaggctggtgtgcagtggcaagatttctgctcactgcaacctccgcctcccaggctccagcgattctcttgcctcagcctcctgagtagctgggattacagccacctgccaccatgcctggcaaatttttgtatttttagtagagatggggtttcaccatgttgaccaggctggtctcaaactcctgacctcaggtcatccacccgtcttgacctcccaaagtgctgggattacagggataag

SEQ ID NO: 239097 - DNA, 329 bp, Homo sapiens
aacatttccttaagaaaacaaagcaaaagacaaaggcacaggctattaagtaattacaagaaaagggatggcagtgctcggggcgcacccagcccgcggaggcctcctgcgttttccagaactccaggggcaccttcgcttgggtcagacttgggtaatttgagtcatgagtgggctcactttttaaaattcattgtattgtggaaacaacaaacaaacaaacaaccattgaatttctcagcagcttcatctcccactgaaaacgacatgaactgtaagtgcttcacttaaaagtgtttcccttccctctcaaaaaacacagcgctttt

SEQ ID NO: 239098 - DNA, 4309 bp, Homo sapiens
  misc_feature (163)..(163): n is a, c, g, or t
  misc_feature (2204)..(2204): n is a, c, g, or t
  misc_feature (2743)..(2743): n is a, c, g, or t
tatgttgatgctattcctttctgtttgttagttttccttctaacagtcaggcccctctgctgcaggtctgttggagtttgctggaggtccactccagaccctgttttcctgggtatcaccagcggagactgcagaacggcaaagattgctgcttgttccttcntctggaatttttgtcccagaggggcacccacaagatgccagccggagctctcctgtatgaagtgtctgtcgacccctgctgggaggtgtctcccagtcaggaggcatgggggtcagggacacacttgaggaggcagtctgtccctcagcagagcttgagcactatgctgggagatccgctgctctcttcagagtcagcaggcaggaatgtttaagtctgctgaagctgtgcccacagctgccccttctaccaggtgctctgtctgtcccagggagatgggagttttatctataagcccctgactggggctactgcctttctttcagagataccctgcccagagaggaggaatctagagaggcagtctggctacagcagctttgcggagctgcagtggactccacccagtttgaacttcctggtggctttgtttacactgtgaggtgaaaaccacctactcaagcctcagtaatggcaaacgcccctccccccaccaagctcaagtgtcccagcttgacttcagactgctgtgctggcagtgagaatttcaagccagtgcatctcagcttgctgggctctgtgggggtgggatccactgagctagaccacttggctccctggcttcagcaccctttccagaggagtgaatggttctgtctcgctggcatgccagacgccactggggtatgaaaaaaaaaactgcagctagctcagtgtctgcccaaacagctgcccagttttgtgcttgaaacccaaggccctggtggcataggcacctgagggaatctcctgttctgtgggttgtgaagaggatgggaaaagcgtagtatctgggtcagagtgcaccgtccctcaaggcacagtccctcacagtcccttggctaggagagggagttccccaaccccttgcacttcccgggtaaggcaatgccccaccctgctttggctcaccctccgtgggctgcacccactgtctaaccagtcccagtgagatgagctgggtacctcagttggaaatgcagaaatcacccactttctgtgttgatctctcttggagctacagaccagagctattcctatttggccatcttgccagccaccgttttgagattttttttatgtttaaatctttgctccatctagcatttactttggcataaatatgtcttcaatatagaagtttaactttctttagtgaaatctacgtatcttttcttttatgatttctggcttagatattctggtttgtttcttggaatgaaatttcttgggaagaacgtgaggagtgagctggagtaggacacacccaggtggctggcaagaaacccctctgaagaagtctctctctcagggaaaggtccataattttccattccagttcagctcagtcaacatctactaagaacctactctgttccagagactgtgttaagtgccaggggcacagagatgaggaacatctctgcttgcaagtgggagtgacaaatttagaaacagaatgacgacacagtgtggtaggtgcaatgagcaaaaagcataaggatcagtgagcacacataagggtgcctatcccaggctggaagggaaaagcctatctgagaaggcctcctggaggagatgaatcctgggccgagtttgtttttcccatttgaataactagaatattagaataagaccattcaataaagacaattctgaaatcaccttccaattaaaacaactcttactttgtaacttcatgttgcttatatgacataatgcacagcatattacctgctaagatacacactttcaatatcattggaaagacagaactggaacagaaagctgccttaatcaacaacagaatatagctcccagaccaagggcgagaggtctccagtgtagggacaacctggtgcacagcgattacgagagaaggctaaagtggaaccctaatttctccatgcagctaaaagcagtttactatttctgaaactcaatctagaaggtagggaactttaagataggagactggttgctttctatgacagtcagggcnagattgtaaaggggcttatgctttatgtaaagaatgggacatgagaaacactgaggtgttgtaagttgaggggtgtctgatctgacaaaacaacttggaaatcatcagcatgagatgagattgcccagggatatcaggttgcagaggatttaacctttgcagatccttgatccctttgaggatgtgataaaagctacagatgctctttccagaaaaacaaacatactgaaaaccacaccaacatatacacaatttcaggggatcctcagattaagaatatttgatatatagaggactgagaagtagcctgaggaagcggatattcaaaggatgggaagaagatgaggggagcaggaaaagggccaaagaaaaatgacccaagaggtactggaagagccaggagacaagtgttgggaagctgtgggagcacagagatccaaggaggatgtgatcagcagtgttgaatgctgtagagatgtcagctaaggtcaggactgaaacatgtcttttgcacttacagttaagaaatcacagccganagaagtggctcacatctgtaatcccagcactttgggaggccaaggtgggaggacgacttgagcccaggagtttgagaccagtctgggcaaaaaagcgagacgccatctctataaaaattttaaaaattagctgggtgtggtggtgtatgccgtagtcccagctacttggaaggttgaggcaggagtccagaagttcaagtttgcagtgagctataatcgtgccactgcactccagtctgggtgaaagagcgagaccccatctctaaaactaaaaagaaagaaagaaaaatcactggtaatggtattgagaaaagtctctgcggagtaactagtaatgttagctccagatatactttttcaagcccgagaattatataggtggcatctaggtggaagtaagggtaggggacttgtcttgaccctgcatttgcagagaactaatacgtcaaataattgtcaattgtccagaaaaagtgttgaaggggcttatggagattatgtctgtttgtccctgttgccaccactataatggagtcaaaagccagaaagcaacagttgaaggaatgatgtgaggaaatggagaagtttggtttgttaggtaggagagacctgaagggcagttaaaataagaaacaaaaacaagacagggatttgtctccaagaagtggacacatcctgatatttctatcctatacactaagaaaaagaaaggggaaaacagagaggctcaagacacagagaaaagtggctgaagggccaagcatccaggaagagagtctggacttgaagaggaggagagccccccacctggaagtgcaaggtggggggcctgtggctgtgtataatttcctccaagtatgaattgaagtggatcagccccaatggcctctattttccccataacataagaggtgaggttgactgctgagagtagagatgggagttgtatggaagactggaggaggacaatgcctattttttagaatcactgatgagggatgtatgggaaaggcagctaaacaaggacaaattaaagaacagctcagcaggctggtgatggagcagtgtcagtcatggtcccgacaagaagcagatggcacattcaagtggtgtaactgaggagcatgtcaggaagagaatattcaccaaggtgtgaacagggtgaagggaaactcataaaggccagtgaagcaccctggaactagcaagagtggggagcctttcccacccccagacctcaggggcaagaggagggagcagatcccagatccagagggaattggggtaatttaggagagggctgccacactggaactcatacagcacagatgctgacattatctgaagccaggcagccctctctgtctccaggttctggtgactgctccatcctcttgtcccagtcccaggggattctgctattacttgtggtttcactatactctttctatacttttataaatataactttattagattatccagtttgaatacaccatctatttcctgaaggaaacctgacatacatggttctttaaaaagactaataaaatagacaaactctag

SEQ ID NO: 239099 - DNA, 411 bp, Homo sapiens
agaaatgagtggggctaagctttgatagtttaacatctatttgacttgagtagccttgtaaacttattaattctcacctcagcctcagggatgtatgtagggaaggagcataaaagatctgcagttgccctaatacagatatttttcccttcacttattttgtaaaattatattttattttcatggtagttttagactcaaggttataaaggcctgcttataatagttctcctaccagcctctgaaactcatctttaatttttttctgtcaggattttctccatcatgcatattaatcacattcctttccaaatttgtatcaatacccataacagcagttaaaatgctcctaacaaaaaatagatagatagatagatagatagatagatagatagatagatagattaaaaa

SEQ ID NO: 239100 - DNA, 545 bp, Homo sapiens
cttacaagaagaaaatatctatattctcaaggttgagaaggcttcttaagatccagaaggcaaaaatataagcgaaaggattgatgaatttgatcattacaaaatgtaaaatttctttatgacctacttttggtataagataaagcaacagactgaggaaagatatgtgacttatgcgtaatgtatgaatgttaaaatctagaacataagaactatcatttaataaaaaagcaaacaagttatacaaaaggaaagcagacaaaagatatgaacagttaattcacagaaaagaaaataaagatggtcagtaaagctacagtaatcaagaaaatgtggtattggcaccaatttcaacaaatagatccatagatcagaataaagagtccagatggagactcagacacatatggtcagttgattttagtcagagatatttcaatgaagaggcaattcaaaatgcagagataatttgatggagaaaagatatatttttaacaagtggcgcaaaaacaattgggtattcatttttgcctttgtagtagcct

SEQ ID NO: 239101 - DNA, 1018 bp, Homo sapiens
tttcccaccttggcctcccaaagtgctgggattatagaggtgagacactgtgcctggcctaattgtcttaaatacactagggttgattctgtcacataaaagaaatcagaataggccatttagggctgatgtgccactccacagtcttcaaggaccaaatttccctcttgctgcttgttctgccttccttagtgggctgactcatggcccaagatggctgctcaagctctggccatctcgtctgaattccagccagcaggaaagaggacatgagggaagaagagcactcctcctcttaaagagaattccaaggaacaccacatcacactaccgcttcaactcatgggccaaaactagtcacagtgctattcctagctgcaaggaagcctggggagtgtgcccagctataaatgtgagtccttgtgactaaagaataaacggcagagtgagttgtagccagcaccttgcagtctatgctgtagctttctttccaatttgaggacttttccagggaaaatcctcacagccaacctctggtgaaactacccttgtgttcccctttttacagcggaggaagttgagagccagaggggtagaggggtagaggggcttgaccaaggtgtcacaactagtgaacagcagagcccttctggagtagcctagagctgcaggcatcagctgggcacagtgcctcaggcctgtaatcccagcactttgggaggctgagacagcaggatttcttgaggccaagagttcaagacctgggcaacataggagaccccatctctacaacatttaaaaattagccagtcatggtagcatgcacgtgtaatcccagctactcaggaggctgaggtgggagaatcactagagcccaagaggtcaaggctgcagtgagctatggttgtaccactgcactccagcctggacgagagagagagaacccatctctctctctctctgttttcatttttcttttttctcatgctattttaacaaaaagcccatcccttaaaaa

SEQ ID NO: 239102 - DNA, 3088 bp, Homo sapiens
  misc_feature (161)..(161): n is a, c, g, or t
  misc_feature (310)..(310): n is a, c, g, or t
  misc_feature (312)..(312): n is a, c, g, or t
  misc_feature (399)..(399): n is a, c, g, or t
  misc_feature (448)..(448): n is a, c, g, or t
  misc_feature (896)..(896): n is a, c, g, or t
  misc_feature (954)..(954): n is a, c, g, or t
gctttttgcagagaggggatgagtggatggttcccctacccaaaggcaggaaagtccccacaatgtggctgagtctggggcttttatgggctcagaataggggaagtgtgggcaaacaggaacagaagttctcactctgggtcacaggtttcatgtgggancagcagtccagtctttcagccttcaggctgtttttttggcttgaaggtggggtttcaccagggacccaccccgtctgcctaggcatttggctgcctcctgtcaccatcaacagggctcagagctgatgcctcctgacccatgtccaggngnctccctttgccagaagaatcagagataaaaagcatctgctgaagaaagtagcttttaatgctgcaaagccctcacaagatctgattnctactgggaatgggatatggtaggaagagcacagcctttggcaccaganaggcatggcttagaatcctggctctgccactggtttactggctgtgtgaccttgggccagttacttaacctctctgtgtctcagtgtcctcatctaggaaatggtggaaacgcctaacttccagggcagcgcatgtaagatgcttggtgcatagtaggccctcctttaatcctagtccctcccggcctgcccctgccaccacccccagtttgtttgcctctgggaccagcagttttggagactccgctccctcctcaggctgtcttcgtggcagcttcccagctcctgcctaataatagctctttatcacattaggagtacatcacaaaaaacagtgctttcctcttctgggtaattagaggtaattagcactgcctttgtgctggcctcctgttttccttgaaaatgctttgctggagaagttgctggcaagggaggtttcattacngctgttggggaaatgctggccaccctctgctcccaacagagacccacaggacctgtcntctccctgctgggccaaccacgcagcagggccctttgtgatcatcccactgggctggccctgttgcaggcagggcgcatctctggggtgaatgaagctgccctcctgcccctcagtctctcctcacagggacaaggttacagtgggtgggggatttgccaccccagggaccaactcatgaggcttctggggcacagagatccaacccacggcaagattctccatgtcccagcagaaatgccaggtggcctagaacttagcaaaaggcttggcacaaagtagatacttgataataaccgcagtagccaacaactcacatgttttacggggtaagtcatttgatcctcatagaggtcctgcatagtggtagtaacccgttgtacaggtgtgaaaactgaggctgcaggcggtgccacggcatgtgagtggtagagccggatgaacctgggctgttaaccactgcttcagtactgcctgcattcacacatctctgtagcttctggtagtggcctctaaccctgtgccaataagcctgttacatgtattatcaaagccacacagccagcccacgtggtataggtctctttattagcctcattttatacatgaggaaattgaggtccaagaagtgaaagaacccaaaggggcctgatgggcttggaaggagtcactggggcagatggaggtgggtgatggcagcctctgtttgggtaagttggggtgtcttttgaggcaggaaacaggaagggctgggccccatttgtacctgcagggatctggttcccacggaaaccccacgatgtgcggggctggctgtggggcacagaggtgagtgagaagtggtctctgctcccctgcgctcagtttatcagggaacgcaacctcatgagcatgtgacgatgacaggttatgagtgccatcacagggtgtccacagaggcccctgccaacacgggaagccacggaaggcttctgcacgccagtcacatccggcgtgtatccaggcagctggcagattcaatcaagacagcctgggagatggtcaggggctgaatcttcacgcagtatcggctacaccagaactttctggtgctgagaagaggctctttcccgacctgcctcacccctcttctctcatctctccagctaactgtaaaaccagagctctgcccagcaactgctcccctgggtctttgcagaggggtggctcagggactagggttgcctgagacccagaccaacttgtagtcgaggagggccagagctgtgtgttctaggacagctctcagtggaatttccatctggtatcagctgcagccagtgggtaccaacacctcccttccttcctggccatctcgtctgaattccagccagcaggaaagaggacatgagggaagaagagcactcctcctcttaaagagaattccaaggaacaccacatcacactaccgcttcaactcatgggccaaaactagtcacagtgctattcctagctgcaaggaagcctggggagtgtgcccagctataaatgtgagtccttgtgactaaagaataaacggcagagtgagttgtagccagcaccttgcagtctatgctgtagctttctttccaatttgaggacttttccagggaaaatcctcacagccaacctctggtgaaactacccttgtgttcccctttttacagcggaggaagttgagagccagaggggtagaggggtagaggggcttgaccaaggtgtcacaactagtgaacagcagagcccttctggagtagcctagagctgcaggcatcagctgggcacagtgcctcaggcctgtaatcccagcactttgggaggctgagacagcaggatttcttgaggccaagagttcaagacctgggcaacataggagaccccatctctacaacatttaaaaattagccagtcatggtagcatgcacgtgtaatcccagctactcaggaggctgaggtgggagaatcactagagcccaagaggtcaaggctgcagtgagctatggttgtaccactgcactccagcctggacgagagagagagaacccatctctctctctctctgttttcatttttcttttttctcatgctattttaacaaaaagcccatcccttaaaaa

SEQ ID NO: 239103 - DNA, 493 bp, Homo sapiens
aagagtctggatttgaatcctgactctgctggttggttattcacaagctttgagataatctctccgggcctcaaatctcttcatctgtaaaattggctagtaagacgaattccttattgtcaggattaaatacaagaataaaatacgaggctcagaacaggtgttagttcatgtgagaaaggaagaactggccgggcgcggtggctcactcctgttatcccagcactttaggaggccaaggtggattggattgcttgagctcaggagttggagaccagcctgggctacagctatttcggaggctgagatgggaggatcatttgagcctgggaggtggaggttgcagtgcactgagattgtgccactgcactccagcctgggcaatagagcaagaccctgtcttacaaaaacaaaaaaacagaagaacctaggatcaagatttttaagatttgagcttcaaccattaggaattgagaagagggaaggatctagg

SEQ ID NO: 239104 - DNA, 1082 bp, Homo sapiens
atcatttgctcccaggcttcccccatcatcaccctcaccacatatcctgctaatatccaacaacaaacaaatatttaatattgaaatagcccattgcctgagaatgaacacaagctaaaatacatgcaagggtacttaatggaagccaaaccatgttctatacctaaggagaaaacatggacatgtagaatgcttttattcatgtattcaaaatcagaacaaatcagtgtatatcactagaacatcagatggaggataacacaagaagtgatacagatcagggttcacttctcttaccctctctctgttaggaccacattcctattttagccaaatgtttctggtacgggccatcttttcaccataaatggcattatgtttcaaatggctaaaagcatattatgggtatgctcaaaggagtaaaacccaattcacagagatgtggcttttctaaagaaccaaattaagggaatacttagtatctacaactaaagtattagtcattctgaggattatttgttgctttaagtattagctccctactacatccataacaccctacttactaaatttaattacacacaacttttcaagaattcgtattttatttgaagggaggtacctgtctactttatctacaataaaaacaaagggtattggctttctctaatccatgcaaactacaaattccatcgggagtcctacatcactaacagtggtatgaacaaaactaagaaagtacttcctatccacatgtgaatgttttaaaaaagtttttgccataaaacctaagtgtaatttagcataccacagtgctctgaagatgggtcattgacgatgtaccatttgtatataggtaatacacatgtaaatcactaattgttaattaaatataagaagtaggtttttatctttttaaaaaaaaaacaaaaaaggtgactccctttctcattctgttctgttgtattgcgtccaaaagttgtgtgtaatttttttaaggtccaagaaatgtaaagaaatttgttggaatacctgaatttctgtaaaaaaataaaaataaaaataagattttgttacttaaa

SEQ ID NO: 239105 - DNA, 442 bp, Homo sapiens
acagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggggaaactcatttccatttttaaccatattgggcctgagcctcagttacctacctcttctgtaaatgtaaactacctcttggggtccttgtgaggattaaatcaaacttgagcctaaagg

SEQ ID NO: 239106 - DNA, 579 bp, Homo sapiens
gtttattttctttctttttttcccccgaatattttcagtcctcggttagttcaagacatggaacctgtgaatacagggctggctgtggcatatgatggcatgggacgcgtgcgtaaggcccttgtgctgcacactgaagtaccattgctggctcaaggaaaagcacttgagagactgagctgcacgctgaactagctgctctttttgtgggatgctatttttacttgaaagaacaacagaaagacttgagtattaaagagagtttaaaaaatgtaaaacagtgtcactctttactaattttttgttttgaaagttttttcataaaaatgtataataggtttattggtatttttgaatgaattatttatatttttctcagtatttctaattcagtatcagtaatctaacccatataaacaagtagtttgagaaccttatatgttcagccctacctcatggttccgtcttcctcacattgtgtgggcttctgtgccacagctggtttgatcttcctctctgatagcaagctcttatctacgtatatttcagttaaattcctggccaggcatggtggctcac

SEQ ID NO: 239107 - DNA, 375 bp, Homo sapiens
ctgattgaatttaatatccagtgaatagtctgtgcctacttttgcatatattagtctttgggatctcaattttcctatctatgtgtatttcttatataatacaaagattaatacatttattgcaaacatttttcccaatctattttttgtctttttatattatgttccacaaagtttttagttttttatgcagtatttacttttatatccatatgctttttaaaagatgattttaattatttacagtacctaaaccaaaagtggaactcagatatttgctggtggttaaatacttgtaaatagaaattctttgaaagcacaatgataactgccattagctaggtcacttttgtagcagttatgacctgagtttct

SEQ ID NO: 239108 - DNA, 478 bp, Homo sapiens
tgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggttgcagtgagccgagatcacgccattgttctccagcctgggcaacaagagcaaaactctgtctcaaaaataaaataaaaaattgctttaaaaaat

SEQ ID NO: 239109 - DNA, 324 bp, Homo sapiens
caaggtttcaggcatgcttgtaaggaccacaaggtaaaactgttctgccactgtgtgtgtgtgtgtgcacgcacatgcacatatctgagatgggtggcctgattgatgtgttgcatctcatgcattttaaattaaagtgtgtcagctgagtggacataccaaggagctccaaggcacatgtcccactcaagggagagacgttgggagtgagaataagagacctatgcccagtaaaggaatcccataccaatcttccctctataatatgaatggatggcccagaagcaccaggccaacaagaaggatcaccagtatggataagga

SEQ ID NO: 239110 - DNA, 589 bp, Homo sapiens
aagtcagctttgaggggacctgctcagttctgtcgggagagtttgcgtgttttacatacatctgagatgtttcagtagctggttagatatgtgagtctggagctgaaaatagcattattattttctcttttttaactttataaaacttagtaataaaagtcatacatgtctagtggaactagtgaaaaataagagaaagttaacagcccaccctctgtccccggcttcctgcctgtgctggcgcatccaggagacacagctgcccgccttgagggtgtatgcgttcttgcaagtcaaatgatttactgcacattattctgccacttgcttccctctaggagggatgtccgtccaggtggggggagaggtcaaactcaagagtttaatagttgcatagcatcccctcatatgaataaactcttcctccactcatggacatccaggatctctcgtgtttttgcaattattaaacaaggctgtaataaacattcttggacatcaaaaaaccaagaagaaaaaacaaaagcgagaaacacgacaaagacaagaccacaacaacgatagcaataacacacaaccaataaggggg

SEQ ID NO: 239111 - DNA, 747 bp, Homo sapiens
cttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcac

SEQ ID NO: 239112 - DNA, 457 bp, Homo sapiens
gcctcaggcccttgcccagcgtccccattcaacactgaaaaccctctgcacccagcgccagcctctctgcctgcttcctttttccggggcacttaccatcatctgacacgtcctgggtgcttattccccgcagagtggggaagcccaggagcactttagtctgttcactgccaaggccgggatctggccctcagaaggtgcttcagagctgctcctccagggtctgtgaccccaggctgctctgggccagtgctctgaaatcttggagtgagcgctgtgcccagatcccagctggctcgcagagagcaggaactccccgctgcacacccacctgtcttttctccatttctccatcttgtgtttctggcttggtgggactcgtggctctactcaaatgggagtgttttgcacgggaacattttgcctgttaaggtaaaaatacagcacaaaggaactg

SEQ ID NO: 239113 - DNA, 209 bp, Homo sapiens
agagccagtagcacaatgctccagatccctccgatttcagcttaaactgttatatttccttcgatgaatcttaactctactccttctctcttatgaagaagatccttgtgattacaatgggctcactcatatattccaggataatctctccatcttgacatccttaacctaagcacatctgcaaattcccttctgccatttaaggtagc

SEQ ID NO: 239114 - DNA, 156 bp, Homo sapiens
gctccggcgagcgcaccggccccgcccccgagcccacgtgaccctgctcagccattttggagaaaagggcgcgctcctccgcctacctcttgagcgtggagggtagatgcttcaggtgaccttttacgagcgtggcgtgtcctggatggcggccgc

SEQ ID NO: 239115 - DNA, 437 bp, Homo sapiens
ctcaaaaaagaaaaataagaaagcaagatcaggagaaatgagactggagcagaactgtcatgcactgatcatctctgtgtggaatgcaaaaatggatatggatattaaactccaggagatgttatttgggaaaggtgactgcaagaagtcaagctattcagagactatacctgatcatgaacattgttctacctgtaatcgtgctgagagaataatatactggtgagggtgtgagggtgaaagtattatcacatttgcaaagtataatgcaatttctctctcatggagtaaaactctccctctctctctctctgtctgtgtctctctctctttcctacctccactgttctagtagaccttgacattctgaaactggcccaactgtcccatagaactgatgtttatggtttctttgaataaacacagaaattgatcct

SEQ ID NO: 239116 - DNA, 443 bp, Homo sapiens
ctaagagtacctaatcctgccatttatgctgcaaagctttgaaatgtcctcagagagaaaggagtcagttcaaatgattaatttaaaatgaaatcagaagaagcaaaaattataggaacaatggcccttgtatttcaggaggggactgatatcgtgcaagggcaatggagtttgcctgtaaatagtggttataattcctaccttaaggattggagaaatacagagtatagacctgtgctgtcaatatgtggctgctgcctatatggacttctgagctcttaaaatctgactagtctagaacaagttatatgtaaaacatacactggattttgaaatctgagtacaaaaaataatgtcaatatctcatcaataatttctgtataattacatgttgaaatgatagtatcttggatatgctggattaaataaattttattacaatt

SEQ ID NO: 239117 - DNA, 347 bp, Homo sapiens
caaagaagaggtttctttctttctcacgtaaaaatgaaaaaatcagctggcagcagtggctcacacctgtgatttcagcactttgggaggccgaggcaggaggatcgcttgagcccaggagttacagaccagcctgggcagtgtaatgagaccccatcgctgcaaaaaaaattttttttttctaattagctgggtgcggtagaatgcacctgtagtctcagctacttaggaggttgagatgggaagattgcttgagtcccagaagttcaagattgcagtgagctttgatcatgccattgcattccagtctgggtgacagagcaagaccctgtctcttaaaaaaaaaa

SEQ ID NO: 239118 - DNA, 1955 bp, Homo sapiens
  misc_feature (1397)..(1397): n is a, c, g, or t
ctcatatgctttttttaaaaaaagaaataattgctcataagaagaaaaaatacagaattattgaaaacaaaagtacctcaaccttcagttctcagatatagtactataaataattagttttcaatcttggcaggctttttacgtagtcacatatgatttgagcatttttttcctcttttttacacagataagattatatgtatggctatatgactttactcaaaaataagtcttgaagatctgtccataccaataaagatctgtgtaagattttaagagctgcaggagattgttattgattttgattagattgcactacagcctatacagtcttctatttagattttgaggttttacttgtggtctagaattgattgttttgtacaaaattcaatgtactcattcagcaaatacttactgaatgtctgctgtgttgcaggcactgacctaggtttcagggatatggtggcaaacaagaaagatgtgaaagacagtcccagccttcccaggccttataatcaatggcatttgaaactaacaggtctgctacatttgttctgtatacgcacacgtgcgtgcacacaagcacactcgcacgcgcacacacactgaatcttgccagttgtgtccatctagtccagggttctgcaaactttttctgaaagagccagatattaagtattttaggctttgtaggctacagatggtctctgtcacatattcttctttgttttggttttggtaaacatgtaaaaatgtaaaaactattcttagcttgtgggcagtaccaagacagaccattggccagatttggcacaggctatagtttgccaacccctgatctaggcactatcaggaattttttgatctgtggaatacagagagagatgtattaaagaattctactgtgattgtaacattcttatgtttgtttttctaaaatctcaatgtgcatctaatcatgtttcagttcactcctgttcttcacagtaattctttttaattgagctttctccatgcctggctttgtccccttttcatgtcattgaggctggtgatttttatggctgcagctgttgttggctacacgtatttatagacagcagtttgcttgattaggatgagaagcatgggtggctttctccatggttgtataggtcaggtcctgaatcccccagtgtgcttctgtggcctttggagtcagtcagggacagaccttgtcctgagccactgtgggcagtgaagacaggacaggctgaccaggtttgtagactggaaacagaccagtagacagagcaaagatgtctctccaccagtcatgaaatttggagatcaagggctgattcgagaagttgcttaggaagccactgagtattgtaagacccacctgtcacagngtccttgactttgaccaccaactgctctaagtctgtcactcttttagtctcttctggaatgatcttaggacagtctgtcttgttggagtgttggttgtccataggaagtaaagaaaggattccactattctactgagccatgacttcttcatggttgttgctttggcaacctactatctctgaccaacatgtggcctgcctcactgcagccagccattccatgtgcagggaacaggcacagctttcaccttaaaatccttcatctcctgcccttgctaccagtccctgccacttcaggcttcaggattctcatctatccctctgaggggttttctccttccactgagtagagtgcactgccctgagtgagccgcttccccatcagctggatcccatctcttataaaaatacaaaaattaaccaggcatggtggcacacacctgtaatcccagctacccaggaggctgaggcagaagaatcacttgaacctgggaggcagaggttgcagtgagctgagatcatgccatgcactccagcctgggagatggagggagactc

SEQ ID NO: 239119 - DNA, 550 bp, Homo sapiens
gagtgtaatggtgctttttctacagccatgaaagaggctgacacctgcacactcaggcacgacttaaaatagaacttgtcaaacagtgatcctctctggatcaagctcggaacaacaaacagctcttgaactcgcctcccagcctaaaaagactgcagtgtgtgacactgtggggtagtttggtgggaacgacaaatcccacactttcaaaatcctgacaatcctcaggtatgatgccaattattaatgtttccttttttcacaggcacgtacaattcagaggactttcgaaattatctaaaaacatgggtgattctcactgccagccttgtctgtgagaaaagtacatatctatgtctgcacagatacaagagacaaaaaataaacctttaatttttaaaaattaaaatgtacacagtaatcttgctgttagtattgaattaaaactaaataggcatgactgttccttgaaaggaatgatataattttctttaatatttcatgaggtcttcccttttcaataaagattattgcaagtcaccagaaaaaa

SEQ ID NO: 239120 - DNA, 465 bp, Homo sapiens
attcaagtaaggcttaaggaattcagtggattagtatatgctctcatctattttttcacattcctactatgaaaaaatttcaggcaatgccaataaagcaaaagtccctgtttgccctcatacagtctcactcccctcctcaaaggtagatcactgttatcaggtatgagctatctaggccttttttgaggtattcctatacaaatgtatttgaaaatctagaaatatatagcttgattttctttatataaatataaacattatttacatattttatttttcacttaagagaatgtcttagatctttcaaggttagtggcatcaatctcttatcttgtcaaaatatggttaaggtattacatattatgactgtgctgtagcatagggaattaacatttgactttttaatctgaatgtgttagagaatttacctgcagtattaaaatcacaagttattttctctcc

SEQ ID NO: 239121 - DNA, 474 bp, Homo sapiens
ttagtgatgctcataaccacattctctctgacccctgctgatagaggcttcagtccagggaaggagttaaggtttggagtcaggaaccagcatctcaccacagtccgcctgttgtttggtatgggctgctggatgtgccactgaatcttctgaaatcttaggttttttagctctaagtgggaaatgatgatgatgttacttgttttgccaacctcataggttggtggtaaatgtcaatggtcacgacgcaacatctgtaagctctaaactgttatactgaacatgaactgaacttaataaagtcagtggggcaagttctgcctttctggtttcccaatcctgctattgtcattgtcattttctcaggacacacagagattgcctaagttgcttgaaggtaagtttgactcacaaagtgaggaggaggtaagatgtgcgacaggaatgaagaaaaagaaatgagtcatactaaaa

SEQ ID NO: 239122 - DNA, 1657 bp, Homo sapiens
  misc_feature (22)..(22): n is a, c, g, or t
  misc_feature (1409)..(1409): n is a, c, g, or t
acagcgctaaaaaggcctggangttcggactgggtggagctcaacacagtgtggcaaagtggctgcagccagactgcctctctagattcctcttcactgggaagggcatctctgaaagaaaggcaccagccccagtcaaggggttatagataaaactcccatctcactggaccagcgtatctgggggaaggggcggctgtgggcacaacttcagcggactttaaacgttcctgcctgctgactctgaagagagcagcagatcctgacaaggagggctctcccagcacagcgcttgagctctgctaagggacagactgcctcctcaactgggtccctgacctccatacctcctgatggggagagacctcccaacagcgattgtcagacacctcatgcaggagagctctggctggcatcagcctggtgcccctctgggacaaagcttccagaagaaggagcaacagcaatctttgctgttctgcagcctacactagtaatacccaggcacataaggtctggaatggacctccagcaaactgcagcagacctgcagaagacgggcatgactgttagaagaaaaagtaacaaacagaaagcagtaacatcatcaacataaggaacccccatacagaaacaccatccaaagatcaaaggtaggtaaatccataaagatgaggacaaaccagcacaaaaacgctgaaaattccaaaaaccagaatgcctcttctcctccaaatgattgcaactcctctctagcaagggcacaaaactagacagagaatgagtttgatgatttgacagacgtaggcttcagaaggtgggtaataacaaactcctctgagctaaaggagcatgttctaacccaatgcaaagaagctaagaaccctgacaaaaggttacaggaactgctaatagaacaaccaatttagagaagaacataaatgacctgatggggctgaaaaacacggcacaagaacttcatgaagcatacacaagtatcaatagctgaatcaatcaagcagaagaaaggatatcagagattgaagttcaacttactgaaataagacatgaagacaggattagagacaaaagattgaaaaggaatgaacgaagcctccaagaaatatgggactatgtgaaaagaccaaacctacgattgattagggtccctgaaagtgacaggggagaatggaaccaaattggaaaacacacttcaggatattatctgggagaacttccccaatctagcaagacagggcaacattcaaattcaggaaatacagagaataccactaagatactccttgagaagagcaaccctaaggcacaaaatcatcagactctccacggttgaaatggaggaataaaagttggctgagcgtggtggctcacgcctgtaattccagcantttgggagcccgaggcgggcggatcacaaggtcaggagatcgagaccatcctggctaacacggtgaaaccccatctctactaaaaaaatacaaaaaattggccaggcgtggtggtgggcgcctgtagtcccagctacgtgggaggctgaggcaggagaatggcgtgaacccaggaggcggagcttgcagtgagcggagatgtgccactgcactccagcctgggcaacagagcgagactccttctcaat

SEQ ID NO: 239123 - DNA, 359 bp, Homo sapiens
ggaaatcataaacctatttaaatgtcatttgttttatatccctttatttttgccaggggtatgtcctttttctgttgttcaaagttatattactggccagaatggaaattataggaactagctatgtatgaaattgcatgttttccatccattgtggccaggtttggtattcccttaagatggcaacaaagtaagaggcatttcttctagcacttattcgtgaacccagtgacctccaatttcccattttaaaagtcatctttatcctcggaactttaacctactggcataagaacgtgggcttaagttcttttttatcactttttggagttaaaaaacctctgagaggccgggcgtgg

SEQ ID NO: 239124 - DNA, 703 bp, Homo sapiens
  misc_feature (508)..(508): n is a, c, g, or t
  misc_feature (561)..(561): n is a, c, g, or t
  misc_feature (643)..(643): n is a, c, g, or t
ttatatactttataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacgggaaccaacctaaatccagaattcatttcagtctgcaacaatgccacatgggcactnggagaaatctccattcaaatgggtatagagatgcaagcttatattcctatggngtgcaccagcttgtagaatcattaacagaccaacacacccaagacgttgttagagaatacagcaataacaatttgtcgtctngggtacgttggccctaaagagtggcccccattgcttcagaggttattaagaccctggtgc

SEQ ID NO: 239125 - DNA, 386 bp, Homo sapiens
gccttaggcctaaagcaacaaccagaagccttcctgggtgtttacattacagcacaccagactgcaggcaccgccaccccagactctgcctgcagctaaagtcaccaagtttgccgtgccccataactgaggtcattggcagcccagcaccaagcctcactggcatcaagggcagcgggttagtaagcatggctccacacgggtaagcagttctaggaaatgggaagaaacccagaccatccatctcagggccaggctctccttcccccatggtaagaaggtgaagacttggagattggtgagtcaggcaatcaaggtcaaattgacatactctagaagattacatgccgtgtggaacagtactgggcagtggacccactgggaca

SEQ ID NO: 239126 - DNA, 303 bp, Homo sapiens
cgtcctagatcgggaacaaaggagtcaacgtgtggccgggcggccaaaggtgagtcggtgccagggcccccaacttcctattcccccacccatggaccttctgttcccctcccctgggaatgggggccgtgatctaggtggctccgtaggggttaatcacgggcggtccagactgcgggcagcgagaccccagggatcaggaaccccccccaaggccccccgtggccgggccgtatctcccctctcctgcagctgagcgctgcggttggagaggaaggagccgcccccctccccctgcggccg

SEQ ID NO: 239127 - DNA, 502 bp, Homo sapiens
ggattttacagctgtcgagagggtgaagaaatagattcttgattaaggaaatggaaaacagctccaaaagccaaatgacagaacgtctccagcaatcaatagactgcagaatcagtcagaatcagaatccctgccacgttgagaagccacaacttcagctgctcactccagactcatgctgcttgaatcagaatctggcttgaaaaatgggcccctgtctcctcatttaacccagttcagaagtcaggactcacacaggtacatgacattggctgcgccagcatcacagctggaatcccggctataaagaagtctgagaaaggcagttcttagcttttccactttggactacaggaagatacagaaggaggttgaaatgattattttgtgatccagtccatacatgcaccacactctaaacattcaaattataagaaatgtattcaatggctttaaatgactctgaaatacttttgattaaacattttttaaaaagcatgaa

SEQ ID NO: 239128 - DNA, 428 bp, Homo sapiens
aggtggggagaccacaggatgacctggagccaaagaagaagggcccaggtcccagggtctctacagcactgccggccttccagccacagtttttctcaatcttcctgtcatatccctcaaggaagtaagtggacattgtaaagagcgagtaattatagcacaacaaaaatcaaaagtcatgattctggaaagcattatcaataaaaaatggagaaatagttgacatctcttcatgtttcctctggaaatttctgattatgtatgtatactcttccactctaatatccaaacaactctcttacttcttcatgcaaagaaacatgaaagaatgaaaaggttcatcacaagtgtatgattaattttgtatatataattttgcaaattaatagattttaatgtgttcaataaatgtacataaatacacatgt

SEQ ID NO: 239129 - DNA, 699 bp, Homo sapiens
gagagaactagtctcttaaaataaaaattagccatatgtggtggtgtgtgcctacagtcccagttacttgggaggtagagcaggaggatcacttgagcccaggagttcaaggctgcagtgagctatggtaatgccactgtactttagattggggtgacagagcaagacgcctcttaaaaaaagagagaaagagacagtatatttataactgtatgatcttagcacaaaaaattacacagtccagaaactgattcaagtacctattataatttgaaatacattaaaaacattttttacaacactgaagaaaagcagagttattcaataaatggtgcttggttaactgataggagtttggaaaaataataaaggtaaacttttattccttattctaaaattaactccacatggattaaatatttaaatataaaacatgaaaataaaagtattagaacaaaataatagagattaaaaacataattatctcgagagtgtgatcaaaacctgtctgttaaaaaggaacatttgatacattttaccatataagaactaaatgcatggtaaccatcaatagaatcaaaataaaaaacgaactgggagaatatttacacaaaatcatatcagaggtaaaggaataactcttcttaatatacaaagagatcttacaaattgtaagtatacattccagaacttcctaga

SEQ ID NO: 239130 - DNA, 678 bp, Homo sapiens
gcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaagaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattg

SEQ ID NO: 239131 - DNA, 708 bp, Homo sapiens
tctgactgaagaaatacttgcagacattcaagaagtaattaatctttccttcctcttcatggtttgcatcatataaactactgcattattacatactcttctccttaggtcgtttaagtcattattagagatcctaaggttgtatcagcctctggttgatgatcacattttcagtctggttctaatgctattttcatatcatgccagacaagttggcaagtgctagacatttcccatgtatttgtactaagtctttgtctcccctttagctccttttgtaaccatttcacaatcaccatcaatattattaaacctgttgtatgtaggtcactgggatgctagaggcagggttaagtcggggtggggtttttttggttttttgttttcaaaggactaagaaacaattgcggccgcatgcggtggctcacacaggtaatcccagcactttgggaggctgagggggcgcggatcacttgaagtcggaagtttgagaccaatctggccaacgtggtgaaaccacatgtctactaaaaatgcaaaaatgagccagttgtgatggtgcatgcctgtaatcccagctacttgggaggctgagtggggagaatcacttaaacccgggtggcggaggttgcggtgagccgagctcatgcgactgcactccagcctgggtgacagagcgggactccatctcaaaaaaaaaaaaaaaaa

SEQ ID NO: 239132 - DNA, 1164 bp, Homo sapiens
ggtcagctgcacctagaaggggccccctcctggctcaaaaatggctgcaaccacatgagccatgtgactcaggatggagggtggcactgtccacaaatcggcttctctgcagagcccactctgcaaggctgcggtgaggggctgaggctggctgcctggtgggatggcctgagatcctgctcctgctagggccagaggccaactgcctctagggttgcttggtgcctcagtaacaggtggtttgagtggatgtctcctgcaggaaccatgactagaaatgtggttagacaagaatttgaggctccagggaagccacaggattctagccagcaggatgcctgcttaatcctcgtaaaaggaaactggacaacaaacgagatggaggtaaaatgaaatcccaaaggaacgcctccaaggatcccgtcttctacctgtcaggagatgttctatttttctaacttccccaccttcagcataacaggatttagtaactgtttagaccttttgaagaacaaagacaaaaataggaagttgtgtcagaggagtgcagtcatctcttattcatggtagtgttttggttcgattttggagcatccaccaggttcgcgtacaggagaagaaacacggatgatctctgtctttattttgggggaggacaatccggccttcttgggactgttccagcccacctcccagatgcttcggtcagtctgatccacgagatatctcaggctgggaagaacacatcttgggccaacttccacagcagccatgcgtccaaggatacagaatcaggcaggccgataaaaggattttgacttgggtttcacaggaaggaggtatgccatcaaaccccactgtagtcaaggatcagaaggtgcttttagcaggaactgaagctttttagtataaggcccacttagggtgccagcaccctgacagtgtccctttaatccacttcagatctggttgactcatcatcaggtgtttccattcactttcaaaattacacagtcacaggataacagtgagatccactgctaaagggtaaagggtcagaggctgaagagtactgtgtaatgtctgcatgagatttgttttaaaaaagtctgaattggcatggtattttgaatgctgctggaactgtaataaaggttcaccttt

SEQ ID NO: 239133 - DNA, 1271 bp, Homo sapiens
ggtcagctgcacctagaaggggccccctcctggctcaaaaatggctgcaaccacatgagccatgtgactcaggatggagggtggcactgtccacaaatcggcttctctgcagagcccactctgcaaggctgcggtgaggggctgaggctggctgcctggtgggatggcctgagatcctgctcctgctagggccagaggccaactgcctctagggttgcttggtgcctcagtaacaggtggtttgagtggatgtctcctgcaggaaccatgactagaaatgtggttagacaagaatttgaggctccagggaagccacaggattctagccagcaggatgcctgcttaatcctcgtaaaaggaaactggacaacaaacgagatggaggtaaaatgaaatcccaaaggaacgcctccaaggatcccgtcttctacctgtcaggagatgttctatttttctaacttccccaccttcagcataacaggatttagtaactgtttagaccttttgaagaacaaagacaaaaataggaagttgtgtcagaggagtgcagtcatctcttattcatggtagtgttttggttcgattttggagcatccaccaggttcgcgtacaggagaagaaacacggatgatctctgtctttattttgggggaggacaatccggccttcttgggactgttccagcccacctcccagatgcttcggtcagtctgatccacgagatatctcaggctgggaagaacacatcttgggccaacttccacagcagccatgcgtccaaggatacagaatcaggcaggccgataaaaggattttgacttgggtttcacaggaaggaggtatgccatcaaaccccactgtagtcaaggatcagaaggtgcttttagcaggaactgaagctttttagtataaggcccacttagggtgccagcaccctgacagtgtccctttaatccacttcagatctggttgactcatcatcaggtgtttccattcactttcaaaattacacagtcacaggataacagtgagatccactgctaaagggtaaagggtcagaggctgaagagtactgtgtaatgtctgcatgagatttgttttaaaaaagtctgaattggcatggtattttgaatgctgctggaactgtaataaaggttcacctttaggaagtgctgatggcacaccagggcccagcacaccgcatgcactattctatagaatttgcccaacaccctttgtgctacagattactattatacccattttacaga

SEQ ID NO: 239134 - DNA, 332 bp, Homo sapiens
ggggagccccactcagggcgtaaatacatttggttcactgtgagattctgggggtactgacagcggcaaacactgtcctagggaagtcacgtgacatgagggcaaagatggtgacggcagcactggttataagaaaagaaaatgaaaacagccgaaaacggctcaaaacagggacatgacgaaggaagggacactgtatagtgagcaggtttacaagatgcttccgggataagcaggagggaaaaggcagaaatgtccacataaccacagctgcggccaaatcctcagaattatataacagcacgaaacattaaagaggattttaaatctga

SEQ ID NO: 239135 - DNA, 407 bp, Homo sapiens
ggggagccccactcagggcgtaaatacatttggttcactgtgagattctgggggtactgacagcggcaaacactgtcctagggaagtcacgtgacatgagggcaaagatggtgacggcagcactggttataagaaaagaaaatgaaaacagccgaaaacggctcaaaacagggacatgacgaaggaagggacactgtatagtgagcaggtttacaagatgcttccgggataagcaggagggaaaaggcagaaatgtccacataaccacagctgcggccaaatcctcagaattatataacagcacgaaacattaaagaggattttaaatctgagagtctaagtgtttttctctacttttttgcattttcaaaattctgtacctgaacatctaattccttttaaaacta

SEQ ID NO: 239136 - DNA, 1032 bp, Homo sapiens
cccagaggatgggcacggtggcctgcacctgtaatcctagcactttgggaggtctagatgggaggatcgcttgaggcctggaatttgagactgctcactgcagtctctgcctctcgggctcaggtgattgtcctgcctcagctccctgagtagttgggattacaggcatacaccaccatgcccagctaattttgtatttttagtagagacagggttttgccatgttggccaggctggtcaggaactcctgaccccaggtgatccgcccgcctcggcctcccaaagtgctaggactacaggtgtgagccaccatgcctggccatgaatgagttttagaaatggatagtggtgatggttgtataatgttgtaaatggacttaatgccactgaattgcacagttaaaaatggttgaaatggtgaaatttgttatgtatattttaccgaaataaagaatagaaatgtcatactccatgagaaatctcatactctcatacttagtagtcactccccatttcctaacaaccaccctgaggcagctactcatctactttgtctttatagatttgcctatgctggatatttcttataaatgaaatcataaaatgtgtgggtttttttgtgattggcttctttcgttaagcataatgttttcaaagttaatctgtcttgtcacatcatatcagtacttcatctctttttattgttgaatagtaatttactgtctagacagacaatatttattcattcttcaactgatggatgtttgggttcgttctacttttggagattatgtataatgcttctgtgaacatttgtatacaagtttttgtgtggacatgttttcaggtttttttggtatatacccaggagtggaattgctgggttatataataactgtttaagcttttgaggagctgccagactgttttccaaatcagctgtaccattttacattcccaccaacactgtatggaggctccaatttctccacaacatgaactgcttttgaataaagatttaaatcattcttt

SEQ ID NO: 239137 - DNA, 1427 bp, Homo sapiens
  misc_feature (1383)..(1383): n is a, c, g, or t
gacacattgagcgaccctgcatgactacagagatgggaatttccagagtcaggctgcacacagatgtgcacacagccagctctgacctccagcagaagacagtcctcccctcctttgcctttcctctgcgggccttaactgccaaaggtcactctgggagcttggccactcctgcccctgccagactggcagagtgggtggcctgagtcctgcacttacatctggttcttcccttggccattgtgaccccacactgcgctctaccctcccacaaccagctcctgggccccagtgggtctcactgtccttatgtctgctggtggccttcctgtggctggcctggccagggaggggagtgggacccacacctcctggtgctgggcccagcagagacagtggtcctaggagaagccaccattaggtttctcatcaagatcaatgggagattgtgaaaaataaccttcctctcttgtggcagcagggactgtagtcagagctcaggttgggaggtgttctgactcctcagggtcacggtcagtggctgtcccccagtaacgccccatgactgcccggctccctagcctactccccagccattcatgaattctcacctcactcctatggggaggcggggaggcactgccattcctattctagacactgaggctcagaaaactggaacagctccaggactccatgagcttgatcccatgagctcttaggagaaaggagcgaaagacccgcagtttctgcgacaggcgctgctgtcgcggtgttgaggctgtggtgtcttcacagctcagcccgtgcactgggaaccccttttgcctggcttccagccttgttgcagggcactgtgcgagatgggccctaatttgctcccacatttcaaaagaccccaggctgcactgggaagaaaggggctctgcctcagccctccaggtagagcccaggagaagggcagagctgagagccagaagcctgagggtaccaacgcccatctaggacattgtctcccgcattatctccctggaccctcacgcagcccacaaggcagctgttggtatcatccccacttcacagatggggaaacagaggcctgccccagactgcaggctacaagagttgtggctgagatttgaaccctgctctgtcttactccagagcgcagcaagtccctagggcttgggggttgcggaagaagacgcaggaggagaagggcatgcctttaaccagatggcagaggaggggcccatcccagccgtgcggccggtggtctgttgtgccctctgagccctccagtgagtgcacacaagccagactccacctggccgcatcccctgcgttagccacgtgacctggagctagctgcctcccattttnggactgtggatccagagctaggaagtaaaggaccccaacatttt

SEQ ID NO: 239138 - DNA, 466 bp, Homo sapiens
cttatttacacattgcaatatagttaatagaaaaagaagctacattgcccatcaatgatagactggattaagaaaatgtggcacatatacaccatggaatactatgcagccataaaaaaagatgaattcatgtcctctgtagggacatggatgaagctgggaaccattattatcagcaaactatcacaaggacagaaaaccaaacaccgcatgttctcactcataggtgggaatcgaacaatgagaacacgtggacacaggaaggggaacatcacacaccggggcctgttgtggggtgacgggagtggggagggatagaattaggagatatacctaatgtaaacgacgagttaatgggtgcagcacaccaacgtggcacatgtatacatatgtaacaaacctgcacattatgcacatgtaccctagaacttaaagtataataaaaaataagtaaataaataaataa

SEQ ID NO: 239139 - DNA, 401 bp, Homo sapiens
aggtcattctaaatcatgtgtactatgttacctctactttgctgttggcattttggtatataacatgatgtgatttctttttatgccattttttttcttcccttaaaaaatagttaaatagcagtcttggtttcattggaaatcaaagtcaggcagtcattaatattgaatgactgcttcaccttgaaataataaatctgaggctgaaatggagctagagaatcattaaaaggaagtgtaacttattaattttgattttgaagtcgataaagtgacacacttatggcttgatcaggaatttgtttgaaacagtaaccatcataagttttagtactggattataagaaactcaaggacacagacaaactcttttcctttttgtaaacctagcatatagcaca

SEQ ID NO: 239140 - DNA, 331 bp, Homo sapiens
gagacagggtcttgctctgttgcccagtctggagtgcagtggtatgattgtagctcactgcagcctgtactgggctccagcgatcctcttgcctcagccttccgcctcccaagttgctgggtctacaggtgctgggagtacatgcttgcaccactatactggctaaacgagtatgaatattactttgcattacaatggaagcctctatttatgcttgtttcctaatattctcagtacattctgtgtttattttctcatttaagcttcttctcattcattttcttaaccaaatcccgctttcatcaaacccttcttcttgaagcctttttaa

SEQ ID NO: 239141 - DNA, 103 bp, Homo sapiens
gattcatataaactaattacaatgtatgtgtacatcatatttggattccgatttgatagcatatctgttaaaaaaataaacattggggaaatttgaacattca

SEQ ID NO: 239142 - DNA, 331 bp, Homo sapiens
tctttccactgtcccagtgcagccatccagcccagaacacaacaagaatagagttgatgagccctcttctcctcaacaaacacctgtgatgagaacattgaggcaagggaacaggtggccaaaaataccctcatagccttgagaaagtccatcttgatgttatccagtgaaacttaatggcaacgcaggagccagggagcctgctttattttggaaatgaaaaagtcagtacagttgatgagaatttgaagagaaaagacacaacaaagtagaaggctaacaccaattccaaacaatagtaaagaatcataataaagttactatgaatcaa

SEQ ID NO: 239143 - DNA, 1111 bp, Homo sapiens
ccttgaataaaattttttgaaaactgaataatgatataatacagctttcaaattacttcatgctgttaatttattcctgttttattcacatgtgaaagcatgtgatcaattgctgctgcattagagatattagatatttttaaaaattatttggatattatgaccttttctataaaagaataaggacattaaaatgtaagatgcataatgaaaatataagtggagaggttctttgtagtaaacctctattaagtataaggtaaatgttcagagcaatacttttctacattatagtgtcacaaggaaataattatagttaaaagtatattaaaataaaatagtatattattttactaattgtacttttatgtaatgaaatacagtacatttaaaaattgctagggctgggctcaatggcgcatgcctgtaatcccagcacttggggaggtcgaggtgggtggaacacctgaggtcaggagttcgagaccagcctgaccaacatggagaaaccccatctctactaaaaatacaaaaaatacaaaaaatacttaggaggctgaggcaggagaattgcttgaataagggaggcagaggttgtggtgagccaagatcttgccattgcactccaccctggacaaaaagaaaaaaactgcctccaccccccccaaaaaagttagattatgtgtgaacttaattttattattttttaaccatgttaagactactgtgcatttaatgaagcattattatgccactaactttaaacgatcctaccttactcaagggtgaagctacaagatggtaacaatacacaatttggcatatagtggaataacatttctagtaatcactttgcccgtggctttaaactgcaaatgagttaaagaatattgttcccacagattaaatttgtactctattttcttcttggaatttgttatttgtatttgtgcgtatatagtatgtgtatgtatttatgccttatatggcatcttttgactcaggcctacaatatgcagtaattacattagggtaaataaggtgtccgtcacctctagcatttatcctttgtattaccaaaagtgtaattatatgcttttgttcattttaa

SEQ ID NO: 239144 - DNA, 318 bp, Homo sapiens
gttttttatttgtgattcatgaatcaggaaagcatccattctacaaaatacagtgagcactttcatggggccatggaagaatagtgggttttgtaaggaacaaagaaacagaacagtaggaaaaaaactgattgattaacatcagattacttcaggttacttttctagaaagggtaaaagcagagagaaccggccagtgtggtggcttacgcctgtaatctcagcattttgggaggccaaggtaggaggattgctagagctaaggattttgagaccagccttggcaacatagtaagatctccatctctacaaaaaaat

SEQ ID NO: 239145 - DNA, 406 bp, Homo sapiens
agttggtggcctggatttgttccataggctacatttgccagtcttgctctagataatttaacaaaaatacttgaaatagcagtaactctgccaatttgttgaagaattaataagttacatatggccgggcgtggtggctcacacctgtaatcccagcactttgggaggctgtggcaggtggattacctgaggtcaggagttcaagaccagtttggccaacatggcaaagccccgtctctactaaaaataccaaaattagctgggcgtcgtgacgcacacctgtaattccagctactagggaggctgagacagaagaatcacttgaacccaggaggcagaggttgcagtgagccaagatcgcatgactgcactccagcttgggtaacagagcacgactctgtcttta

SEQ ID NO: 239146 - DNA, 945 bp, Homo sapiens
tcgcaatgtactgaatctgggatgtacaaaatcaaatgtgtatttatttattcaatcattcaaatatgtttgtaaagctttcaaaataggcattcgtccttttttaatgaggatcacaatctagtgggtaatacccatttatttcttgctgttaatcagattgattaaatgttaccctgtgtccttgtctcaaaatgcaaactctgtctacatctttagtggaaaatctgttaaaatgctgagaactagttttcagtcaagtcagtcagccaatggcttacatctttagaggaaaatctgttagaatgctgagaactagttttcagtcaaatcaattgaataaataaatacacatttgaaatgactttgtgggcattaataattcacttaatctttctgcttggtacattctcatctagatcagcgtttctcagccttagctgcaaatttgtatcatctggaagtaggacatgataaagagagagagagctagagatacacttaaagaaagtgaactatctctgggcatgaacaatctctgggcatcaggtagagatagagacagatagaaaatgagaaccatctctgggcatgaacctgagtatctaaactattaacaatcttgccagcttagtctgatggacagttgagaaccactggtgtatgcatgaagcaatgctaatcaatttaaataaaaatcccgtaaatatgtgtctcctaacacacacctacctaccgcagatatcatgagaataattaaaatggcttgtggaagtacattcaggggatttctttaaaattacaaaatagagcttggctataatcatcaagattatgactaaaaaggagaaaagaaatgcaaattatgttttggtcctataattggctgtgtaataacaatggattgactctgcatgtacacagcataaagggacagaaaatgag

SEQ ID NO: 239147 - DNA, 380 bp, Homo sapiens
aacgactctgtctcaaaaaaaaaaaaaagacaaatgcagcatctcagaaaccatgcggcgctggctagacactgaatcaccagcagcggcggtgacagcacgtgcccctcacaacagtgcccctgctccatcctttcaatgactatttttgaagtgtgcaagtggaagatgtcaacgataaaacaacacaggagcagcatgtgatgcaatcacagacatcctgtctgcttcgtgtgtctgacgttcattccttttcgtggtcgaatctgtccattgcactgatggactacagtctgttcgtctagtcaccattggatggacatttggggtcttcctagcttgaatttattacaaataaagctgttctgaacattcaaaaa

SEQ ID NO: 239148 - DNA, 1018 bp, Homo sapiens
gtgaacaggaaacctacagaatggaagaaaatgtttgcaatgtatccatctgacaaagggctaacatccagaatttacaaggaacttaaataaatttacaagaaaaaaataaccccaacaaaaagtagatgaacgatatgaacagacacttctcaaaagaaggcatttctgtggccaacaaacatatgaaaaaagctcgtcatcactggtcattagagaaatgcaaatcaaaaccgcaatgagataccatctcgtgccagttagaatggcaatcattaaaaagtcaggaaacaacagatgctggagaggatgtggagaaataggaacacttttacatttattatatattttaattttgtaatgatcagaataaaatactactaagcaataaaagtgaactactgatgattacagtgtggatgaatcttccccacattatgctgagccaaagaagcaggacaccaaagtatatactagtgataccatttatatcaatttctagaacaggcaaaactcatctatggtgaaaatatggtaggaatttattatggaggggcataaaagaactttcggaagtgatggaaatgttccatatcttgataaagacgtctattatacattagatttttgcttttcaacatatgtagattttccttaaaaaagtaacaaatgttggactctagatgacatagatatgtttgttttctgcagagatgggattagcagttgtgaaactactttttgtgtattctaagcttgaataaatatattgatgataatgggaaccaggtttctcatttttggagaaggtagtaacaagtgtgtgagggataagaccaaattgtttcctagaaaggaattataggtatcaacatgaattcatagtttgtgatagctagatatgaatctaatcacaaagaaacatcagcctaattcaaaatgagagatattctacaatataactcacctgtgccttttaaaactgtcaaggttaagaagtacaaagagagaaaaaatg

SEQ ID NO: 239149 - DNA, 651 bp, Homo sapiens
gtctgccaccctggttgtgtagtgcagtggtgtgatcatggctcactgcagcctcaaactcctgggcacaagtggtcctcctgcctgagcctcctgagttgctgggactacaagtgcataccatcatgctcagctaattaattttttttttaaagagagcttatgctagagacaagactgctataagcagtggttttcaaatgctgagccaagaggccaaaaggctgaatcagagtcaccaacgatgctttttaaaggaatgcagatttctgtccggacgccctgttggagattctgattcagtgtattctgggcaggactctaagattgcacattttgagtaagtgctccctggtgattctgacccacagccaggtttgggaaccaatgacttgaggtgagagaagtggggctgtgaaagtggaggcaagaccttgtccaaaccgttctacttttgactcagagtctgagtctgacttcctgatgaaaaatgacctgagagtttgaaactggccgtggtgagaatgtttcaaccacagaaattgctaaatggtgtgaatcaggtcagggttccctcccaccacgaaccctgccgcaaaagccagtacacaattatctaggaaggttattctcttttttctttctttcttt

SEQ ID NO: 239150 - DNA, 598 bp, Homo sapiens
gtctgccaccctggttgtgtagtgcagtggtgtgatcatggctcactgcagcctcaaactcctgggcacaagtggtcctcctgcctgagcctctttttaaagagagcttatgctagagacaagactgctataagcagtggttttcaaatgctgagccaagaggccaaaaggctgaatcagagtcaccaacgatgctttttaaaggaatgcagatttctgtccggacgccctgttggagattctgattcagtgtattctgggcaggactctaagattgcacattttgagtaagtgctccctggtgattctgacccacagccaggtttgggaaccaatgacttgaggtgagagaagtggggctgtgaaagtggaggcaagaccttgtccaaaccgttctacttttgactcagagtctgagtctgacttcctgatgaaaaatgacctgagagtttgaaactggccgtggtgagaatgtttcaaccacagaaattgctaaatggtgtgaatcaggtcagggttccctcccaccacgaaccctgccgcaaaagccagtacacaattatctaggaaggttattctcttttttctttctttcttt

SEQ ID NO: 239151 - DNA, 2444 bp, Homo sapiens
  misc_feature (75)..(75): n is a, c, g, or t
  misc_feature (491)..(491): n is a, c, g, or t
  misc_feature (2221)..(2221): n is a, c, g, or t
gaattgctttcctctggggttccacagtaaagcagccacttagggttgtccacctgtactcatggcttgctctgnacgatgacagtttccccagagcttatctcacaggcacccccggagcagtgagcaatgcactcaactgtgtgtagagaccatgggtattacagcggggtgctgggaacacccaccttggggagtggagagcctgcaagagaagtcacctcctggtcccaacacacctctcggctgcactgtggcctatgacagtgataagccacatagtgctgcttcctcctggcctgggagcacatgtggccttggccatgtctctactccctggggttcactcccacccacctggctccccactcctcaatcatttctggagcagcagtgtgcccaggggacttggggctcttttcttcaatctcttactgagattgttacacagataatcttattttgcagatgaagcttcaggtttagagacntgaggggcacctccagggctccctgctagttggcactagagcaaggaccaggactctaaggttgcctgtctcccaaagccttgtttgtgtgtggtcagccttaggtcacataatctgggttgccaggtgggctctgttctgcccccttttaagcgctctcagatgtcttaggaccaccaccaccagcagcagcagcccctgggtgcctgttacaaatgctcatccttgagctgcacctgcgccctactggattggaacctctgaaaggcaggcccagccatctgggttgtaacaagccctccaggggcttgtgaggcacactcaagtgtgaggatccctggcttagctcattggaggcacctgtggagattttaaacccaggtccaccccaggccaggaaaatctcagcctctgggactgggaagcaggtgtcagaggttttcaagcttccagggggttatagtctgagtgtttgtgtccctccagtattcatttgttgaaattctaactcccaaggtgatagtgttagaagatggagcttttaggggaacgattaggtcatgagatcagtcccctcaggaataggatttagtgttcttataaaagaggcctgagagaaagccctcaccccttccaccttgtgaggctagagtgagaaaatgtcatctatgaaccagcatgcaggccctccaccagacaccaagcctgctggcatcttgatcttggacttcccagccttcagagctgtgagaaataaatttctgttgtttataggccacccagtctatggtgttctattatagcagcgtgaacagcaggtgagaatggtggcctgagacccacctcttgcatgggtggtctctgtcaagctggctcagggtagaatagctgggcttgcaaggcctagaatcttcaacaagctggcaaacagatgaataaagggagaccgccagccacatgtaagacaccaaacctgtcttccagcagggtctatgtgtgttcagcactactcccaagccctgtgaacatttgtttcttcactctatcttggagaccacgggttttgtttctaagctttcttgccctgggaaacaccagggtgtgtttcacactagctgcattttaaaatctctttgtattgaagtcaacagggaatgttcctgccttgtcctatttgtgggtctaatcttgccatcgggtcctcagttgcctcagcacttgccactcccacccactcagaagccagggctggccgaggtaacagggcgaggtgcccctggggctgagggcagggccttggggcacatctcccggctgctctctgacactcccaggcctgggtggactctggtgcttcggggtggaatgaggcccagggaggcccaggtaggcctggtctctctccccaaaggctctccaggcctgaggagtttctcagcaggctccatgaacaatgggggtggcctgtctgagggctgtgaaggtcagggatggtctgagctacaccagtgagtgcgctttggtttggtcagaggcaccaagcacagtctatccctggctagtgggccacggccacacctcggtttgtgtgccctggagtaggttccactgaggcccaggactatgttcacattccaccttggagagtaagtttaaataggtacatgtctaggctatcctacggacgcttctgaggttcctgatagagtgtgactcccatttcttttggntgaaatgtctataatagaacaataaaatccttgaactaaagattagcagccttttttagaagctgactcagaacaaaatggatttgggcccagcccagtggctcatccatccctgtcaaaacctttgtgccaggagctcagcctggctccccagccctgggcctgcaggagacctcagggcccactcagtgtccacgttattgggatcagggacactgatatg

SEQ ID NO: 239152 - DNA, 481 bp, Homo sapiens
gcgcctgtagtctcagctacttgggaggctgaggcaggagaatcgcttgaaccggggaggcggagattgccccattgcactccagtttaggcgacagagtgagactccgtcccaaaacaaacaaaaacaaacagttgtaagagcagccgttactctttcacaccagaaatgtgaagcaataccaaggaaatactgtgtgggtgaatcctattttagaaaaatccaacatttaaaactagatcccttttagattacagaagaatttaccatataattcctttaatacacttaccttcgattcatactttacaagatgggtgtaaagttcagtatttacgttgcaaaagctggtggctatgctattaatgaagtggagaacttgaacctggaagattggagatctctctctaatccctaccccgcagctggttcggtgtgagtttatagaaaccttggggtctgagtttatgttaaaaaaaaa

SEQ ID NO: 239153 - DNA, 171 bp, Homo sapiens
gccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaata

SEQ ID NO: 239154 - DNA, 441 bp, Homo sapiens
cactgcagtattcacaatggatgaatggataaagaaaatgtggtatatactataatagaatattattcagccttaaaaaggaaggaaatcctgcagttgcaacaagatagataggcccaaaggacatgctaagtgaaataagccagacacagaaagacaaatattgcatgatctcacttatatgtggaatctaaaatagtcaaacttacagaagcagagagtagaatggtggttgccaggggctgaagggaggggaaaatggaaaaagttgcatgccaggggctgaagggagggtggccactggtcaaagggtaccaggtttcagtcatgcaaaataagttttgaagatctgtacaccataaggtctacaattaataatactatattatacacataaaaatttgctaagagaatagatctcacatcaagtgctcttaccac

SEQ ID NO: 239155 - DNA, 342 bp, Homo sapiens
tgaatttttctccactcaatctcatcatccttcagacaggcggagagagcgggatccatctatgagatttctctgctgagaaatctcctccctccctccaatgaagcaacagcaggtcatatctgaatgcagaagcatggccttgtgctgggaaaacacatcctggctgtagagctctcaggcttctagagtcaaagccaagggttcaaatcctctctgtcttactcagaagccacatggtcctgagacagtgaagtaactctgtgaacctcagtttaccaatctgtaagatggggatcataatgtaaaagatggcattaaaacttacattgggaaaaagca

SEQ ID NO: 239156 - DNA, 687 bp, Homo sapiens
ggaccttggtatgctgagcaccggtcccctgggcccactgttgttttctcacgttttctcacctttccaaacgtgtccatgcctagaagctggagaccccatccacactgcagtaccagggattcttcctgggcagtgtatagcaggtaaccatttgtgtcctggatgtctgtccacccaagaggccatgactttgcaaaggcaaggcaagggcagtgctggatctccggctctgcttcctcctcatcatccaaggagaggtcctgcctgccctggctccctggacatgggcttccaatgggctatcacagctatttccagggtagcaaaattcctggactagatgtggggtgactgctgctgaacagaggtgggccccagggtgaaggaccttgctcagcctcccctcagtttggtctaccaggcccttgtcaagcactctgctggagtctgggggtactgatctttggaaatgtcagtcctggaggctgagctgttccccagagccctagagacccctcaccaactactttattgagggacaaggcagtaggcaggagtgctgggaaatctggtttgcttggtatgccttcttgcacacccacctctccctgcacctggttctatttgtatctgagcttctcgaactgcaataatgatgcagcctagctggcttctggaagctgg

SEQ ID NO: 239157 - DNA, 170 bp, Homo sapiens
gagatcgcgccactgcactccagcctgggcgacagcacgagactccgtctcaacaaaacaaaacaaaacaaatcagaaagccagcattgtagatatagaaccaagtttgctttcctgggcttaacttttttagtcagttggattgcagacagctggtctaaggcgcattc

SEQ ID NO: 239158 - DNA, 387 bp, Homo sapiens
atttgtttgtgctttacttttcttatttgcaaatgagagaaccctggagttacactattatatggtctcattcagcattaacattcatgactttctaacaggccttgcttgaaatgatcagagccagagaatgttggagagaggatcttaagtagaaatgcctcagccagacaagcaacaattacttttgtgaaataagaaaagcaattgtgtaactttcttccttgtccagttactaaggatggttttatttacacctttagcatttcatttcaagaagttgatattaaagaaatcctcatcataataataacccatggagtaatgcatgtcaactctgcaaaactagaacgtagccactttaaatatacttaacacatgacagca

SEQ ID NO: 239159 - DNA, 347 bp, Homo sapiens
cttcaaaagccactgtagccaggtgataaaggttaacatcatcagtgataagtcacactgataccatctatctacccttgatatgaagtgaggaaaatggcagtttgcccacgtggtcttcctctcaaaaacacattactacagtctaatcaggagaaaaacatcagacaaactgaaattgagagagatttcacaaaatgcttgcccattactcctcggaactgttaagatcatcaaaccacagggaaagtctgtgaagccgtcacaggccagagaagcctaaggagatatgacagctagttacggtgcagtgtctcagatggggtcctgaaacagaaaaaaggaat

SEQ ID NO: 239160 - DNA, 350 bp, Homo sapiens
cacaagctcttttcaaaaggatatcaggattcaagcattacatcatctaaataaattctcattggatgttcagtccctgactggctggaatcgggttccctttatttaaccctttcccagccaagacatagcctgtcctaactttgagaatgtatctttcctgttatttgcagcagcatttagcatttgagcagaacgcatgtgaagaaagttgctttctataaaccccccacctcagtttaagtttttatacttagtatgtcaaaaaagttatttcaaatgctttgttgctatgtaattgcaaaagcagcattactgagagaaatgcttcaataaagcctttggaaaat

SEQ ID NO: 239161 - DNA, 769 bp, Homo sapiens
tacaacctggggatgattattctttgccagataaaatgacttccttctttgaagcttctgttttttcttaatagggtatatttaagttgtataacttgattatttcatatgtatacattgtggaataaccccacaatcaagttcttgcttaggcatctaaattacttaacgatccaaggttagtttatagagtaatttgtttttaagaacatgttttcctctcacttctatctaaaattcttcaggattttacttccttttgatatcactcccaaaactgtctcctcaagggcagggaaatacagtcctaggattagcagaatgcctatatttaatcagtggtgtgttaatgaaggtcataattaagtaataaagtgcctgttatttaaagtgtacagtttgataagttttgacctatgcatgcacccatgaaacggtcaccacaatctaattaacatacccatcacccccaacagttttctcatgcccttttgtaatttgcttaccacttccccatcccgaggcaaacactaatctgcttcctattactgtaaattagtttgcgtttcctagaattttacatatatggaatcttacagtatgtaagtatatatttttgaagggagaggtctggcttctttcactctgcataattattttgagattcatctatgcttacatgtatcagtagttcattctcttttaactgatgatgagtagtattccatttccagatatacatgccacaattactttgttcatttatggg

SEQ ID NO: 239162 - DNA, 351 bp, Homo sapiens
gagcaattactaaacaacaagacatctctagcccacagccagtgggggtaagcactggggttcgtgttccccaatatgaaagtccacttcctccaatatgaagggacttacgaatgtgcctctccccgctgggctgatctgtgatcagagcacagggctggtggccctgcaatctgggcacagggattcagattcacacctgcctcaggggctccgctggcagtgggacatccctattaataatgaggggccgtggctcataaggtgaattcagtgcagaaatgggccaccaagagaagccactgaaacaacagccctaagcacctgtcctaagtcagaacaaaactctcc

SEQ ID NO: 239163 - DNA, 378 bp, Homo sapiens
cagagggaaaagaaggctacttatggctttaaccagaagtgtaaatctatcaaattttcagagtggttactctggaaacattgtgggaaatgaattagaagtcagcaaataagaatcaggaagccctactaagaagctattaaaataactcaagcaagaaattatggtttcctggactagtgtgtggtagcagcaatgatgaggggaaaagaaggtgggacagatctgagagacagtggggggtggggaaatagaactgatagcccatgatgattggctggcagggttaaggaagtgggaagtcatcattctcaaccgatgactcaggtcacatccactcctcagctaaaaatcctttggtgtttcccatctcactca

SEQ ID NO: 239164 - DNA, 383 bp, Homo sapiens
ccagcaaaaagattatgacttctgaaggcagaggatgatttttagcattttttagcaataaagcatttttaaattaaggtatgtttgcatcttatttttagacataatgctattgcacacttagactacaatatagggtaaatataacttttatgtacattgggaaaacaaataattgacgtggcttgctttattgtgatattcacttttttgtggtgatctggaactgaacctgcaatatctctgaggtatggctgtatatattaaagtaaaactgtaaaggtaatttgaggttaattataatttgaggattgatgtattaaaattatagtgtgttatatgttctcataatatgcctcataattatcactatttgaactaaa

SEQ ID NO: 239165 - DNA, 543 bp, Homo sapiens
atgtattgagagggtattaatgggtgtggtaaaaactatagcaactgaagccagaagaaaagaggcataaaccagtgcacttggcttagcagtgaacacaaagtacgtagtcaaaataatgaccatattaggggatgaaggaagggagaggtgacaaagtgggtagggacagaggtttccaagaaagcgaactcttcatccaccacaatagtcggtcagtgataggtagttgacaaattgataaatcaagaaattaaatatgtttaactccttaagaaagaagtaaataccagatggatccactaacaaagttcaaaatgtgcctttgggaaagagcctcagaggtagagaagtatccaaagacattgctgctggtgttttactttatactatacaccttttggtgtcatgtattttaccaaacactgtgaacatattcctttgatgataaaaactattttagaaactaaatatatacatacacttatcagcaattctactcctagctatatgacctagcagaaatacatctgtatactcatc

SEQ ID NO: 239166 - DNA, 394 bp, Homo sapiens
ttccccgatcagtcactgctttgtcatttcctgtggctgcagttgtaggttcttatctcttcagctgtaggcgaagctcagacaacaggcccctccaagagggcttgctgcctcccctgcatacagcgagcctcatttatggcatcctgcgtgctcttgcagctgcagtggggtttgaagctccgggtctgtctcccagccaagaagggccccagtgttaatccttggtggggccatgattcatttgccagaagtggtgttagagggttaatcccaaagcacattttgaggccagaggaggggtgccactgataagaatttttaaaaattctgttggggattttagtatgaaagtcctgcctgtggctcagtggtttgactgtgggctcactct

SEQ ID NO: 239167 - DNA, 1965 bp, Homo sapiens
  misc_feature (77)..(77): n is a, c, g, or t
  misc_feature (306)..(306): n is a, c, g, or t
  misc_feature (521)..(521): n is a, c, g, or t
  misc_feature (572)..(572): n is a, c, g, or t
  misc_feature (1682)..(1682): n is a, c, g, or t
  misc_feature (1894)..(1894): n is a, c, g, or t
caaaactctctctggttaatttcagtatcatattatgcatatataacattttattaagaataaaagtgcagcttgangatatactattttgattaagacagtttggataagaatataatttttaatttgtaaaggtgaatgtggtcacacagtgaaatggtcaatttctagctatacatgtattatgagttataggaaaaacattttcaaaagaataattttttattctttctagtccttttccaaggaagagtcaccatgtcattgttttggtccaatcaggtaccttttgcgagtgaaaggggntgttattaacaattatgtcaagccagcaggtgtaaaccgaccaggactgtcccaggcaaaagaggatgaatacccatcctatccaaagggaagccaccatttcttcttctatatattccatgagaagcccagcaatcccttttaaaaggcaaaaaacagcctgcatcgccaagtcaatcctaagccaaaagaacaaagctggaggcatcacgctncctgacttcaaactatactacaaggctacagtaaccaaaacagcatggtantggtaccaaaacagagatatagattaatggaacagaacagagccctcagaaataatgccacttgtctacaaccatctgatctttgacaaacctgagaaaaacaagcaatggggagaggattccctatttaataaatggtgctgggaaaactggctagccatatgtagaaagctgaaactggatcccttccttacaccttatacaaaaattaattcaagatggattaaagacttacatgttagacctaaaaccattaaaaaccctagaagcaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacaaaatgggagaaaattttcgcaacctacccatctgacaaagggctaatatccagaatctacaatgaactcaaacaaatttacaagaaaaaaacaaacaaccccatcaaaaagtgggcaaaggatatgaagagacacttctcaaaagaagacatttatgcagccaaaagacacatgaaaaaatgctcatcatcactggccatcagagaaatgcaaatcaaaaccacaatgagacaccatctcacaccagttagaatggcgatcattaaaaagtcaggaaacaacaggtgctggagaggatgtggagaaataggaatacttttacactgttggtgggactgtaagctagttcaaccattgtggaagtcagtgtggtgattcctcagggatctagaactagaaataccatttgacccagccatcccattactgggtatatacccaaaggattataaatcatgctgctatgaagacacacgcacacgtatgtttatcgtggcactattcacaatagcaaagacttggaaccaacccaaatgtccaaccatgatagactggattaagaaaatgtggcacatatacaccatggaatactatgcagccataaaaaatgatgagttcatgtcctttgtagggacatggatgaaactggaaaccatcattctcagcaaactatngcaaggacaaaaaaccaaacaccacatgttctcactcataggtgggaactgaacaatgagaacacctggacacaggaaggggaacatcacactccggggactgttgtggggtagggggatgggggagggatagcattaggagatatacctaatgctaaatgacaagttaatgggtgcagcacaccaacatggcacatgtatacatatgtaantaatttgcacattgtgcacatgtaccctaaaacttaaagtataataataattaaaaaaaaaagcagctatg

SEQ ID NO: 239168 - DNA, 610 bp, Homo sapiens
gcagtctggtggccttgagcaaccaggaaggtaaagccggtacctcagttaaatcaccaagtttactggaagtgcatatttttcatgtgccaaattcagtaagtcatggagcaaatgtttattttgctatgctttacttaatctatgtttgcagcattgcactggaaacaggatttgtctgtgaaatggctctgtcatttgtggaccacttctgtagggagattgtggatttaggaagggcagaagcaacagcagatatgcctggtgtttgaatggatgtgcctctctcggaggcagcaagcagcatacccatattataaagtttttgattttctaacatctgaagacaggcatccagccttgcagaacagccaggtgtctgttctatagactacagttccttgtttccagaattacggtaaccaaataatacacaaggtcacctgattgcacttcccaacaacctgaacaaagagcacctttgcgcttgctggtaggtgctgtaccagactctttgtaatctgccttaggtcagagaagaacaagccattaccagtatgggagtccatccctagtcagggctagttgctattatccctttgatactctg

SEQ ID NO: 239169 - DNA, 373 bp, Homo sapiens
attagttaaagcttttaaaactgtactctaattccctaactgaagatcaatcatcaaaggctaaaatctcacatattagactgtgatgctagaaacactaaagtcatatcaactggggagacttgtgaaattcaaatttggtcaacttcatcccccttagagtccgtttctacattggtaacattgagaaatctgtcctacatactcataacatttttgtaatcagaggagaaaatatgtgtaaaaacactgaaggaggccaaggcaggagatcacttgaagttaggagttcaagaccagcctgggcaacgtagtgaaacactgtctgtattaaaaaaagaaaagcaaaaaataaacattttgaagattattt

SEQ ID NO: 239170 - DNA, 457 bp, Homo sapiens
agctgggagagtatcatctggaggttagggaaagatgagtctggacaagtaaaggccaaatcttcctgactgttggatcaccacaatcaagataacgaatatatccaccggcccccaaaatttccttgtgttaggggctgttttaggaagtatgatcaagaagggctggcctgccagggtggagtggctcacgcctgtaatcccagcactttgagaggccaaagtgtgcagatgacctgaggtcaggagttcgagattagcatggccaacacagtgaaaccctgtctttaccaaaaatacaaaaaagttgggtgtggtgacgcatgcctgtagtcccagctacttgggaggctgaggcaggagaattgcttgaacccgggaggtggaggttgcagtgagccgagattgtgccattgcactccagcctgggcaacagagcgagactccgtctttaaaa

SEQ ID NO: 239171 - DNA, 311 bp, Homo sapiens
taggtgacagagtgagatcctgtctcaaaaaacaaaaaaaaggaataaagcactgataaattctatgatatggatgaaacttgaaaacattttgctaagtgaaagatgccagtcataagagaccacttttagtggggaggagggtggtaatggagagtgactgctaatgagtagcgttttttggggggggtgatgaaaatattcttaaactggttgtacaattttgccaatatagtaaaaaacattgacttctacacgttaaatgagtgaattacatggtacatgaatgatatctcaataaagctgttttt

SEQ ID NO: 239172 - DNA, 448 bp, Homo sapiens
  misc_feature (83)..(83): n is a, c, g, or t
ctgtagaccttccagcttgagctgagctttcactcaccgtccaccactgctgtttgctgccatcgcagacttgcactactccnccccctccagatccagcagggtgtctgctgctctcctgatccagcgagatggattccctacaggactcatgagcagatctcataatttctgggcatgttccacaccttggagtaggaatcagttagggttgttcttggctgcaactaacaaactactagcagtggcttaagcacggaagaacttaatgatctcacaggtgacctgggtagggaagggccctggtctactctacagctcttctagactctctcaccttggagtccaaacgcatggccttcctttggaacaccttctctctctcccacttcgggctcagctcctttgcagtgaaagattggaaagaataaacatctcttactcaatg

SEQ ID NO: 239173 - DNA, 384 bp, Homo sapiens
tactgtgtttttatattagtctaataacacaagagaataatatttagcacgtgtatttctcaggattcattttaacatctgtaaataaaaagttgtctgttgacatgttcaggatttacagtttctattaagcctagatcctttcagttaaaatattgttttcaacttaattactatataataataaaggtagaacaattttaaggtgtataaataagcttttaaatataataatagaagagtaagtagtaccagattaactaattaaatacttgtggccatcgcaagcaggtattcacatctctttaggaagatgtaaaatttgtaattttaaataatgtaaccttatcttaaaatcttttttttgttatcggactctgttaa

SEQ ID NO: 239174 - DNA, 276 bp, Homo sapiens
cccttccttaaaattgctacaagccactgaagagcatcttccttgttctatgtgtccagcttcagtctcgtcgctggacatttggttccagatctaaagcagcagagggcagtggccgtatgtggagctgttattaactgcatcaccttgttgtgaggatcaaatttgatggtgtttgtgaagagctttgcccagtggctggcagcctgtgatcatggctctgtaaatggaggctgccatcatcataatatcattatgaagcccctgatctcacag

SEQ ID NO: 239175 - DNA, 383 bp, Homo sapiens
tgagttgttgacaaatgtagacagccatgaaaccaccatgaaaccagaatcatagaacatttccatcatttcagaaaattccattatgcccttttacagtcaatctcttccattcacccctgacctctgtcaaccactgagtgttttctgtcactataattgtacatttctagggctttatataaatggaatcatatgtagtcactgtgtctgatgtctttcgtttagcataatgcttttgagatctttttatggctcagtaatattccattgtgtggatgtgtactacatcttggttttgtcctttaccaattgatggatgtttaggttgttactagttttaggctatcacaaataaagctgctatgaacattcaaatacaa

SEQ ID NO: 239176 - DNA, 559 bp, Homo sapiens
aatgcctgaatgtcataatggagtgctttgtaagtatacaaaaaatgaagtggcttcttttggacctgaggactcaggaagagaaaatggtaattgttctgagtcatgaagatttgttagaatgtcaagacagaagaaccatcattgtaaggggaagaaaaaataaaactaaaaggactatgaatgggaaagtacaaggtatgctctgaaaacacttggtacacttggagtgttatcaggaaggttgtcaggaggggataaaataggaaagcagagggcagatcaaattggcctcgaatgccaggctaattcattcaaggcacattctctgatattattctaatcctaatgtagctccatgacagagtccaaatcatcctttaacttggttggtgaaagttttatcttgtatgggggcaaagaaccagattgggtgagaagtggcaatagcatggaaagaacacaatcactgctttaagaacttccagactggtgggcagccagtcttatccacagaatagaataaattcagcacttcaaaatttaatattcactagtt

SEQ ID NO: 239177 - DNA, 2350 bp, Homo sapiens
  misc_feature (518)..(518): n is a, c, g, or t
  misc_feature (547)..(547): n is a, c, g, or t
  misc_feature (875)..(875): n is a, c, g, or t
  misc_feature (1007)..(1007): n is a, c, g, or t
  misc_feature (1159)..(1159): n is a, c, g, or t
  misc_feature (1292)..(1292): n is a, c, g, or t
tattggacttcttaaaataggctcagattgcaagaataattgtttcctacagacatattaaacaaaggccctgtggtgaaggaggtgctaaataatcagatggtcaagatgactttgaggatatcagtaaatctctttggtattccagcctttgttcaaacagtttatgggcaaagcggctatactggaaggatagggctacacaggaacttcaacaatacaggcctcctttcatcaaggctgtccttattactgccaggagccgaactggccagcagcagtgaccatcctaagatacaacatctgagggtgaccagatagttagtggcagattgattatatcaaatattttctttcatggagagacaactatttgtcctcatggaatagagccttactctggatctggctttaagtttgccttccctaagcaccatgcttgtgtgtgcaataataagcttcctgttcaccattatgattttccccaaaatattgcttctaagaaacttattttacantgtaatcagtgaggtagaggtagaattanactttcagtcatgggaaactaggtaattaacatcaaaattcccattggcaactagataatccagcaaaactcttcaaaacatgaaaatctaggccaggcgcagtggcttatgcctataatcccagcactttgggaagccgaggtgggtggatcacctaaagtcaagttcaagaccagcctggccaacatggtgaaagcccgtctctactaaaaatacaaaaaaaattagccaggtctggtagcacatgcctgtaatcccagctactcaggaggctgtggcaggagaatcgcttgaacctgagaagcggaggttgaggtgagccgaganagcaccactgcactccagcctgggcaacagaggaagactctgtctctaaataaataaacatgaaaatctagagaggcaagcattggcacaacttctttcctggaggtattggctgattctagaagcatttanggggataagcagtgcttcttactgctccaggatattaggaggacaaaaactgaatgccagtgcctgccaagtcataaaagagggcttaggaaattcccatgctttgggctgggacccaaaaaagctccaccataggagtaagagtgaattgnaagtgcatcaactctcccccatacacagggaattcagcacggattcaaaccatcccaattcctgaaatcagattaaaaatgatcccctaagtgcttggtaataaacaaatcctctgtggaggtggaaaaaaanccccatcatcttaagcctcaagttctacaatttttcaaatacagtcttcacaagagaaaagaaaaataaccagacacttctatagcagagcaacactcattgagaacaacaagcagctttgggtaaaattgcttaaaacctctgtttgaagccattgaagaactttcagctaaacaggactctagaagacaaaacgccagagagaaggtgtgcagaaaagagttaacataagaggctgagatgctatccttagccctgattttaaagctgggctttggctagtgtctgggaacttggattaccggaatgttcccaccattccctaactgataagggggtttactctttgtaaactatataaacaacatggtttatgctgaattcccgctttgcttctaggagtctggaattatgatttgtgctgggcagagggtgcctctatcactaacttccaatacaaactttgggcagtaagactctaacgagcatccctggcagacaacatttcacacctgttgtcacaattcagtactgaagtaattaaccacagcctgtgtgattccacaggcaaaggattcttggaatcttgtgtcaggtttcctctggacttcaccccatgtccttttcccctttgctgatttgctttgtagtacttttctctaataaatcatagccatgagtatgactatatgctgagccttgtgagtgcttctgttgaatcactgaacctggggtgctggcgtggtcttggggactcccaatacaaaagtattttaaccagagaagtgagcagacattctgcagctacttcttccattatggaatttgccaaatctgggtaaaaggcccaagaagagagttactgttaagaatcagagaagcaaacaagttatggaaaccacacaggactggagaaacaaaaagaacagggcctttaaaccaatcgcacttgggagagcagagatcctagtaagacaggaagttcagagaagtgagcctggcactttccttgttttcctcttgagtatttgctgaattcttggattgctcagagaggg

SEQ ID NO: 239178 - DNA, 209 bp, Homo sapiens
ggatagatagcatgttatatcacaaagcaagtcttaccaaattgaaatcataccaggtatcttttctagccacaatggaatgaaattagaaatcaattgcagaaggaaaactagagaattcacaaatgggttaaagttaaacaacatatttttgaacaaccattgagtcaaacaaaaaatcgaaagagaattaagaaataaattaagac

SEQ ID NO: 239179 - DNA, 234 bp, Homo sapiens
ttggaagaacgtgaagtgggtgatgtgaagaacaagacttagattattccagattgtgggtgaacaacaagtgtggtgtttaaccatgatcctaggactttataggctgccatcttgcatccctttcccgtgatttttctcttgaggtgagctgcccacatgtgtagtaccctccttacccttgggaagtgagcacacacagggtgtttaggaagttgtatgcatggccatctg

SEQ ID NO: 239180 - DNA, 415 bp, Homo sapiens
ttctttggtaggtaaaactctccattataaaataataatacactaagtcatacgccatagccttcagcaattttcttaaagttattttactttaagaccagtgttgccaacattgaattcattttacagataaggaaactgaggctattttacccaatgataatgtcggaatgagtcagactattgtaattgaaatcactagcttagttccagatttaaattaaggcctctcacatatttgtaaatgtgacaggcaccagtagagatcattggttaatgagtggaggttggagtggagatagggttccattaatcacaaactctaggccatagttctcaatgtgtggtttggggccatatgaggagtaagaaaatgtactcttggaggaaaggaaacaaacacaaagcttgcaaa

SEQ ID NO: 239181 - DNA, 384 bp, Homo sapiens
tgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaaggtgagtttaaa

SEQ ID NO: 239182 - DNA, 987 bp, Homo sapiens
tttttaactattaagaatatttactttaggctgggcacggtggctcacgcctgtaatcccagcactttgggaggccgaggtgggcggatcgcgaggtcaggaaattgagaccatcctggctaacacggtgaaacccagtctctactaaaaacacacacacacacaaaaattagccgggcgtggtggtgggcacctgtagtcccacctactcgggaggctgaggcaggagaatggcgtgaacccgggaggcggagctggcagtgagctgagatcgcgccactgcactccagcctgggtgacagagcgagactccgtctcaaaaaaaaaaagaatatttactttatacaaattaatcggtagtttgaaattaactgggaaatatgtcttaatgggatatgagcaaggaatggaggatattacaaaatagaagagccataatttcaggaagaaaaatgttagcaaacttaataacaagcatgtatatttcaacaagtctgtgtatttcatcttatttttctcattttgccacagatcctcatagggccttaaattgagatgggcatttggaaacttctgctttaaaacttaggaagattcctaagtgtcttctgacaaaagctgatagatttataatagtgtagttttatgtattttttgtagtctatggtacttttatttgaaattctttgaaaattggtcattcatgtatgatatacatgacaactaaactcattaattggaaaagcccactctttaaccattgtcttaatgattaaatgtgtttttccatttgtatgtgaaaatatacaaacttttaaaacaatgaaaatgagtttcttaatatgaatggtaaacattaaaacttgttaatattcattaagttcaaaatggatcaaaatttttcatatatttctgagacttgaaaatgaaaagattaagaatgactggtaaactaataaaggttattgtgaacaccagattaaggaa

SEQ ID NO: 239183 - DNA, 327 bp, Homo sapiens
tgcaagcccaggtcttggggcgcgagctaagtcccccttgccagctctaaacaaaattcgggggagaatgagtcggccagtctgggcacagggtgctctcgactgccgggcggcgggcggaagcgcagggccctgatcgcccccagaggtctgagcgcacagggcagtggctgcagagccccggcgcgaggccaactcggatcatccacgttgggacctcagcctgcccggttgtccttagtaataataatagtatgaaaccgagttttaaaaaacctttccccgcattttcctctatgtacaagggagaacaagtatttctaggca

SEQ ID NO: 239184 - DNA, 188 bp, Homo sapiens
tattgttcaagggtcaactgtatactgatagcattcagtaaaaagctgaaaatccaaattcctcaaatctgtgaacagtccaaatctaaaacaaatctaaaacaaatctaaactaaaaaagtaacagtttagatagtattgtgggcttaagacatttcttactgacatacttcttgaaagaattttat

SEQ ID NO: 239185 - DNA, 405 bp, Homo sapiens
aatggaaatgcaaaagaataagaatatgcaaggctactcttaaaatacagttcctggatgttatcaaggccaatataaagttagagtaattaagacagtgtggtaatagcacaagaataaaaattatgaccagtgaaagagaaactccagtaatagatgcacacacacgttcaccattttttatgacaaaggtaaaactgtagggaagaggggaaaaggtacccttttcaataaatgacagtttttccatatctatatggaagacattatatcttgacccctaactcacactatataaaaaaatacagctacatataagagttataacagtatagtttttagaagaatatagaacatattttatgatgttacaatagtcaaagattgactccaccatcctccacc

SEQ ID NO: 239186 - DNA, 333 bp, Homo sapiens
gattccaaaagggtgtctggtttcatggaaacattcttctcaccctcatttgtcatcgcacaccccacccccgctttttggattcaggttcaggaataaccaaatccttggcacccacacaatgtggaagtacctttcacagctcatcgcctgaatgtcttgctccttacatatatgtgtgtgttttgggggaatgtgagcttctcagggaacttgatgccttgcagattatgagaatgtcaaacttgattttattcagtttcttataggatgtgtttcctgtgggcaagaattataggaaataaatgtcagtgtcatatacaactgcagtag

SEQ ID NO: 239187 - DNA, 400 bp, Homo sapiens
atttactaaacttcactccccctcccccaccccagccctttcttttcagaagacacatttagacaatcaccattcacctccaattcaaaagaactgctgcccagtgactccgtgctgcacggaagaatatcagctccaggcctgttggagaaggaagccagcagtgagggggattgcaaagtagagagaggttggtagaactgtggactgtgaagagatcgagaatagcacagttaactaggcatttgccttcggcagatggcatctgaaactcacagctgccaccgtcccagagaaacagaataaacacagagcttcacggtgtcctggctgcggttgttgccagtatttctagactgactttcctgagaactaaagaatgctcatgttagccaagacc

SEQ ID NO: 239188 - DNA, 1735 bp, Homo sapiens
ttgagaaatgtccagatgatttggaaattaggttatgtttttgatacagggcaggttcctggcttcactcaggaaggaattcaagagcgagccagttgtagaggaaaacagctttattgaggtggtgacaatagttacatctctgtgactgctcccgcagagcgggactactccatataggcagtgtgctgagagcagcagctcaggaacagtctgcagtcatatttatacctgctcttaatgacatgctaattaaaagatgggtgattcacaatttgccagaaaatgtactggtgttgcttccaggtgttgccatggcaatggtaaactgtcttggtgcaagtgggtgtgtcttatggagaggtgctttccatgcctcttccctgtttcggtcagtcttcagtctggtccagagtccagtcctgtctgcctcctacctgattttcacctttgagaaatctgttgttttcaatggtgagagcaggaaacacaacgttaagggctgagtaaacagcaggtattgtcagggacggacgcagtaaaaagaaatggactaaagggataagaaggtcattagaaggtggttttacaatggggagagattgaaaacagaagaaaccagcggagaggtcacataacaacattggaagcaaggagagtggaatttagaattcaggacgtggagagtgttatcagcaatatggcagaataggagttccttggtttcacacaccccaccccccaaaatgtaactagcaatgatccgcaggcaaaaaatactatcctgaatatcccagaactctggagtgaggctgagatacttccttggactgcacaataaccaagaaaaaccacaatcgaacagtaagagaaacagttctttgaccatgtcatccttctaatatgctagccagagcaattaggtaagagaaaaaagtaaaatgcatcctaataggaaaagaagaaggaaaattgtctctatttgctgatgacatgatcttatatatagaaaaccctaaagactccatgaaaaattgttaggactgataaatgaattcagtaaaattacaggacacaaaatcagcacccaaaaatcagcatcatttctatagactaacagcaaactatctgaaaaagaaattaagaaaataatcccatttacaatagcaaaaaaattaaatacataagtataaatttaaccaagaagataaaatacttgttttctgaaagctataaaacactgatgaaataaagtgaagaaaacacaaataaatggaaagatatcccgtgtttatagattggaagaataaatgttggacaggtgttcatactacccaaagcaatctacagcttaaatccatatggaatcataaaagataccaaatagccaaaacagtcttgagcagaatgaagaagtctggaagcatcatgccccctgatttaaaaacattatgaagcaattataatcaaactgcacgatactagcataaaagcagacacatcaatcaataggagaggatagaaaacgaagaaataaacccacacctttatagtcaccttatttatgacaaaggtgaggaacacaaaatagggaaaggacaatctcttcaataaatggtgttgagaataccagatatccacacgcagaagaatgaaaattgacgcttatcttatgccatgtcaaaaaaatcagctaaaaacagattaagaacttaaatataaaacctgaaactgt

SEQ ID NO: 239189 - DNA, 919 bp, Homo sapiens
agtcttaatgcatatagaaataagagaaatgagaaaagaaattgaaaagagagacagcagagaactgattctctactagagcctccagaaggaatcaactctgccaacaccttgattttggacttgtggccttcagaacagtgaaatgataaacatctgttattttaaggtacctagtgtgtaacattccgtcatgacagccctaggaaatgaatacagcgaggaaaatcctaccagcacaaaggcatggaggtgccaggatgtctcctctgcgtgaagagtagatgtagatgaggctggaattatctatcctagctgcccagacccatgtgcctttgttttatgtagttacagcacctatgatacatatttgttaccatgtatgtcactatgaacctcctctggaggacggagaagtcaaataccttaattattccaacacaagcttgcgtgaacagataatcatcactacgagtatattgtgtgcctgctaagcaccacgcctgagataagcatttgctgtggtttgaatgtcccctccaaagctcatgctaaaatttaattgccattgcaacagtgttgcaaggtgagaactttaagagatgatcaggtcatgagaactctgccctcgtgaatggattaatacccttatcgcagtagtggaccccccttttctcttgctgtctgtctctcatgttagcttgtgcttcctcctttcaccatgggataacacagcaagaagcccctcaccagatgctggcaccttgctattggacttccggcctccagaactgagaaatacatgtcttttccttataaattacccagtctgtggtattctgttatagcggcagaaaatggactaagacggcattttgcatacattatctgtcttattaaaaataatgtttttgcccag

SEQ ID NO: 239190 - DNA, 352 bp, Homo sapiens
atacagaccaggcagacatgatgccatcattcagagcaaggtaaggagagctcagactatggtgttacaatcagaaatgaagttgaagcaacagatatgaagatattgagatatatgttcagtcaaatagaatggctaaaaagaatataaagagaaaaattatgaaaggaaatacaaatatctaataaacatgaaaaagtataattcactaggattcaaagtcatgatttatgaaaaatagtaattttcagtgctggtaatggtacagtgaaatagacactcatagtgatagtggatatctatatattgacacaaaattctgcaaagtaatgtagcattatgttatccagaa

SEQ ID NO: 239191 - DNA, 760 bp, Homo sapiens
tattctaaagcataccaagctcttcgtgtttgctgctggagtgactgtgtgttcccttgcccttagatgaagaaatgctttcaaaacctctgaagatgcctgaatgggtatcgtgcagcagtttttggtgttactgacgaccagctctgacgagagtcttcggtttcttagcttcaggctggacttcaacgagcattacaaagccagggagcccaggctccgcgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgttgcacacgtcggagttgaatgcatttgtaaatcactaagtcaagtaggctggctgcactgttcacatttgtctctaaaagtcttcatccccaaaagataccataatttgctgaggcttctgaatcttaagtgctctaagttataacttatatttgtcactttaaaagaactgtttgtttagcaaaatctacagcaagggtatatttataaagtgataatgtcattgctgttatttagcatcctcttcagaaacttttttttgcaatattattagattaaactgaaatacatagaaaatatagagagcattttattatcttggtattcaag

SEQ ID NO: 239192 - DNA, 1567 bp, Homo sapiens
  misc_feature (962)..(962): n is a, c, g, or t
  misc_feature (1144)..(1144): n is a, c, g, or t
  misc_feature (1538)..(1538): n is a, c, g, or t
tgcttgaacccaggaggcagaagttgcagtgagccacctgtgaagagagagcgagcattctgctgggtgtataagtggattgtgtgcaatggtgcttcagtctagatattcatgccttaatcttactgtgttcgtctctccctttttcaggggaagcctgagctttgcttagtgatgatggccctagtgtgaggactggggcttgtggagtagcctcttgtttgctctagccaccccactgcctctgtcctctgcagttactaggaccttccctagcaagtttgcgtcctttccaccacaggcatgacctgcctctctctgctctcttccagcccgtcctctctctgcctagtccttttcagacacttgcttcttggcacctttgacttttctcactgccgggctgcccctactaaggatgattgccctgttttcgtagctctaagaagcagccaaaatccactccacctccctcccaccctccgtcactccaaacagcctggttttgttccagtcaggaaaaggtttctttcttcctcatatttttttgaacaaaatattttgcatacggaagcccggagctcctgcaaaagtgattttgtacctaattatttaagattataagttaaccccacttgcagttttttcagccagagatacatcttaatgaggtgctgacatttttcagaggataaatttaaagatacatttgaatggaactgaataattttcaaaggaagtggtcatacttctgtatcaatatagaaagttgatgtgtgtttgagacatacttggtttattttacttcatcatctgcctctgtctaatttatgaccttcacctgaaatggaataaaagtaacactagattttgggtctgtctttaactggatctggtcttggccgccacttaggagtttgtatgacttttgacaagttcctggcctgttttctcaactgtanaatgggctgaacaatgcactcctcccagatgtgttaaggagattttagaagtagtaggtttaagaatactccgagtgttagactacttccggtcttacttagtacagtaggtaggccttgaattacagtgctgtagtacataattatgtactcctttttcagtagttttttcccagtaatangccttcagtcagtgttggcactgtatttaatttgacattctgaacagtggtattccagagtatgtgcagtaaactcacctgcctacagaagagtgacccaaatcctgtgattaagaaagaaaagaggggccaggtgtggtggctcatgcctgtaatcccagcactttgggaggccaaagcgggcggatcacgaggtctggagttagagaccatcctggccaacatggtgaaaccccgtctctactaaaaatacagaaaatgagccgggcatggtggcatgtgcctgtagtcccagctactcaggaggctaaggcaggagaatcacttggacccgggaggcggaggttgcagtgagcccagatcgtgccactgcactccaacctggtgacagagngacagagtgacagagcgagactctgtctc

SEQ ID NO: 239193 - DNA, 450 bp, Homo sapiens
tgaaagcgaggaggaggaggaggattataagccagtgaatgacgtgcttttgattttttaaaaaagatcagcagtggctggtgggtgtttagagagcagctgatagatatcagaagtttagagatcagataaaaaggttaatgtaggctgggcgtggtggctcacgcttgtaatcccggtactttgggaggcagagtgtggggtggatcacttgaagtcaggagtttgaagccagcctggccaacatggtgaaaccctatctctactgaaaatacaaaaattagcccggcatggtggcgcacgcctgtaatcccagctactcaggaggctgaggcacaagaatcacttgaaccccggaggcggaggttgcagtgagccgagatcgcgccactgaactccagcccgggcaacagagcgtgactccgtctcaaaacaaacaaacaaacaaac

SEQ ID NO: 239194 - DNA, 493 bp, Homo sapiens
ccaagaaccagagaagagaagagaagggaagggacctgtggccacatagcaaggccatggcacagccgaagtctcctctgctttcctcatgcagccccgtccaacccatctctttcatctcttttcttaaaacttaaaaatattttcaggggggtgtggtggctcatgcctataatcccagcaatttgggaggatgagatgggaggattgcttgagcccgggagtttgaggctgcagtgagccactgtagtccagccggggtgacacagccagactccatctttttctctgtatattttttcacctctacctgatgtgactgagtaactgctggggtacatcacctctttcaggtgatggaaatgttctaaagttgattatgctgatggttggttgcccagctgtgaatgcagtaaaaacattgagccgtacactttaaatggacaagttatgtgtgaattatatctcaataaagctctgtgccccacccaaa

SEQ ID NO: 239195 - DNA, 483 bp, Homo sapiens
ccatacctataatcccagcactttcagaggcagagacagtcagattgattgagcccaggagtttgagaccagtctgggcaacatggcaaaataccaactttactaaaaaatatttaaaactcagcctcctgaccatctgggactgcaggtgtacaccaccaactcctggccgatttttgtattctttttgtagtgatggggttttgctgtgtttcccaggcttatctctaactcctgggctcaagtgatctgcctgcctcagttcccaaagtgctgggattacaggtgttaaccatttcagccagctggaaaatgtgtttcaaaataaagttaaatttactaaattaaaagtaaatgtaggctaggctcagtgacacacctataattccgtacttggggaacctgaggtgggaagatgccttgagctcatgagttaaagactagcctgagccaaaaagcaagttcctttgtctacaagaaatt

SEQ ID NO: 239196 - DNA, 541 bp, Homo sapiens
catcctggttctccacgtttaacattggactgtttcttcaacttaggtgcatagcactgacactaatcagggattatcaccgataatttgacttggactatggagttcattcaaatactttatctagacaatttaagtactggcttatttgtcatgaaaatctgacaaagtaatttcttggtattcagttgatttttactctgtttgggttagcagtttataaaccagtcagtctcttcattaaagttctgggaattcttactcgttcaaatgatatgattctaaagttctcaaaaatctgtattctagaattcttctcaggaccttttccctcctttcatgaaactccttaaagatacagtattctataattttgcaagcttgtacagttttcagaaactgcctcagaattaagcaatttacagtggaaatgtttttaaattgtcatagacacaattgacaagaaaattttattatttacaggcgtgagccaccacacccagcctctgaagttaatttaataaaattttatgaataaatt

SEQ ID NO: 239197 - DNA, 436 bp, Homo sapiens
aggggtgaaagcctgatgatctgccaaagcatgggacaggaaggcagaaacgtaagtggaatgtagcatgaccctagcagccggaagaaacagttgaatctctcaaggaacttctcaagtgtagtgatggtggctgctcaggcttgagtccctcaccagcccagccagaccatagtttacagagagctaaaccagcaacctcaacagaacatgttgtcaaatgatcctgtctaaaaactgttgattaatgagctgatgtcagccagatggaaggttatgaaagcatggtgtcaccaggttgccctaggacctatttgtaatattcccttacagaaagcttacacctggaaatgtaagaaatgtgggaaggcaatttattcagggtaaaggccttggaagactaaagaattaaagaattcatactgctgaaaactct

SEQ ID NO: 239198 - DNA, 141 bp, Homo sapiens
cttgcaagtcagatcagccccttccactggcaccagggggtcaacgatcactttcttcttttcagtataagggaacactgttctcttcccttggtctgttaagtcatggttttctttaaaaacatcatccattataatccc

SEQ ID NO: 239199 - DNA, 498 bp, Homo sapiens
tgaacagaacaacacatgtgaaaggggtctaagtttaatagaaacctaaaaaaaaacacaaatgaacaaaaaaacccctttctatcacaagagggctagtatcttatacttcacattttgttcaaggactgagttgccataagttggaactttgacatgtgacttggggagtctggggtgcatcatcggttgcatctcctgagaaaattctcaaactaggaaaaaatatgttgacagtgagccacaaaggttggtatttgtagctgccatcctcagtgtttaggagaaataagttttcattatgggacatggaacagatgtcaaatccccagccatccttgtgctgtttgctgtttgttgagtcaccctggagcttgtccatcccggcaccaattttcatgggaagcatcaatgtggggccagaaggccatgctgatggatgggctcacaagaggagagctggaaggggggccttctgttggctctggtcatcttaat

SEQ ID NO: 239200 - DNA, 443 bp, Homo sapiens
aataaaaaagtggtgattgttattaccagcatggctactactagctaattccaggcttcaagccactggggcataggcatatgtttagctcattccacaggaggggaacagaggctcaaagaacctaggtaagttggctaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaaca

SEQ ID NO: 239201 - DNA, 599 bp, Homo sapiens
agagtcttactctgtcacccagactggagtacagtggcgccccagctcactgcaacctccacctcccaggttcaagcaattctcctgcctcggtctcgcgagtagctgggataacaagcgcctgccaccacgcctggctaatttttgtatttttagtagagacggggtttctccatgttggccaggctggtcttgaactcctgacctcaagtgatccacccacctcagcctcccaaagtgctgggattacgagtgtgaaccaccgcacccggcccaaataatatatttttaaaagatattatactatttgcaatttgaggttaagctttacaagcatctgttttgtcttttttgttgttgtttttttagacagagtctcgctctgtcacccaggctgtagtgcagtggcacaccctctgctcactgcaacctctgcctcccaaggttcaagcgtttcttgcacctcagcctgctgagtagctgggatcacaggcatgtgccaccacacctggccaatttttttgtatttttagtagagacaggctttcaccatgttggccaagctggtctccaactcctgacctcaagtgatccatctg

SEQ ID NO: 239202 - DNA, 470 bp, Homo sapiens
ggtcggcttgctctacggcctggaaccgggctctagaaaaaaaaggagattccgaacgtatctcatcaaacacttgcaaagccgggagatctgtctgcaaatatccggaattccattgcagtatcggattaggtaggctcataaacaccgtgcttttgaggtgatttggaagaaacgcgagccacgagcgaggaactagtttctggaaaatagccgtaaacctgtgcggagcgaattattaaccccccgccccagctcccccctcgaagctcttttcctgtagctgtgtgttgtgtagacgcaagccagtttcagtgtacgtgggcgtgtttgggaagaagctgcgagctgataggaggtacctagtacaaatgttaatttgtttgagttgggaggggtaagggaggaggaagaaagggcactgatgttagctgtggaggaggggcaattgaaatactaaatttctgtta

SEQ ID NO: 239203 - DNA, 271 bp, Homo sapiens
gccaatacactccagcctgggtgacagaatgagaccctgtctcaaaaacaaaacagggagttgaaaaaataagaaaaatcaacattttcatataaagaaatattagacaggaaaccaattcagctggctgcctgtagggaccagatgggagcaagaggagtaagttcttaaggtaaactttgatatattattttggtttctgggacattaagaatgctttgcctattcaaagcaaaataaatgaatcttaaatgatagaagcaaacaaaac

SEQ ID NO: 239204 - DNA, 346 bp, Homo sapiens
gaagatttacattatttcaggttattatcacaacaagaacagcagttttattcctccatccatttgataaataataattcagatttgaaggatatcttactcattgattcccaaataataaatggtaaagctaggattaaatttagatctatttgattacaaagtttatggttttttgtaagctttaggaaaaactgattatgtgtgcgtttttcatgcataaaaagtaaagaaagctatcattgtcagatatcaaccccagaatttgcaagcaaattttttccttttttttttttttttctttaagttcagagaaaaagcaggtagcagcccaggagcaaaaatt

SEQ ID NO: 239205 - DNA, 497 bp, Homo sapiens
tccactgcaaggaatggtgggacatccatgttagtcggagagcatccgggagaaatccagcacgcacacccacaatgtccggccgcgcgagcctgtgaaagcagaggaggagggaaatcagtaggaaacccagccttggtaacggacgagatgtcgatagcgagccacagcccggcacaaaaggcgctttgctagcaaaggttttgccaggccctattctactgcactgctgcacagcttctgacgtgaagccaagattaagtgagaaagactgagatagctgctctcctcttaaggctcccggccagtgagctccccaatatctattatgcaaccgatctgacagcccgccttgagttgcaagaaagaagtaggatttatttatggggagaacattgcttttattttccatgagtatttgctgagagaatgactggtgtatgtaagcggacttcttacaatcaactgatgaatttcattaaattactagctaaatc

SEQ ID NO: 239206 - DNA, 294 bp, Homo sapiens
gccgctgcctgctgccagcggcttcctggcccccgtcagcaacaccaggggcagggagaggcccaccgtcttctcctgcccgccccccattggcgagcgatgaaggcgggggcctgcgtctccgtgttcgggtctcacgcagctagatgttgattccacggtccagcctaaggcccctcagtctctctgtgcctctggaagccgaatgaggggcagtcaaggttgaacattggtcagtcagttctccgaccatttattgcaccgctgtctcctcccccgtccacctccctttac

SEQ ID NO: 239207 - DNA, 152 bp, Homo sapiens
aaaatattacctcacacctaccaaaatggctaaaatttaaatagtaacaaaaccaaatgctgacaatgatatagggaaactagatcacccatgcattgctggtagaaataaaaatgatccagacactctggaaaatagcatagtgtttacct

SEQ ID NO: 239208 - DNA, 223 bp, Homo sapiens
aagagtagaggttaagaaaggataatacatatgatttgggttatgttacgttgcatattggacatatgaaactatccagcatggagtagaaattctaggactgggctgggcgtggtggctcacgcctctaatcccagcactttgggaggccgaggcgggtggctcactagaggtcaggagttcgagaccagcctggccaacatggtgaaacctcgtctctact

SEQ ID NO: 239209 - DNA, 651 bp, Homo sapiens
tgaggttctggataactagtcaatagattgaaatcaaagagagaaagtgccgttccttaattgatttttaatggagggtaaacagttcattatccttaattcagtaaagagcagaagttattttcatatgtaggtaacttgtttagaggcattaatgtatggctaagtttgagagggggaaaattacacttttaaaacaattatctttgtctggtaaccagtgaaataccagaaaacactgttgtaccagttacatattgttgcataagaaattaactcaaaattaatggcttaacacagtaaacattatctctcagtttctgtggttcagtaatctgagttcaggttatctgaccacctgtgtctcggggtctctcctgaggttgtggtcaagctgttggctggggcattggtctcatcagaaggctcaactgaaggagactccatttctaacctcgttcaggtgattgttggtgggacccaattcctttcaggttgttggactgatggtttcagcttcttgctgcctgttggccagagatttctcagttccttaccacaaaagcctttcctggagcaactctgagcaagacagacaacagagtttttttgtaacctaaacttagaagtggcatcttagaagcaagtcat

SEQ ID NO: 239210 - DNA, 774 bp, Homo sapiens
attcctcagtcatcttctctgaaataatgagatttcatggagcaggtggaaggctattgttttctctttcatgggatgcagccataaggcagataaaagaagagcagagaatagcctcttccagcatctgctgcctttcaaaggcctttaaaataatcagcctaccagggtactgtattttggggtgacattccctgggttcctttagtcacatagctacttatttaataaatgttgatggtactggtataaaaatagacacgtagaccaatggaacaaaatagagaacccaaaaataaaaccccatacatataaccaactgatctttgacaaagtcaacaaaaacatacagtggggaaatgataccttatatatctctcatcatatatatatatactcaaggtggattaacaacttaaatgtaagacctgaaacaaaaaattctaaaagaaaacctaggaaaattctaccaaacattgacctagtcaaagaatttatgactaagatctcaaaagcaaatgcagcaaaaaaatatatacacaagcaggactaaactaaactaaaaacttctgcacaacaaaagaaatagccaacagagtaaacagacaacctaagaacgggagaaaatatttgcaaactactcatctgacaaaggacaagtaccaagattctacaaggaactcagacaacaagaaaaaaggaaataaccccattaaaaagcgggcaaaggacatgaacaggtatttttcaaaagaaaacatacaaatggccaac

SEQ ID NO: 239211 - DNA, 1793 bp, Homo sapiens
  misc_feature (929)..(929): n is a, c, g, or t
ttttgttttgaaactttttgtagagatgaggtcttgctgtcaagaccagcctggccaacatggtgaaaccccatctctactaaaatacaaaaatgctgggcgtggtggtgggcgcctgtaatcccagctactagggaggctgaggcaggagagttgcttgaatccaggaggcggaggttgcagtgaactgagatcacaccactgcactccagactgggtgccagagcaagagtctgtttcaaaacaaacaaacaaaaagaactttaaagatctgggccattgtcgacccataacattaaagcaaactttgtgagattttacattttaattctattaatactgctgttttaattgaggaactaatcaggtaaagattctgtccaccttcaatgcttctgtaaactagagcattttatcttgtaaaatatatgtttttcaaggtgttattctgacacttcttaatgtttttgagagacagggtctcgctctgttgcccagtctcaaactcctgggcttaagtgatcctccacctcagcctgccgagcagctgtgactacaggtgcacaccactgcacgtggcttgatggtttccctataaaatataatcatcgactgagtcacctgaatccttttggaactagatgggagtaaacacacccacaaataagtgcttatcaagagtattccatttcccgtcattactcagggctgcacagattttcctaagtgctcatcaaaagttcagtaaataatgtagggctatttcataaatcttttatgctgtttttcaggggtcagaagtttcctaaaatttttgagtggttttgcctgttatagaaacgtatatgtttattaaggagaaaatggagtgggaaataaaaagaataacgacaggctgccattgtctgaagtctagctatgtatattgnaaaaataccttccttctgctgcattaaaaaaatatggctctagaaaaatcaaccagttttcctggcaatgaggtaagagttaaccagaccagaatatagtccatgcatccaacatgatagctagctcattggcttttagggacaggtttttgtgtgtttgcctggtttttgtttgtttgttgttgtttttattgtaaaatatacataacataaactttccaacgtgaccctttttgagtgtacaatgcagtgggattaagaacctttactttcctatgcaaccatcaccaccatctctctccagaacttttttgtcatcccaaactgaaactccatccccattaactaccaactccccattcctccctcctccctctccttgtttgtcctgaaagcctgagtgtcgtggcctaaccctactgcaagagagcactgcaaccagcacatgggaggcaggatgcacctcttcccttcatgctttctactaaggcattaatatattacccactaacattttgatgtttatatgtgggggaacattgaagaacccagaattttatgattgaattattggtggggcgtggtggcccatgcctgtaatcccagcactttgggaggccgaggtgggcggatcacctgaggccaggagttcaagaccagcctggccaacatggtgaaacctgtcactactaaaaatacaaaaattagccgggcatggtggcgcgcgcttatagtcccaggtacttgggaggctggggcacaagaatcacttgcgtgggggaggcagaggttgcagtgagccgagatcgtgccactgcgctccagcctgggtgacagagcgaggcttcctctcaaaaaaaagcc

SEQ ID NO: 239212 - DNA, 273 bp, Homo sapiens
cctaatattgtttactataggaagttaaaataaaattagagaccatatatagcaggtaccataacattgactaaaacaccataagtgcttcataaacaggaggtatggtttatgtgataataataaatgtaatgttatcaatgaatagtaaacatgaaatgtaatgagcttgtgagcatcaatgtatgttactgtaagtatttgctctgaggatgtgagaggtatgttttgtttttatttgtgaataaacgttcattaaaaagcataatagca

SEQ ID NO: 239213 - DNA, 427 bp, Homo sapiens
tctttaactgtgttctacaacatttttaggtatttttaagtttctctatttcatttaattttaaacaacccttttaggaggagatgtaaccagaggcaactacttctctataaaaatcactcagcaactatatagtatacatgatacagaattttctatttccataatctctaaactggcactgtagatgatttacaaacatcctgagggacaatggcccttggtagacaccatagagaacattaatgttctggtaattttgtagaaaaattattctagtctgctgtactgcaaaacagtctcactacagagccacagggagccactgcacaggacaagaggagggggagatgggagtcacagagagcacagggagtcacagagagtcacagagcagggggacgtgggagtcacagagagatccttc

SEQ ID NO: 239214 - DNA, 388 bp, Homo sapiens
taggatttgccgatagatttaaaggagagtatgttgttaagagtgactcaggtttttagcctgaggccctcttaaagatggtgctggcaggaactagatgatgtagactgcagggtgagccagttggggaaaggaaggaagcaggaggtcagtttttatcccattgtttgagctgcctgctagtcatctccacagtaatgtggagatgtcagttacacagtttggacatgtgtgccgggggttctggggagaggttgggctatgtggatggtatgtaaagctgtgataccggatgatccaccaaagaggctgaggcaggagaatcacttgaacccaggaggcagaggttgcagtgagccgagcttgcaccattgcactccagcctggg

SEQ ID NO: 239215 - DNA, 342 bp, Homo sapiens
caaatcgtgtatctggtaagttacggaaatcaagaatatatagagatcttctaaaacccaataacaaaatccaattcaaatatgagcaaaatatttgaatggacatttctctaaagatatgcagatgatccataagaaaattgaaagatgttcaacctcatgatcattatataaatacaaatcaaaacgacaataaaatatcaacacacccattagaatagttattatcaaaaattaaaaaaacagaaaatgagtgttggcaaggatgttgtaaaaaactttgaaaacttgtgcactggaaataaaaataatacagctgctatggaaaacagtatgctgcct

SEQ ID NO: 239216 - DNA, 443 bp, Homo sapiens
cagtacagtgtgtaggaggggtgttaaattctggggctgcagctccagcagcagcttctcgatttgacaagctggtttattgattgtgtcagggccaacagcttcctctgcagcccagtcttgaggctgaagatattagtagccaagtgaggaatgcctttattagggtgtgcaaaattggttcaactaaactgaatgttaaagatgatcacatgggccaggtgcagtggctcatgcctgtaatcccagcactttgggaggccgagatgggaggatcacttgaagtcaggagttcaagaccaacctggccaacatggcgaaactccatctctgccagaaagacaaaaattagccaggcatggtggtgtgcacctgtaatcccagctactcaggaggctgaggtgagagaatcacccagactgggtgatagagtgagactgtct

SEQ ID NO: 239217 - DNA, 366 bp, Homo sapiens
ggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtc

SEQ ID NO: 239218 - DNA, 138 bp, Homo sapiens
gcctgattgccctgattggaatcttcagtacaatgtggaataaaagtggtgaaggcaaacatccgtgtcttgttctggatcttagggagaaagcttttatcattaactattatgttagctgtggcttttccatagatg

SEQ ID NO: 239219 - DNA, 411 bp, Homo sapiens
actcaatgcttgccccactgtgttggctctgggatatacacttcttacctagacgtttatttttactcacaggatttactaaaccttaggagctgagccaggaatggtggtgcatgcctgttgtctcagctacttgggaggctgaggtgggagatcgatttaacccatgtgtttaaaaccgaacggagctatgatcatgccactgcactccagcctaggcagcagagtgacagcccgtgaagaaagagagagagagagagagagtgagagacagagagagacagagagagagagaccttaagagctgaatccttatcaacggattctaatgaaaggccatgcttttctccaaaatgctggatgaggccatctgtctactattcttgttaataaaaataatgagatgctgct

SEQ ID NO: 239220 - DNA, 335 bp, Homo sapiens
aagctttgcaaacagctccaagctctgcaaataatgacacacagggccaagctctgcaaacacgtgtgaggagacagaagcacacagaggagaattcacctgccagggccatagaaatcctgcgctgctgtccagcactgggattcgtgtctgcccaactctcaggtggatgagttactattacgggtgacgtagcaaagcagtttggtgtgcagaccacaggcaagaactgcttgaatcctggctctgtgatctgtgggaaatatgtaacctctcgcctcctcagtttcctcatctggaaaatggggataataattatacttatctcagagtgt

SEQ ID NO: 239221 - DNA, 496 bp, Homo sapiens
gccgagggagggagctgactgcctttgggcagagcctgggttctctgacagctcctcgctttctccctggggagtctccagcagtggtccccccaccccccaaggggcccatgagcctgcaggatatgtcgcgctgcagccagcacagtgctgcttcaaactgccacttgagagctccagcgtggggacagcgtggggcccacttcacagccaggctgccaggagacgctgtgagagtgcccagaccctggaggccaggaggggaccagggctgcccgccggctccaccacctgccttggccaagggccagccaagagcactgtgacgggcaggcagggggtcgaacagccactgttctgccgacaaaagcaggccaatttcctgaaagaagaggttccggccttggctggtggcgccaggttcatcaccccgagcttcctctaggctggacacggtccctaatgggcacgggcgacgcattacagtgaggtctgc

SEQ ID NO: 239222 - DNA, 241 bp, Homo sapiens
gggcggctgtttactcgggagggaagtttccgtgacgcccgctccattcttgctttgggggaagaagggggaaggggaggcatgcgctggcgcttctgattggctcccaggagtcggccaatgagaagcgccgctgcgccccagcaacagccccgatttagaaggctggcggcgttccagggggtttcggcgttccgggcgcgcggcggggtgggggcagggacagggcccgcgggagggc

SEQ ID NO: 239223 - DNA, 407 bp, Homo sapiens
tcaaaaaaaaaaaaaaaaaaaaaaaattggctgaaacaccagacatttttcctggtgttcacctggtaccacctgtggaggacccggctaagggttcctatgtgtttctctggaagccatttccatgtgtatcgatagcgaagtttgttttaatatttcaaaagttgcccttaatggctccatgagataacagaattattaagctgccttcaattaaagcctcaagttttccatttgtaaattaagaatttttgtggcctgggcacagtggctcacgcctgtaatcccagctactgggattactgggaggctggtaattgggaggctgaggtgggtggatcacctgaggtcaggagcttgagaccagcctggccaatgtggtaaaaccccatctctactaaaaatac

SEQ ID NO: 239224 - DNA, 265 bp, Homo sapiens
gggtgaagagcgtcgcatgcattgcccctgcatctttccagatgcagctgaggacttttcttgtcctaatgtttctaggagtaaagtgaggaaaaacagcagacacgctgcattgccaaaagccagacgttgcattaccttcttcagaaagagattaaactttgtaatgagggcttcataccgccctcgtattcccgcgtcctcttaagcatttcagttattgtgtatcgttccagcaatggaaaatatatgatcattgttccga

SEQ ID NO: 239225 - DNA, 578 bp, Homo sapiens
aaaccaggagaccctctttgtttccatccagcaggtataattatctttagaatatatcaaagagattttctcacttgtttttctattagtcatagctgctaaatgtcaaagagacctcaaccaacttcctgctgattgcccagaggctacaatcagaaagcacagttgatgacatggatcaggtttctcactgattacctcataggaaatccttactccttttaggccttccagcttatggcagccctatggccaggaccctaacttgtaaggtttacttcctgtgacagcattcatcattgttcagtttagccatcataacattagccatagtcattgctaatcttgctctctccttttgctaatattgtattcttaagagtaccttttggttcacaatattattcctcaattttattacccaagtggaatgttctgttttagaacatcacctatgctgattactcccatgccactgttcataaactaccataatggcagaagtaagcatcagtttctcattactgtcagtcactgctaaccttacctctcaacctgccttcagcatataatgagaa

SEQ ID NO: 239226 - DNA, 1488 bp, Homo sapiens
gttgttgaaagtatggaacaggatcgtattccagaagtgcatgtcccaccatcttcagctgtgtctggagtcaaagaatggtttggattgggaggagaacaagctgaagagaaggcttttgaatcagttattgaacctgtacaagaaagctcatttcggagtagaaaaatagcagtggaagatgagaatgacctagaggaattaaataatggtgagcctcaaacagaacatcagcaagaatctgaatcagaaattgattcagtgccaaagacacagtctgaactagcatctgagtcagagcacattcccaaacctcaatccactggttggtttggtggaggatttacaagttatttaggttttggagatgaggatacagggcttgaattaatagctgaagaaagcaatccaccactacaagattttcccaattccatatcatctgataaagaagccacagttccatgtacagaaatattaacagaaaaaaaagacacaatcactaatgatagcttgagtctcaagccaagttggtttgattttggttttgctatactaggctttgcatatgccaaggaagataaaattatgttagatgacaggaaaaatgaagaagatggtggggcagatgaacatgaacatcctctaacaagtgaattagaccctgaaaaagaacaagaaatagaaacgataaaaattatagaaacagaagatcaaatagacaagaaaccagtctcagaaaaaacagacgaatctgatactataccatatttgaaaaagttcttgtataattttgacaacccttggaacttccagaacattccaaaggaaacagaattgccatttcccaaacagatactggatcaaaataatgtaattgaaaatgaagaaactggagaattttccattgataattatcccacagataatacaaaagttatgatattcaaaagttcatacagtctgtcagatatggtctctaacatagagttacctacgagaattcacgaagaagtatattttgaaccctcatcttctaaagatagtgatgaaaattcgaaaccatcagtagacaccgaagggcctgctctggtggagatagacagatctgtggaaaataccctgctaaatagtcagatggtttcaactgataactctttgtcttctcaaaattatatttctcagaaagaagatgcttctgagtttcagattctgaaatacttattccaaattgatgtttatgatttcatgaattctgcattttcaccaattgtaattcttacagaaagggtaagtttgccttttaaaccttttgcaataattttacctattttgctaaatataagagtggctacaaaatatgtttgaatgaatcctccctgtttaatgtttatataatgtttctctttccatgacatcttacctgtaagatttctctttatatgaatgttttgtcaaatggatattgatttttaaaaacatttccct

SEQ ID NO: 239227 - DNA, 627 bp, Homo sapiens
atgggcctcaccaggctggcaggagggttcacgacatggaacagctgtgctaactaccaggacagaagacaggaaggtttgctggaagaggggtgatgagaagttggccaggcctatggggttcccagcattcaggcaaaagcccagaggtcctcagggacccccccactgtctgctctgctaatgcaaagcccatgaggcccaaggagtctcagcttcttcagccacccgcagattcaacttcagccaagacaaatggtcccctcctgcacctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcagctggaagggagtgggagaaacgggggcagggagaagacagggcagatgtcctggagacagaaggcaatggggacccatagctcctcctgacacatcag

SEQ ID NO: 239228 - DNA, 2220 bp, Homo sapiens
  misc_feature (9)..(9): n is a, c, g, or t
tcagagaanctagacagaaggacctctgtggcccctcccaagctggagattctacgggcctacttatgccttttgagatacatgcctggcccacggattccttctagaacattgccccactagctcatcacccccaggattgggcctctggaagttgtacatctaatatctgaccttgcctcctgactgatggtcgggtcagcatggcgcctgacccagcagttccaggtaagggtccgcacgctcttgctgccagggcccaagtagcaaccttggttcctgtctttctacaccccagtgcctcatcttcccatgaagttcactggtttccttacaacagtttccctttgtctacaatagtgggtttctggtctccaaacccagagtttgacctaaaactctgttctctgggtttcccaaagccactgagagggctaagaaagacttcatcctggtcccagacccttctgatgagcatggaaacacgggctctagtcctgagctaaactccctgttctttcccgaggcagaaaggccggccatggagagcccagagggcacaggtggctgcttagccctccttttgtagaaaaggtgcaactggactccctccttgaccaaacctcagccagggtcctctgggccctcttcttgactaggcctcacccttggcctgttttaagcccagttttaggattagtgagaatccctctgagcccacgattggagagaatcctgctaagccagtttagggggaatgcccccgacccttgatggctaatcatgttcaccttcccccaccttagatactaagctcctctttttaattttccatcagctgagttcctcactctgcctttcggccgtaaacctccatctacccttgctgtattcagagctgagcttagtcctgcgctgaaggctccctcctccactgcagaactccagtaaaatctgtcttaccgttttaaacaagtgcccagtgcaatttctcttaaacagatggaaacaaccttgcgggaagacacagaaaacatgagagggtgccttggagaatcagccctgctgggaagcgtgaaacccatttaggtctgactccttgccttctactagaatatactcaaggtttaggactgccttcaagtgttattccataatcagcacatattggcagactaaaaaaagagatacaaagccaagagctctgtctccctcccaacccagggttgcctgaacaatttccctgcagcctgcaccgttaacctctagcctccggccaacatgggcttgattcctaagccattaaagtgctcagcccctctccagtaggcatccactgtggaagtgcccggtcctaagataaagaggaccaaggcatccacatttaagtcaccaggcctcgttgttctcacggccacctctgagtgctctgaggaaaacatggcactcttctcagtgtccccaaactccctgtgggatgcaagtaaccagacaggttttgggagcctgcctttgctgttcagaccacaagaagtgcctgcaaatggattcatgttctcactacaggcaatttctgggctaagttttcaaagagttcaaactaaatatctgtcactatcattctcagtaaactatcgcaagaacaaaaaaccaaacaccgcatattctcactcataggtgggaattgaacaatgagatcacatggacacaggaaggggaacatcacactctggggactgttgtggggtgggaggaggggggagggatagcattgggaggtatacctaatgctagatgacgagttagtgggtgcagcgcaccagcatggcacatgtatacatatgtaactaacctgcacattgtgcacatgtaccctaaaacttaaagtataaaaaaaaaaaaaaaaaaaaagctggaggctgggtgcagtggctcatgccagcaatcctagcactttgggaggctgaggtgagcaggttgcttgagcccaggagtttgagaccaggcgaggcaacatggcaagatcccctctctaccaaacaaacaaacaaacaaacaaacaaacaaaacaactagctagggatggtggtgcgtgcctctagtcccagctacttgggaggctgaagtgggaggatcgcttgagcccaggagttcaaagctgcagtgagtcatgatagcaccactgcactccagcctgggtgacagagtgagaccctgcct

SEQ ID NO: 239229 - DNA, 624 bp, Homo sapiens
tgaaaacattaggaagactatagaaaagagcagattaccaaaaaattaaaaaaaaattaatctgtaattatgctgataaattctgaaaggtcttaattgaacttataattatagattcatactcagctatgagaaatgagatcccatgtaccattcatccagttttctccgaatggttacatcttgccttaaaatgtttttcatcctttaaatttggataaaaatttaaaaataaaacccacataccagttctagttatgtatttattaaatacacgcttatttcctctcacttctaaaatcctattaagatgccagtaaggaataaaaaaagaagaggctgggtgcagtggctcaggcctgtaatcctagcactttggaagtccaaggtgggcacatcacttcaggccaggagttcaagaccagctgggccaacatgctgaaaccccatctctactaaaaatacacaaaaaaattagccaggcatggtggcgcgcacctgtaatccccgctactcaggatgctgaggcaggagaatcgcttgaacctgggaggcagaggttgctgtgagccaagattgttctactgcactccagcctgggcaacagagcgaggtgccatctca

SEQ ID NO: 239230 - DNA, 3269 bp, Homo sapiens
  misc_feature (844)..(844): n is a, c, g, or t
  misc_feature (1013)..(1013): n is a, c, g, or t
  misc_feature (1155)..(1155): n is a, c, g, or t
  misc_feature (1836)..(1836): n is a, c, g, or t
  misc_feature (2947)..(2947): n is a, c, g, or t
ttttatggatgaatgcatctgaggccagacaggaaaatgacttattgctggttgaattgctgattagtggctggattggaggtagaacccagatcatctgcctcttcattctactcatgtcctgtcatggaaattagtcaatccaattattattattatagaagtctgttttcaccagaaagtttgtgaactgacaaccgtaaaatctgtggtaaattcacaggcttcatcaatgacactatgaaatattgaccctcagcttcccagattgcaactccccaagtcttggtctgtttgctgttaagatttgttacaacttcttgcttattgccttttgttacacaagcagtgctaaatatgggctggatattggaaagagggcaagaaaatgagaacccacagttctgtgacgtgacaacactgattggccagtcactgttatctgcaggatgtgcttttcttaaggatgaacatattttggtccacaagtttccaagacaagcacattcctgccaacatgatccttggacaaactgttctggaatttgaacttgctactggaagagggttaagtccaggacacacacacacacacacacacacacacatttcagtggggggcaagccatagttggttatgttagcacctcattatacaacagtttcaagataaagtgattccagatgtgctctcagtaagtacctagtacttatgtttttaacccattaggctaaaaatctactttcagaattttggggaagccagagttagttaattaactagtcattcctagttacttcataaagttgattctaagtcgactataatttgcagtatgtttcntgttagaggatacccattataaccatatgaaacatacatatttatagacacatatatgtattttcacacagacttgcctttgacaatgattagaagttcatctgaagtactggtttaatgatcattaggttcctttgtcccggaaatttcatttagaaacattaggaanatatatatctaagaagtagtattctagtttcttcttattaatgaagctgcagtgatagtcattgtgattctgaagcataaatttcatgagtaagtcctggttaaaaggctccctcccttgtttaaaaaaccaagatttgaanttttttgctttgtaacttaaatttacaaaaaagagttaaagagaaaagatgatgaatgttttccttgataattcatattattgttaggaatatggaatttttgcatcacttggccctagaaggtggagagctaaaggtgaacatttcattttgctttcaaatattttaaatttgtctgcagaaattatgttttctgctgaatacaatggaagccttcttagctggtcttacttgagaatattgcatcttagtatgctcttttgattttattttgctctacagtaaatttttaaaaatttaggtatgatatctggcatcaaggacaacaccatttatttgccaaaggctgtaacctagggcattatacactaaatgggaatattggcaaacatactgttcagaggtacctgttgtgctgtagggcagtacctacagcaaagcagtctgggtatgatggactctggatccagactgtttggtttcatttcgcttctgctttttactagctgtgtgctttaatttcatgaatgtgaaagataaataataactcatgaagatttagttaagtctgaacttgtaaaggaagcacttagaaccatgcctggcatatgttaagtacttctcaagtgttagcttaaacaaacaaacaaatctcaaattttgtctttgtcatgtcagagnggctaacatcaagtgatggctgaagcagcaaacagctagttaaatttaaaagaaaaatgatctttgggattaatcctatcttgtgaaaagttttctagagcttccatccagctgtggctaaagctagaggacaagaaggtgaggaaagtgtggcagagtgaatgccattgattaaagaaaggccaggaccttgctgtataacaattgtttctattatttctattttgagagaaagacccttgatgttacccgtcagcaggagatggatggtagtctttgtgtggattgacaaacattggtagtttaacaatgtgaagggcttcctttgcaggaaatgaaaaagttgtgattttccataagtcatttagagagtcactattgagccagccaggctgggcccgctagtctatacaatggttttgtgacaattagccttgtgctgttgcagcatttcagactcatggagcgttttgcttagaagacctctcttccttctggctgacacagccccatcccagggtgcagggcctgataagtggagtacaggctggatttcagccctaaccacccgctccccccaggacatggtacagtacacaaatggcacattgaaggtggtagccatgaagacaggtttttgaattttactttctgttcttcagctcaggaaatatgttgtttatttttgtttttcagtcatagtctacttcaatagctggaactggggaagagatggttcagtattttttgtcattgaatccaatggttgattgttaattattacttaagataatccacaaacatcctgctgacagtccaagactgttttctatcagaggttttatgaagccacttaatttagggttaaggtcctgctgaaccttacaggagtctaaaagcaaggagaaaggcatcagaatatcacacccttttagctataaatcatatttctgtaatgctgttgctactttttttctatgtgctcttgcaatttaagatgatgcattttatttccaatggtttgcaatctgtaactgaaagacagaatgctcggaaaagcctctggctaaaaaccagtctattgacatagaatcatgtcaggagtggcccnaggagatttgtgggttttggcctgtcttgtttctcatccaatatttcttttcagtattatcacagttaaattcctcattggatatgcaatagattaaaatcacattaaagtttggacttaaatcaagcatagcaaaaaatgattctttgacattagctcccaagattcttctattatggtttcagtggtcctgaactttggaagatgctgatcaggtaataactgttctgtgccctacaaggaggatgccacctgtaaaaaggcactgagaagttttattgtctcaaatatatttattctgattcttaagaaaacttgaaat

SEQ ID NO: 239231 - DNA, 398 bp, Homo sapiens
atatttggagatgtagccatagaaactgtccatgatgaaacagagaaaagagaattttaaaaaatgaatccagcatcagtaagctgtgggacaatttcaaacactgtaatcttcatgtaactggagacccatagggagaggaaagagagataagttctttttaaaataagaaacgtagatagaaaattttccaaatttgatgaaaaccataagcctggtgagaggactttttttttccctcttgacaccaaatacaggtatcttttccaatgatacttcttgaactgacaccgtctgggtgtccaaggatttaattcaattctaatactcaacctgcaactagtgtcagataccacaagttagagttgagttacacaagactgcccccactttacaca

SEQ ID NO: 239232 - DNA, 295 bp, Homo sapiens
gcattttttagtagggacggggtttcaccgtgttagccaggatggtctcgatctcctgacctcgtgatccgcccgcctcagcctcccaaagtgctgggattacaggcgtgagccaccgctcccggcctgtctctctgtttctctgtctctctctttgtctctgtctctctgtctctgtctctgtgtccctctgtctctctgtttgtctctctctgtgtctgtctctgtctccgtgtctctctgtctctgtctttgtctccctgtctctgtctctggatccctctgtctgtttctc

SEQ ID NO: 239233 - DNA, 388 bp, Homo sapiens
tagcagatgttggaaaccatagtcacattctccttccctattccaaactttctttttcactggcaatactcaaatgttgcttgagtatccattctctacacaactacatattcaggataaatgttttcttctccagttccagggaataaattacataagtgaaatgcaattatggtgatctatttctcttcccagtgattgatttaatcacataacccaattttgtccagtgagacctaaggagaagcctcttgtaaagcctttataaaaggttgttcttactaccgttgctccttgattctctctggtagagctatattggtattcttgctgtgtagattatgccacaatgctgtgaaaatagtgtttaggaaagtctccaaatcca

SEQ ID NO: 239234 - DNA, 456 bp, Homo sapiens
tttgttggtaaaaatttaagccttttggtgagtacctcatttctaaagttgatcatgctggttgtacataattaggctacattatcgcccttttctggcaagcagaacaaaacatggttttctctccccctccccttatttcccatgtaatagctcggaatcttaatcttaaggcattctaagctttcaaagtcttttttaattatacattttcctgtcatcttccctaaagacacttttactgttttcaaggctggaattccgttctattttttatccctataatgcctgttgaaataaatggaggtaagaattaatgataaactaaatagataaaaataatgagcaattgtgtgattattgtttttggttgttaatttatctacttgatgtgtttttattgagattctactgttaattagacaaatgaagcacccagaacagtactggggacat

SEQ ID NO: 239235 - DNA, 318 bp, Homo sapiens
ggctgtagcggcttgcctgatcacatgctcaactcttccacctcagcttccccttagcacacacacaacttctctccctttgccaccaacattcttatgggagtggacactcccattgcttcacctgccctgatgatatgacctttcttccaacagtcactgaactactttgcaatctgcctgacctaccttcagtaatctgcagcagccaaccacactctccttgaaatgctttcttggacttcttccattaagaagtggtattataccgtaccaccctgagccatcaaccttgctctccagtcccttcttagtatc

SEQ ID NO: 239236 - DNA, 379 bp, Homo sapiens
ctgagagaagaataggatttttacaaatccgtagcccatagagtatttcaataaggacagataccaaatatgtcatcaagttaccagctgggaaattaggctctacttacaattctgtcactagcaaactacatgaccctgagcctttgaagaagaggaattctctactgaactactttagagtcgctgtttagcttctataatatcataagtctaaggcttcaaacactctattttaacaaacagcatacatagcctttgaattcattccacttgtgaaaacataaaaagaaatcagttttttaaaagttatataccaacaataaaagctacaggcacaaagattttcaccaagatacacgaagcacacacacagtat

SEQ ID NO: 239237 - DNA, 873 bp, Homo sapiens
  misc_feature (75)..(75): n is a, c, g, or t
  misc_feature (77)..(77): n is a, c, g, or t
  misc_feature (108)..(108): n is a, c, g, or t
  misc_feature (120)..(120): n is a, c, g, or t
ccatttaagttaagtttagacacttaatctccaaaaagattaaaaatgaagccaaagtctgaagttttccacttnantctttacgctggtacatgaagttggaagagnccataccacagnacagcgttttctggtgtatgccttgcgctctgcccgcaacgtgcgacccccagagatagacgtggtcagggtgacacacggcctgcaatgaagttcccgctggcgggtacaaacaaggtataatgtcagagttagaagacaacattcttgttttccttaagttgtacccatttcagtactttacctgttaatagttctaaaatgtttaattattcctctagaccacctggtacacaaaagcaaacagaaaaactcttaagtttttctgcaatactaaagaaagtgagataagactttaaagttaaagatctatagacactttaggcaaaacaggctcataaagcaattaaaaaatcaacaatttagtaaaaacaggctacatagtattttgtttttacgtttcatttgtctattgatctttaaattaaattagacatttctactgttttcctgtactcttatacacacctgttttctccaatgttctcctttagtatggctggtaattgttttggtgattgccaccccctcgagatgccttgccataagtgctctgttggcctattttgaaaacacagaattctcattaagatagtggtctactcaactttcggtacaaacacaaactattaaatctacgaatcgttgcaggctgaaataataagttattaagatatttgagctaccctattagactgctactctataaatcatacatcctagttctatttatcaccaccagtctatggtagt

SEQ ID NO: 239238 - DNA, 763 bp, Homo sapiens
  misc_feature (75)..(75): n is a, c, g, or t
  misc_feature (77)..(77): n is a, c, g, or t
  misc_feature (108)..(108): n is a, c, g, or t
  misc_feature (120)..(120): n is a, c, g, or t
ccatttaagttaagtttagacacttaatctccaaaaagattaaaaatgaagccaaagtctgaagttttccacttnantctttacgctggtacatgaagttggaagagnccataccacagnacagcgttttctggtgtatgccttgcgctctgcccgcaacgtgcgacccccagagatagacgtggtcagggtgacacacggcctgcaatgaagttcccgctggcgggtacaaacaaggtataatgtcagagttagaagacaacattcttgttttccttaagttgtacccatttcagtactttacctgttaatagttctaaaatgtttaattattcctctagaccacctggtacacaaaagcaaacagaaaaactcttaagtttttctgcaatactaaagaaagtgagataagactttaaagttaaagatctatagacactttaggcaaaacaggctcataaagcaattaaaaaatcaacaatttagtaaaaacaggctacatagtattttgtttttacgtttcatttgtctattgatctttaaattaaattagacatttctactgttttcctgtactcttatacacacctgttttctccaatgttctcctttagtatggctggtaattgttttggtgattgccaccccctcgagatgccttgccataagtgctctgttggccactgtagtctgcatatccctgtccatatccttgatcataatagttattaaatccttggttccagttttggccctggcctcg

SEQ ID NO: 239239 - DNA, 210 bp, Homo sapiens
ctaatgttctacctttatattcaaatgcattagtcaagacatacattgcactgaaactttgtgggcatcatccaatgaagaaaaatatgaagccaggtgcagcagctcatgcctgtaatcccaacacttcgggaggccgaggtgggaggatcaattgaggctaggagttaaaagaccacactgggcaacgtagtgagaccccgtctctac

SEQ ID NO: 239240 - DNA, 475 bp, Homo sapiens
agcaggacattcactgtgtgcttatcacagccattcaatatgtccaaggcttattttcccccaaacacattcttcctcctgtagtcccaattttggctaatggtgacaccatgtttccagttattaaagctagaaactcaagctttattgagatttaacacacatatcattacaacttacccatttttaaagaatacaatttgctgggcgcggtgacacatgccggtggtcccagctactcaggagggtgagctgggagaattgctcgagtccaggagttctgggcagtagtgcactgtacccactggtgtccacagagggtggggggcaccatcaagttgcctaagaaagaggactctgcccaggtccaaaacagagcaggtcaaaactcctgtgctgattagtaatgggatcatggccattgcactccagcctgggcaacatagcaagactctgtctcctattaaagaaaaaa

SEQ ID NO: 239241 - DNA, 549 bp, Homo sapiens
ggagaaagcagcccgactcagccccgagaggttcggtgtgcgggcagcggccagggactttgcggggtagcgcggactcctggacttccaacaagggccgctgcgcaggcgctgcaatcactgcaggcacttgtctgcatgcctggtggggcttggagtctggggaggcttatcagtaaagcccagagcatttgctatttattgctcaaggggcacctttgtacagtctggccgtttgcttggcatggcctcttagaactccttattgtttaagaaatccgatctggtgaataagaagttagtctttctctcccagtcactgcctcctggacgaatatttgccagcacggaggcagagaggacagaaaaccacaagccatttggggaactgggaacagttcagtgtttctggggtgtgggggtgtcaaggtgggggatggggttgatggaaaacatttgcaatttctgctttacctcacgattcccagctctgacctctggacctgttctctcccacccctaacataaatcattttagtttcattcagt

SEQ ID NO: 239242 - DNA, 756 bp, Homo sapiens
  misc_feature (718)..(718): n is a, c, g, or t
ctaaaatcatcagcatttttatgtattgagattattaatattgaatgcaatagttattggatatagctggtaagttctctgccatgcatacttacaataatccttctacctctcacttttaacatgggctatgatacttcaatataaatagaggaaataattatttaccagatatcccaggaagcattcttatggaactattataacagtgcactccccaccccctgggaaatctcaaaagccaagttcttcagtgtattctatggtgtatgaatctgcatttgtttttccttttctatcattagcttttcctaaaggcaaaatattataactttataagaatagtccttctcctgcctatttaatatttcaatgttaatataattgtattggtttttaaaaataattaaaatggcaacactttgcgatccaatctgatatttaatttttaaaatgtaacaatttcttataaattcatgctgtgttttaagtaaaaatcatgtatatgaattattttaccaagtagtattatctgcacgagacaaatttaagtattttaaaaattactccttattaataaataatcctcatataatgcacagtattgccacaaatgcccacttcattttgtctgcatagacatattaagaatttttcaatgatgtaatttaattatcctaaaagaaatgacagattcttctgtaggaaaaaataaaancatgaatatttttaaaattttaaatggttaaatttcta

SEQ ID NO: 239243 - DNA, 453 bp, Homo sapiens
accttatcttaaaataagggagaacttccttcctcgagtagacacaggagccccctaaagccacaaagatgcagcctatcaaatgtgagggcctctgcttctcttccctcttcccagctcgcaggtcagagagactagcaggccaggcgcctgattggattttgtgtcctaaggacagaaggcaagctcccgtctgcccaggtggccttggagaaggctggggaaagggatgccctgtgggtaacttcaagccccttctttcagagtcaaccaggcacatgatgggattgggggtgggggacaggaagattggggagggggagggagggaaagagaattcattaacccttcaatctccagagtatcaggtcaatgctatacctgcctgaaagaaaaactggtgaattctgaagtcttctaatagtatataaaacaaaggcgctgcttgcacag

SEQ ID NO: 239244 - DNA, 510 bp, Homo sapiens
tgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctagggcatgggcggtagtcacggtgaattccataccaggggatatacattcccttgctttactagaaagaaaacagggccacttgggatgggtctttcactgttcatggc

SEQ ID NO: 239245 - DNA, 385 bp, Homo sapiens
tgattagggtggacagttggccatattggaatagctagttctctttcttgaaaatttagaagtgaggataagataggataactttgggatcgtctcataaattgagaaatgtaaaccagaaagctactgaatgcatatataagctaagccagtagacagaaagagagagagtagaaaaaaatgcttaatgtgtagagagagtgagagaaactgttttcctgtcccaggcctctctttcttaagctgctgtgaaagagttttgttacttgcaattaattttcttattaagaaattttccttgttatgttagatttaatttattgtaaatgccctttctcaatagaatcaaacatatatgaatttaactgcctataataggtaagta

SEQ ID NO: 239246 - DNA, 361 bp, Homo sapiens
tggctggggataagaatggtcaagggcacagaggtgtgatgaccagggcaaggcaaggaatgaatgtgatgagtttccacagaggttccctatgggaaggcctcatctgctgttgagcagtatggcctttctgtaggtgatggggagcccctcagggcttaagctaggtggtagccggctcagttctgctgtgaaagaatgctcactctagctgcaacatggagaggcaggcatagggaggtggaggttacaatgaagctgaaagacaggaggatcgcttgaacccaggaggcggaggtcgcagtgacctgagatggtgccactacactccagcctgggcaacagagcaccagctcaaaaa

SEQ ID NO: 239247 - DNA, 288 bp, Homo sapiens
taattttcttatataagtctttcttgtgtttcagaatcatattattcattatcatgccctcgtttaagcattactttcttgggaaaaccttttcagatctaccccagtttatacatctctcttatgggagctattaccatatgtttcttttaaattagttgtgaagatgttaaccctggacttcttaaatgtctaattcaagtccttataattatttcatgacaccaatactgacaaaactagcacacagaagatgttcaattaatgtttcctgtgttttcataggat

SEQ ID NO: 239248 - DNA, 319 bp, Homo sapiens
ttgtattttctgtagagacagggtttcgccatgctgcccagtctggtctcgaactcttggactcaagcagtctgcctgcctcagcctcccgaagcaatgagattacaggcatgagccaccatgcctggtgattcctgccatttttacactaagaacctgtatcttattgcaaatgcatgaagatggcatcattatattgacaaacttgattccattctaattttgtattcacataggaacacacatttgtgtgaagtgagtcactcatttatatcctaatgtctcagattcatcctcttcccccttctgtcgtcttctc

SEQ ID NO: 239249 - DNA, 453 bp, Homo sapiens
atgagacagtgcatttctttttcatttttgacattttagagattgtgcatttctacatctataacatatcgagagtctgtaccctagtaccctactcctcactcccccactgccaccccccttagtctggactgctctatagtcttgcctggatgatggcaccagcctcataaataattcctgtttctgttttttttgttgttgttaatataacagtttcattgagacataactcatataccttataattcacctatttaaagtgtacaattcagcaagttttagtgtatttgtagagttgtgtagctatcactacaatgtgagggccaggcgcggtggctcccgcctgtaatcccagctctcagggaagcaagagtcaggaggatagcttgagcccaggagttcgagacctgcctgggcaatatagcgagacctcgttctccagaaaaagga

SEQ ID NO: 239250 - DNA, 693 bp, Homo sapiens
tatcttttctttcatttattactttcatgtcatcttatcctgtataatttaagtcatcctatatatttttgcaaatactatctttcctccttctgtccctccattccttccttcttttgtgtattcaagtagtatttattaaatccttcattttattccaggcgtaatactacatcttaggaacaacttattattagacatgatactttccgtcatgaaccacataacttgggtatagttggccagaccttaacgttgacattagtcaggcatgcacacacacatacatgcacacgcatgctacagtgctgtagatattctgatggacgttagtgggaaggtaaatggaagacatgaacaattctaactgaagatggctggttatcaaaaggtgttttggaggcctgccttttgatatcagtttgttgatactatacacactatttccatattgagttataaaactaggagcctttagttttctcaaattagtaaaatgctgaaataaaataaaatattacaaaataaatttcttaataataggatcacaaaagccttagtagaatgaacaatttagagaatggtcagttctagtatgggtgttagaatatttataaaataaatgaagatttgtcacctttatttcatacagtagaatatatttacgactaacagtattctacatgaggtcag

SEQ ID NO: 239251 - DNA, 389 bp, Homo sapiens
gtgactagtactatgtttcaaatgctgaaatacctttgtattaaaaaattaatgagtgtgatgaatagcatggaatctaaacctctggccttgatttcacatgtaagtcctgtgtgagttattgcagtgtctagtctgctttcacagatgaatggaaagtatattttggttttcttcttctggaagccagttgtgttcacagtagaatggtgttaaaaaaggcttcctttttggtaaatttataactttttttatttttgagatggagtttttgcttttgttgctcaggctggagtgcagtggcgcaatctcggctcactgcaacctccgcctcctgggttcaagcgattctcctgactcagcctccaaagtagctggaattacaggcg

SEQ ID NO: 239252 - DNA, 451 bp, Homo sapiens
agaacaacatatcagtcagcacaaatgagtctagcagagtgcccactgagagaacacagaagatgagagaataaacaaagatggtcgtggttgccttccaaaggaggagagttttgagaatttaatttgtttccaatctttgctattataagatatatattatgatgaacctgttgattcataaatctcttactatattttggataattttctcaggacaaatgctcccaaatagaattactaagttaaacagataccaaggaaataaacatttttaaagagattttgatatattgccagatagattccaattgctgtctagaaagattatataaatgtatgctcctcaccccccagcagtgtataagcgtatccatctcacaaaaacttggaagcatcaataattacgattttttaaaatctctaataaagcaagtgaaaatatctaatt

SEQ ID NO: 239253 - DNA, 355 bp, Homo sapiens
gtgatcctccgccttggccatttctgaagttttaatgctaccaaactgatagtgcctggttcttagaaggttatcaagtaagtttcactcactcaagctctgctctatagaagaaaacacagaatttgtggaatcttggctttaatactacagtgtgaacttaataatgctttcccaacccttctattctgtcagtaagccttttgttttgccctttcactggataattaatttgagggtttgctctcttgaagtgaagtttagcactagaggactcaaagaatgattctgaggttttgagcctatagaatggtgatgccattaacgtggaaataaagaagcagagggcaaagta

SEQ ID NO: 239254 - DNA, 333 bp, Homo sapiens
agggcccggcgggcgggctgggtagggagggcaggcacatatgcacacacaggcactttgtatcttctgcatatacaggaagagatgggtttggtgatcagcagagcttaggtttcatcagggcaggtgctgagcttcattccctccaccctaaacactgccctgcaggccggggatgcttccaatcctgaatgctcaagctctgcccagaatgtggttgtcagggcaaccaaaattcacaggacgaaaagattgagaagcttacagtgcttgacatgccatatagagaacccttagcttgctacaaactcagtttttaaaaatgctacttgg

SEQ ID NO: 239255 - DNA, 325 bp, Homo sapiens
aggttgatgacagccctatagctggcctaaggaaacaccagtccatactggaagagaaaagttctggaaaagatatggaaaagaaatctatggtaaagggagaactgagtagaatacctgatagatttaaacagaaatctctaggaagataatcaccaagaaaaacaggagtcacatagattacctgatgtattggaacgttttgagaaatgtatactcaggctaagaagttgaggatgagtaaatgacaggtacattacacaataggaaatgaaaattaaggcaactagaaactcccagggaaacaaaatagtgatcatgaaag

SEQ ID NO: 239256 - DNA, 622 bp, Homo sapiens
aacagttggtaggtcagtttttttaaatttagtcattcttatagatgtggagtatggtatctcattatggttttaatttgaattcccttaatacgtaatgatgttgggcttcttttcatgtatttatttgccatctgtgtatctttttcatgaaatgtttgttcagatcttttgcctatttttattggattgtgtgttttcttattatggtatttaacttgtcactgttaggatacatttcaaaaatcctgaccaagttctaacagtagaatgtgtcagtaaatgctcagtttaagtaaaatgtcacattgcaaactaactaccagggtgtggcccagcaatcttaagtactttccctggaagtttctgtaatatgcagaacactttcaattgaaataaatgctgttaaggaggtcaactcaacctttccaaatttttattaattaaaagcagttgttggagagttgtagaaaagtattttttcacagaggcaaatttgtgggtcatattgccatacatcttgccacgaaaataataacataaagtgttttgaagaattcaccctgtaaatctgtcagaggcatgtgaaccaaagcaactccatcttgaataggggctaggt

SEQ ID NO: 239257 - DNA, 857 bp, Homo sapiens
  misc_feature (468)..(468): n is a, c, g, or t
  misc_feature (855)..(855): n is a, c, g, or t
ccatgaaccaaccctctgtcccttcacacagcaacattcattcaaccccatgtctcagtactagggaaatggaaagacggtcattgatcctcaaggacatcccatttagaagaagaaaagacaggaaatcacttccaacatggtgtgttactgtcaggccaataatgtccagaacggtaaaagtataaagaaaaactaacccaacccagagaagtgtcaaggaaagcaagatagaagaggcgaggcttgagtgcttactgaggaacaagtaacagtttgccagaatgagaaggtgagaaggacgccccagtcagaggggccatctggaaaaagcatggctgcttctgaaatcccccagggtgtggctgcaacatggatgtctatgggggcatcatccagatgcagaggaagagggagccacatggaaacacccaacttgtcattttggaacttgaactttatccagangcttcccaggagccactggaagatttaagaaaggtcctagccaggtttgcattttgggtaggtagctctctctgctgacaaggcagggagaataggatgggaagggctgtaaccacaccagatgcggtggctcatgcctgtaatcccagcactttgggaggccaaggcaggaagatcacctgaggtcaggagttagagaccagcttggccaacatggcaaaaccccatctctattaaaaatacaaaaattaggccgggagtggtggcacatgcctataatcccagctactccagaggctgaggcaggagaatcgcttgaacccgggaggcagaggttgcagtgagccactgctctccagcctgggtgacagagcgagactccatctngg

SEQ ID NO: 239258 - DNA, 408 bp, Homo sapiens
tctctcctgctgacagtgagaagatgggcttgcttccccttcaccctttgccaggattgtaagtttcctgaggcttctgtacagcctgcagaactatgagcatgcagaggtcaggacaagagcagctggtccagccacactgtgtgcacagggacaggcctgtcttcacctgtgctcaccggggcctcttccagaggtctctgcagcagaaagcatgtgctccacgtaccggcccccagcgtcccaccagaccagcgccgatccctgtgggagctgaagaggaactgtgctgaatgagaacatttaaagtgaatcatgtgtggactccctatgctccctgactccttgtttatttctaccttttctggcggatgctattaataaaatgctaggaaaatctttaaacat

SEQ ID NO: 239259 - DNA, 435 bp, Homo sapiens
ccactggccttgggagggcacacacaccttgtatggcacggtcagaacaacaataccaacaacaacaaaaagaataaaccagcaccataaccaagtcacactgacttgctctgggctttgagttgctgactccctaaggaactgatttttgcagtgctgatgtctaaaatttggaagaaacatacctttctgtgcagggtaaataatttgagaaagttgtttttgcagcatgaatggactacatacacaggctatcatcagtcacctggcaggattcttccctttaaatatccattatgcttttcatttgttgagcaagacttctaaagaccacttcccttgcagcttccttgcaagtaaccttctcttcttttataaatgttttcatttctgaatcttccttttaaacacactagtgcaaggaattcactacca

SEQ ID NO: 239260 - DNA, 343 bp, Homo sapiens
agggctgtacagtttccccccttatgtgggacaggatgactggagggggttgaagctgtatatttccctttccccatgtagaaagctacagtaggctggagttaggtatttcccttcccccaggtaggttaggctttggtaataccatgtctcctgagggtaggctttgttaagaacagaaagctcttgcatcttcaatattcactgtgaggtcaagctcctagaggtaaaaactcaaaactgtggcagccctcccccgtgactgggtccctctgaagtttctaactctcagagttgtccatactgggcatctagcgattcatcaattacagttcagcctttc

SEQ ID NO: 239261 - DNA, 1109 bp, Homo sapiens
ccgagaggacaggactggaaggtggctagggatgtgtagcgggagaagggtcagtctcgatcttcccctgtgaagctgtcagcgaccatcagagggtacgccggggtggcgcggggacgatgccaggagccttggagtgcagaaggcttcgactccccgcacccacagagttgcgtagggaaccacgggcaaccgactcttccttgtcagcccctccctagcttctgcggcttcacacctccattccgcgccgggcagagtctggcggctcctggagcacggaaggcccacaagcgtacccgtggggccgcggccaaggctggactttgagcccaggaccccaggaccgcccttagaaggctgcgccggcccgcgagaggtctgggatctggacagcgcgggggctggctcacagggactggtgaaggaaactgccgggacccctgccacagccatggctccccgcaaagacgacctcgagcaggcactgcgggcagtttgtactagcgcctagaaccctgacaccgggaattagtctcttggaagagctagcgattggaggctcaggagttaggctgtttccttgttaaccaacaaaatcaggtgaaaccaacgaagtcaggaagcctaaagacatatatgtacagatatctaaccctttacgctaattatttagatttttaataaatctatcttaatgtttaggtatgaagacgggaggaactgtggaattttagtcaagttacagggaagaaacgctttctaaaaaaagaaaaacattgctcacatgtgacctcacagtcttatttaacccatggaaccaaaatatatcagagtttgtatcaaactaatcttataaattttcagcaaccccatccattcactcactccccctccaggatgaggaagctcgtacaatgggatgtaatcctcagagaaatttaggaaataacttgtatatggttggaaggctggataaaaatactttgggcaggcgtggtagctcacgtctgtaatcgcaacactgcaaggccgaggcaggcagatcgctttagctctgtagttcgaaaccagcttgggcaacagtaagaccctgtctctacaaaaaa

SEQ ID NO: 239262 - DNA, 438 bp, Homo sapiens
cctgaaggctgtgggacccatgatcctggttagattctccttctgcttgtccctggctgtgctgcctcaggcacattacttaacctttctgggcctctgccacctcatctgtaaaatgggcatgatggtgaagccaggttgccagataaaatataggctactcagctaaatgtgaagttcagatcaatattgaatttggttttactgtaagtatatcccatgcaacatttgggatatacttatactaaaaaaaaattattcattgatgctatggtttgaatggtcccccaaagttcatatgtttgaaacttaatcctcaaagcagtcctttcaaccttgtcaacctgtcggcgcggcctctggtgcagtggcggcggctcctgttcctgccgcagctctctccccttcttacctccccaccagatcccggagatcgcc

SEQ ID NO: 239263 - DNA, 514 bp, Homo sapiens
cataccccagagagccccaattcaataaggtgagagggagtggttcagatgaataccctgattaaggatgaatagaatgttcttcatctattgctctcttaatcattagattcctggaggcacctttttactgggacagtattaaatatttcaattatctggacatccccttaagaaatctcttgctttacctcccaagatgaattttgagggaggaccttacctggcacaaacagcagtggagctccaaaggctacattgggtagttccagccgggactcccagcccctcacctcacttgttgagggcaggaaaggctgctgtggttttcccttcctgggcttgcccatcctgctaattttaggctgcttcctcatgccactgccatgggtatcagagcatgtggctccccttggaggagctattttctcctgtgagcctcacttgtttgtttccagcttctctcccttcccctccctgctccccacctctgtagggtagagttgtttcatag

SEQ ID NO: 239264 - DNA, 2045 bp, Homo sapiens
caggatgctgaggcagaagaattgcttgaacccaggaggcagaggttgcagtgagccaagatcatgccaccgcactccagcccacacgacaaagtgagactgtctcaaaaaaaaaaaaaaaaaaaatcgcagcttagctgaattcttgatagaaggtggtgacttagatgccttctcttctggtttgtctgctgtgtctgtgtgcacctggacccattgtgctctggaaagcaggcacactggagtcctggagtgcaggctggctggcgccttgcagtgcctggtgatggctggggtttggtccctggtctgtcccctggggttcccatgtctattggtgaggcagcagtgtgtgctcgtaggagaccctctgtcaagaggctctgtcgggagccagcctgctgccctgcctttgaggctgatccttcaccctaggagggcaggcactgagggccagcactctggtcacgccaaggatgctatggcgacccactgaagaatgagctattaccctgcccacccctgcctgctgtgcccccaagcaccccttgggggttactcacttgccttcctggtatcaggttaagaggttattagaccttccatttattcactcaattcttttccctgctctcctgagtaatagctcaggaacccgtgccccagccatgctgggaacatgcttagaaagtaaggggaaacctttgggccagcacccacgtggttttgaatcactcaaggacaatctgcctaagtcactggcttggtggccgtgggccaagcaaggagtcatccagtagcgcctctgccctcactgtcctcctcctccaggtttctttaccgagaggaagccagcgggaggcccgacatccaaaacattgactagtgtgcccccgtgtggctctggtggaagggtttggaaaatgcagccaggttttcctaaccttacccaccaaggccggaggatgccctaaggacagcctgcagcccctgcagccctctttttgcgtaatctttgatttttcttgttattatttcttaacagttaagcgccttaaggcctcatttaacttgagttaaagaagtgtgattttggaggacccaaagattttccactggtgtagggaatgtctcctcccggctctgagagacttcctccaatccacaacctaccgcaggtatgtgttcttattaaaaggggcagggacaaaagctctgcctgtccctcttgtactttcaggctataatcaatcagcaggcacacctgttcagactgtgacattgaatttccaggatcagaaccagagcctggtacagacacaagccttccagtacttgtattttaagttccatagatgcttggaccttttgtgggctcctgggacagtgatcatgaaagaagagtgctcccaggggatgagcaagatgatcccctttggctgggaagaaaagattccatgtccatctggtttttattactcctctaaaaatgttccctttatagttttataattgtacttaaataaaaataattgcacttaaataaaaaaaaattggggagattatagcagaagctgttggtgtcccggccatagctgtgtcccttggtctgccacagaggtcactcccagaatacacttaggactccctgtgtctccttctgagggtgacctgagccacgatgttatgggatggaggctaacacctggtaggccccacatttttgacaatttggttttaagaaaactcataggtatggccacacgtggtggctcacgcctgtgatcccagcactttgggaggctcaggcgcgcggatcacgaggtcaggagatggagaccatcctggctaatacggtgaagccccgtctccactaaaaatacaaaaaaaaattagccgggcctggtggcgggcacctgtggtcccggctactcgggaggctgaggcaggaaaatggtgtgggcccaggaggtggagcttgtagtgagccgagatcataccactgcactccagcctgggtgacagagtgagactccgtctcaaag

SEQ ID NO: 239265 - DNA, 1997 bp, Homo sapiens
atatagtggtagccacagcaccacaggctagctgggggtagtctgaggctcgttaaaaattgacaaaaaaaaaaaaaatcgcagcttagctgaattcttgatagaaggtggtgacttagatgccttctcttctggtttgtctgctgtgtctgtgtgcacctggacccattgtgctctggaaagcaggcacactggagtcctggagtgcaggctggctggcgccttgcagtgcctggtgatggctggggtttggtccctggtctgtcccctggggttcccatgtctattggtgaggcagcagtgtgtgctcgtaggagaccctctgtcaagaggctctgtcgggagccagcctgctgccctgcctttgaggctgatccttcaccctaggagggcaggcactgagggccagcactctggtcacgccaaggatgctatggcgacccactgaagaatgagctattaccctgcccacccctgcctgctgtgcccccaagcaccccttgggggttactcacttgccttcctggtatcaggttaagaggttattagaccttccatttattcactcaattcttttccctgctctcctgagtaatagctcaggaacccgtgccccagccatgctgggaacatgcttagaaagtaaggggaaacctttgggccagcacccacgtggttttgaatcactcaaggacaatctgcctaagtcactggcttggtggccgtgggccaagcaaggagtcatccagtagcgcctctgccctcactgtcctcctcctccaggtttctttaccgagaggaagccagcgggaggcccgacatccaaaacattgactagtgtgcccccgtgtggctctggtggaagggtttggaaaatgcagccaggttttcctaaccttacccaccaaggccggaggatgccctaaggacagcctgcagcccctgcagccctctttttgcgtaatctttgatttttcttgttattatttcttaacagttaagcgccttaaggcctcatttaacttgagttaaagaagtgtgattttggaggacccaaagattttccactggtgtagggaatgtctcctcccggctctgagagacttcctccaatccacaacctaccgcaggtatgtgttcttattaaaaggggcagggacaaaagctctgcctgtccctcttgtactttcaggctataatcaatcagcaggcacacctgttcagactgtgacattgaatttccaggatcagaaccagagcctggtacagacacaagccttccagtacttgtattttaagttccatagatgcttggaccttttgtgggctcctgggacagtgatcatgaaagaagagtgctcccaggggatgagcaagatgatcccctttggctgggaagaaaagattccatgtccatctggtttttattactcctctaaaaatgttccctttatagttttataattgtacttaaataaaaataattgcacttaaataaaaaaaaattggggagattatagcagaagctgttggtgtcccggccatagctgtgtcccttggtctgccacagaggtcactcccagaatacacttaggactccctgtgtctccttctgagggtgacctgagccacgatgttatgggatggaggctaacacctggtaggccccacatttttgacaatttggttttaagaaaactcataggtatggccacacgtggtggctcacgcctgtgatcccagcactttgggaggctcaggcgcgcggatcacgaggtcaggagatggagaccatcctggctaatacggtgaagccccgtctccactaaaaatacaaaaaaaaattagccgggcctggtggcgggcacctgtggtcccggctactcgggaggctgaggcaggaaaatggtgtgggcccaggaggtggagcttgtagtgagccgagatcataccactgcactccagcctgggtgacagagtgagactccgtctcaaag

SEQ ID NO: 239266 - DNA, 406 bp, Homo sapiens
gaggaatagtccagattccagtggatttcctagagccagactgagtaagcatccactgctctgggtgtatgtaaactctgaatattgcaaataaacatgcagtaacttctatacccagatgcccacagagctccaggacacacaagggagtgcctcccatgcactgtcctgctgaggatgggtacacacagaggtgcccaatttcagaacaggagagaaatcaggaagtgtccagtccaactcttgccattgttacagatcaggaaactgaggcccagagcaaggaagtgatttgtctagagtcatacttgggataggcttgggagttggaaggcctgaatttcagatgttccagcttggctatgtgacatgaggcagggcactccttgggcctgagtgtcccctt

SEQ ID NO: 239267 - DNA, 2094 bp, Homo sapiens
  misc_feature (915)..(915): n is a, c, g, or t
  misc_feature (1364)..(1364): n is a, c, g, or t
  misc_feature (2081)..(2081): n is a, c, g, or t
  misc_feature (2086)..(2089): n is a, c, g, or t
  misc_feature (2092)..(2094): n is a, c, g, or t
gtttaacattacagatatccttaacatatatatgtgcagagtagatatctgggaagacacacactgaactctttacaaaggttcatgctaaggactgggattgggggccatgtggttaaatagaggataaggagatgatttatgtatcagttatattttttataatcaatctatattatcttaaaactaatttttaaaacaaaacaccttaaaactttcttcataaatactttatgacaattttacttattttggaactagaaattataattagaaagtcatcattactgctttgaactgttgaaagggtagttgatcatatgaagtgggatttttcccccgctgtcatgaaaatgtttgtcaagttcctccagcaaagcccagaacagagttgttgttcagtaatcgttaattatctctttctaccacaaaaccagaagcaatgagaactaatctctatcccagatgaaagtaacttgtagcttgtggaatattataaaatcatcaggttgaactcttcaccttaaactacaaattcacccccattctccactgcttttcatcttatattcattctcaagattttttccttctaagggttcatcttctatgcagtctgagaacacctgcattcatagggcctttttgtaatagcctggtgcttttaaggcatctaaaagatcttatcgttataattctgttgttatcaactttcacgttggtttttttaatctgcgcctggaaagttagatttttagaatttactttattcatttatttatttatttatttagagacagggtctcgctctgttgccaaggctggagtgcagtggaacgatcttggctcactgcaacctccacctcctgggctcaagcgatcctccaccctcagcctcccaagtagctgggactncgggcacacaccaccatgcctggctaattttttgtatttttgtagagacaaggtttcactatgttgcccaggctggcctcaaactccggagctcaagcagtcttcccaccttggcctcccaaagtgccgggattacaggcatgagccactgcacccagactagaatttacattttaaactgtttattctaactcttttgcccttctcttctgccagtgaatatgattgtttcttcatgtaaaaagatgttttattccagttgactacgactgagaagccattgagaaagccaccttccagactgaaaaaactcaagatcaaaaagcaagtgaaggatttcacaatgaaggacatcgaggagaagatggaggctgccgaggagcgcaggaagactaaagaagaagaaataagaaaaaggctacggagtgaccgacttttgccttcagccnatcactcagattcagctgaattagatggggccgaggttgcatttgccaaaggacttcaaagggtgaggtctgctggatttgaaccatctgacctgcagggaggaaaaccattgaagaggaagaagagtaaatgtgatgcaaccttgattgatagaaacgaaagtgatgaaagttttggggtcgtggagtcagacatgtcctacaaccaagcagatgacatagtctactaagccattttttgtgaatttcataagaaagcattcattctccccatttgtgacatttgtagtatgtctcatattctttgactgactgacctcattccactgggatttctgccttgggcttaaggatgattgtgtgggctgcacaggctgaaggttagttgagtaaattaagtagctatgctagcttttaaaaaaagagcgagggggagacttgaccagcatagatatttggcactctcctttgtgtggcttcaaacattatggagatgtctttaattcatttataagtgccttcagtttacattaataagttcgtgccaaatgaaatccttcctgtttactcctgccttgtggcggggtccatcctctgctgctcctttaaaacaaattgcatggatttgtattaagtattttaatggcttatatgttttttatgctgtatgtctatggttttataatttttttctctgtgttgtgaaggaataaagcnatgtnnnnaannn

SEQ ID NO: 239268 - DNA, 362 bp, Homo sapiens
gggggcacatccggcgtgaggggggtgttggaagttgcagcggagctgggaccggagacccgcggcccccgcgcagcgatgggtctgatctgagccccagcctctccccctgcccaagagcagtagaggctggatatatttttcaaaagccaaactgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaa

SEQ ID NO: 239269 - DNA, 181 bp, Homo sapiens
ggctttacatgtgccaggtaagctgacagcagaacatcagtatccacttgttgtggttttaaaatatgttcacatatacagttgaaagcattccttctgagaactggaacaagacaaggatgcccgctttcaccacttctattcaacatagtgctggaagtcctagccagagcaatcagac

SEQ ID NO: 239270 - DNA, 526 bp, Homo sapiens
ctgtagattttgaaagaccatggagaggattttcttgttggcaacaaattcagctgggcagacatacagctgttagaagctattttaatggtggaagaactcaaagcttctgttctttctgacttccctctgctaaaggttcgagtgcagtggcatgatcatggctcactgcagacttgacctcttggcctcaagcgatcctcccacctcatcctccagagtagctgggaccacaggcatttaaaataagaatcagcaacatccctacaattaagaagttcctgcagcctgggagtcagaggaagccacccccgatacccactatgttgaacttgccaggaagatagtgctgctctaatggcagcaggttgcgtgatgacaaacatgatgatccagtcacagcaccagcatgtgctgtctgcagaggataatagaagcaaactgtagatcccaggagcaaagtgtctgaaaagaacaaaaccatgctgccattaacagcaacgctgattaaatgtagtataaaatc

SEQ ID NO: 239271 - DNA, 1018 bp, Homo sapiens
cctctctcctcaaaccattttcttccaaatactttggctttattccaaatcctctctagtcctctgagatttttttataacacaaaacacaacttacagaagttgtgttgttgttttgctgtttatcttgtcacattatttctctaccttgaggcaacaggacaagggcctgctgtccagcgcacggaggcagggaggaaggggtaggggaatactaagaaaaaaaaatttctcgatcacatgtgtaccacatttaactttatcaggtccttgtgaggtgagtatctgtgtgtcattgttctgaaactaacagtgaggggacaaagcattgataggagttcttacaatatatttgggaactcgcaggtgagggcctctcctgcctgattggtctttcaatgtaccatcccaacccacccacctcaatccccatggcttgatcctgctgtctcggtgatcaagctttcagttaagaattgggtgataatgagctagttaatccaatttaaaaaaaaagaattaggatctgggctcagaagccccacagctgtgaaagcctggccgtagattactagtcttctagatgtagaaaagatttttcctttctctggctatttaagtctttatcagtcaccctgcctcagttatcaacacacaccctagagtaaatctgttccctgggggtggaaatagaaggggcatgtcattgtacatccacactgatgaaaggaaaggaaacattaagatggcttaagtggaaaggtcacatacggcttgtactagagagacaccatgctaaagcaaaacatcgtttaaaaaaattctgacttatcatgtgctcagaaatgctcaaatgggtacaaccatcaccaagggtgggatgggagggcaggggaaaaaaatatgaagcatcaaaaaaaattctgatttgtatttgtgaaattcaatagtaaccctattcattaactggattttaaaatcatttcaaagcacattcggctttcaaaagatgtttgtt

SEQ ID NO: 239272 - DNA, 205 bp, Homo sapiens
agacagggtcttgctctgtctcccaggctggagtgcagtggcgcattcatagctcaagtgatcctcccgcctcagcctcccaggtagccaggactacaggtctgcaccaccacacccggccattggtctaatttctaagcaaggccagtgtcttccaatgagctcagggtgggaaaccccacgggggttgggctgtgaactgtac

SEQ ID NO: 239273 - DNA, 492 bp, Homo sapiens
aaaattgtcaatgtggatgattctttaaaccataatttgggccaaaagctgagcatcacaccaagaaaatatctctgcttctagacatcaagaaagagaggtggagataaaggaaaaaacttaatcccgaattgataggagtgagagacaacaaaccttaggacagggaattcttaacttgtggcagagcaaacagtagaaactcatgagacgtgttatccaataatagaaaataggaacatgagatttattccactagacagtactaggactctacatgtaaactcatgggaattgaaataaagttctctgctgtaattggagcaagatagactgaggagagagtaaaccacgaatgctggctcaagacaaaaaacctagcagaggtgcattgcagacatacccatgaaggaaaaacttacacaaggtcaccctaaaggaaggacattgttaagccctttgaaataatggggtggagaggaaaatgaactg

SEQ ID NO: 239274 - DNA, 326 bp, Homo sapiens
ccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgca

SEQ ID NO: 239275 - DNA, 350 bp, Homo sapiens
gagtgggagatttgggagaatgttttagaattctacttaccacgcctcttttcaatttagttctgatttggttcacctgaatctacagaggtttttttagttttattgtgctactagaatgtaacatgtttcactgtaagaaaactccaactaaacctagaagcatatttaaataggttaaaagtctgtaatctcaccttttagaaaaacaaaccctgagggtttctgctgtgatgtgaaggcagggtgcttttgtcccagttgttttgttgttgttgttgttgttcttgttttctgctgagcctggtagctgatgaaatctaaaatataaactcttttctactgcacaa

SEQ ID NO: 239276 - DNA, 329 bp, Homo sapiens
tatgaaatgcacagaagagaaggttggagaaatagcaaggccaaggtggcccaccactttagattaaccattcctgcccaggaccttccacaagttggtctttcctcacttcccttccctaccagtgaccttactaggaccttacaaaagttgaccactttcaagggaggagcaatgctgtacttgcttcctctgcccattctcatgaattaaagaagtgatccttggagaatttgttagattgttttcactgatgtctgaattaatggctgttctgtatccatgttctttcccctgtaattttgtattaaaattcccacccactctga

SEQ ID NO: 239277 - DNA, 281 bp, Homo sapiens
agcataacgttaaatgacaatatgagctatcacaggatattatttgatgaagggctaaattcaggctacaaataataggtagtaaaaatgtagacaaagcatagaaacagtagtacacatggtacagtagtaacctggcaggaagggcaggctgtgggggaataatgagggagagaggtttggaaggtagagtgggatatatagagtattatattgaatgtgaagctaaattagagattgtggactttattctgtaagtcaaaaggaacgtgaacgtcagt

SEQ ID NO: 239278 - DNA, 1913 bp, Homo sapiens
  misc_feature (1110)..(1110): n is a, c, g, or t
aaatgcattagtttttttattttacaaggcctcctgtgcatggataacttttaaatttatttataagatttcttggtcataattaagaatatcaattctgtatttttgtagaattatgcgataatgtttctgatttagaaagctgaaatacaacttgtttttataattctgagggcattttatgattcataacaagtgcaaatgacattttctagttaatgttaagaaaaaaaaagcactgaaaattaattttgtcagcagtgttgagttttggaaatgcaaactaagtcaacttacttcctttccctagaagtgctgccactgttgtgacattgtgtttcattttgtaacccatctactacttaggccagatatgcattttctggatgcaatctgttggtttccaatggtttactacatggtgggctctattgacaagtaggtgacaaaatctttggcacactaactagtgtagtgtcctgtggtttgtcatgtgctgtgccttgttactgcatgatgagtgtaatttgccgtgtcagtattgcaaatatgatatattttgcatgtagagcttatgttctcgtgttatacatcttgtattaaactttctgagtagtaatctattgttgaattaaaacaaatcttgctgcatgtcaattttgtcagttttgctcagtttctaatgctgttttagttttgtgtcatctataacaacattattactattgacatagtggtagagaaaactaaagttgcaatattgtgatgcattgatagcgttacgataacttctggaaactttgaaataatttagaaatgctcattttaacttagatttataaattggagcaattcctttagagtttcccttggtcacatgtcagagtttataatttctaaaatatttgttaatgaaaaggtcatatgtgtttaatacattagtaattaaatacaaattcttatacatgtattatggtgacattaaaaatatatataaaaataaaagatcaaaacgctaatatacttgaaataatatatgttacttttccacttctaaaaaatgtcagccagagccttcaaaataaaatgctaaaatttaccaattgaganctttaacacttacattttatcctgtagatgttgaagaaaacacagttttacaactttgaaagtatttagtgctgtggatacattaaaggtcaaacagtctaaaatatgattagcctccattctatgttaatataatttacctcatcagttatgataatactaaccaagtaaataaactgtagttagatgtactaaaattactatttaaattctacacatgttttataaccaatcatcttttttgaaatcttttgaggtaatagtgttctgttaaaatttattagaaaaacagtatatctaaaagctaaagaataaacgtcccatataccttttctgatgcaaactatgaagtggattcttcctctgtacaagtatttatggtgagagaataaataattgaaaggatcaaattcctagggacagaaataaaacagaattggctacgaattgataattgttggtctggggacagttatgttcatctaacaattctcctcttttgcttgtatttgaaatctttctttaaaaatacctctttgaatgaattaaaacacattcatgaacacttctttacacttacgtacttcacattctagtccttgcaaaaaggggtcttagagagggatagaaagggaggctttgccaattatccctataacttgttttccatctagattgactttcttgtgctcccatctgctggccacactgtgtaaagcagccatgctgagggaaaaataaggcaatggccttgcagaaattatgatggagaggagttataagaataagttggcagcctactt

SEQ ID NO: 239279 - DNA, 1855 bp, Homo sapiens
  misc_feature (1052)..(1052): n is a, c, g, or t
aaatgcattagtttttttattttacaaggcctcctgtgcatggataacttttaaatttatttataagatttcttggtcataattaagaatatcaattctgtatttttgtagaattatgcgataatgtttctgatttagaaagctgaaatacaacttgtttttataattctgagggcattttatgattcataacaagtgcaaatgacattttctagttaatgttaagtaagtcaacttacttcctttccctagaagtgctgccactgttgtgacattgtgtttcattttgtaacccatctactacttaggccagatatgcattttctggatgcaatctgttggtttccaatggtttactacatggtgggctctattgacaagtaggtgacaaaatctttggcacactaactagtgtagtgtcctgtggtttgtcatgtgctgtgccttgttactgcatgatgagtgtaatttgccgtgtcagtattgcaaatatgatatattttgcatgtagagcttatgttctcgtgttatacatcttgtattaaactttctgagtagtaatctattgttgaattaaaacaaatcttgctgcatgtcaattttgtcagttttgctcagtttctaatgctgttttagttttgtgtcatctataacaacattattactattgacatagtggtagagaaaactaaagttgcaatattgtgatgcattgatagcgttacgataacttctggaaactttgaaataatttagaaatgctcattttaacttagatttataaattggagcaattcctttagagtttcccttggtcacatgtcagagtttataatttctaaaatatttgttaatgaaaaggtcatatgtgtttaatacattagtaattaaatacaaattcttatacatgtattatggtgacattaaaaatatatataaaaataaaagatcaaaacgctaatatacttgaaataatatatgttacttttccacttctaaaaaatgtcagccagagccttcaaaataaaatgctaaaatttaccaattgaganctttaacacttacattttatcctgtagatgttgaagaaaacacagttttacaactttgaaagtatttagtgctgtggatacattaaaggtcaaacagtctaaaatatgattagcctccattctatgttaatataatttacctcatcagttatgataatactaaccaagtaaataaactgtagttagatgtactaaaattactatttaaattctacacatgttttataaccaatcatcttttttgaaatcttttgaggtaatagtgttctgttaaaatttattagaaaaacagtatatctaaaagctaaagaataaacgtcccatataccttttctgatgcaaactatgaagtggattcttcctctgtacaagtatttatggtgagagaataaataattgaaaggatcaaattcctagggacagaaataaaacagaattggctacgaattgataattgttggtctggggacagttatgttcatctaacaattctcctcttttgcttgtatttgaaatctttctttaaaaatacctctttgaatgaattaaaacacattcatgaacacttctttacacttacgtacttcacattctagtccttgcaaaaaggggtcttagagagggatagaaagggaggctttgccaattatccctataacttgttttccatctagattgactttcttgtgctcccatctgctggccacactgtgtaaagcagccatgctgagggaaaaataaggcaatggccttgcagaaattatgatggagaggagttataagaataagttggcagcctactt

SEQ ID NO: 239280 - DNA, 500 bp, Homo sapiens
tcttgatatagagacctatgaattaaaagagcaagcatctttttatcacataccaaacatacaacaaatgatggaatagagacaataataaccacaaaaaaatactcttattcacaaaggggagaaatggaagcagatcacagccactggtccataacaattaggaaaactcattggacaatggttgtcaggttcctccattggagggaattgtgtttcatgattaggcactgtttctgctccttaaaaatgactttccagtctatcctccacagctctttgttctacactctagggaatcattctttttccctcatcttccttagtcacttgcaaaggacattagagaatatgccctttttggtggataaatgggttcttcaacctgctttctgcctgtagaaaattagaggccaataatctgtttatatcttgtagaatgtctattttagctggtaccggtacttttgtcaataaagttcttttttaaacttaatgga

SEQ ID NO: 239281 - DNA, 430 bp, Homo sapiens
cagatggtgggagaggtccacatttagtaaggaagcttatgaactcatttctctccaacattttattatgaaaaaaatgcaaaccaggaaagtcatttttggatttgttaaattagggagtactttggcgtcatccaagaaaagatgtcaagttagctactgtatagttgagtctggagcgtggcaaagatgtgtgggctgcaaatacacctttctgagttgcctgtggcttccgaacttgctctcaaattacttcctcaagaaagcttctctatcctgcccctgcaaactagctgtgtgccccatgcttctacgtagtagcatcgtttctcacaattataaacttgtgtttagttatgtaatgtctgtcttcctaagtataatttaatctctctaaaagcagggacttcaccttgttcagagcagtatc

SEQ ID NO: 239282 - DNA, 489 bp, Homo sapiens
gggctttctgctgcaccaacctgtcactgcacatcagcacgtgttgtaagcaacggctcccgcctgagaagccggaagtggaggaagaaaattatgtggacatttgttctccacttttgaaaacatggaatgtgcttgtgtgtgtatgaatatgcaaattatcttattcaactataaagaataaaattatcaacgtggtctggcttcatccctgcagtattcacagcttcacgtgctctcgagcacagcacctattcatttatggctcacctgctgtataccagacgccggctggtgctggcagagggtcagagacccaccctgacctcatgggacaagaggaggacatgggcagacaaactggcattgcccagaagtgtggctgtggcagccgagcttaagggcagaacaggtacccctccggcctgctgaccccacagctcacagtgatgatgaaggcaggaggggctgcctgtaggggcggccgca

SEQ ID NO: 239283 - DNA, 387 bp, Homo sapiens
tggaatttgaatcacattatctcaccaattttaggtcttttttcctatattaaacaatcaattcttaccactaaacataggtaagaccaactttgaggaaaatagttataattgactataatttgggaccgaccataacatttccttttttttttcctttatgaatgtagaatttcaaacacaaggtagaatcaggttaatttcgacactatgttcaaactcattacttttgacccagtgaagggtttaagagttaagaatctagtagtttagttttcactcactttccttacctattattcatcaagttaaacatttcaattgaactctagcatgccagaatactgggatatactcctatccatccttgcccttcattgtcttttt

SEQ ID NO: 239284 - DNA, 484 bp, Homo sapiens
tctatcgccatttcttacaggttccatttccaaaatataacatgagtccatctatttctgtttctacagtcatcaccctaggctaagccactacttcagtagcctctccattaggcttagttcactccagccctcctccagtgtgattcacacagtcctgcaggtagtcattagaaacataacttaggccctgtcattgctctgcttaaaatttgtggtggcttcccatcatgcttagaataaaatctgctttttttttttaagcatggctttggtgctttacacaatttagtctccatatcctctttctagcctgatctgaaggcaccatccaagtatatgtgacaaaacagcagtgaacatgggggttatgaacactacagaggaaacacaacttgcccaatagtagcaataggcaggtagacaggagggcttgcaaggaggacactggaatagaattttgaaagtagagtggaaatttccc

SEQ ID NO: 239285 - DNA, 364 bp, Homo sapiens
attcctggcctcaagtgatccacctgccccaaccttccaaagtgctgagattacaggtgtgagccactgtgcctggccagtatctgccattttttattgtacttctaacatctttttcttatcgattcgtaattgttgattatggatttatataggggaaaactagtcccatgtcaattatatgcctcacaaataactttataagtttgttattagacttttatttgtttatgcttttttatttagtttctttttaatttctattttgaatatattgatctcttcctttatgagtttcctttgtgaatttcttgctacaaattggaagacccctcacgctccaagatattttatacaatttaat

SEQ ID NO: 239286 - DNA, 309 bp, Homo sapiens
ccaacaacaaaatgctagcacaatgtaacgtccttcactccctgcttgacttctaaccataaagaacgtcattttttacaagagcgttcacaggactcagcagttttccccaaggcctcttgtgaatctttggtattcttcctccaccacacctgccatgttatttatttgtccattttgtctttttctgttaactagtctaaatttgccaaatatgcatctgatggatttaaagcaattctctccgatgttggtttcatccactttggctatcctatatccttagcaacatttgcagttttactttgc

SEQ ID NO: 239287 - DNA, 599 bp, Homo sapiens
atcccaggccgaagaggcttaagttgccacacagcaaagagaaacatagcagtactttacaaagaaatacatgcacacagacaaaaagacaagagggtcctaaacttccccccatgtgagatatctagagctacagttccattcagtgaattctacttacaagtgaacatgttcatgcaaattggttctcagcatgtttcttttcccatgcacagcagagaacctttaaaatgttgcatgcttgtccccagactgtggttaaagaggtgtttctttacctagtgacagcaacaaaacctagaatgctcccaagtttacttttctcctacctcaaaacaatgcccatccactctaccctaaattttgatgggtttttagctacaaagaaggagcatggtagagtttatcaaagggtagaaggaagatcatgatggtacattttggtgatatatttcttataattaattggtacttacgcaatttggtattcgtgtttggtatttaagacgaaaaattctaggtcttcaaattgaatgaacatttgctattttatatttaacagagcagacatctgtatttctctagctttatatctactt

SEQ ID NO: 239288 - DNA, 425 bp, Homo sapiens
tggcaccaccccagaggggcagggagtgttgcttggttactactgtcaggaggaggtgaagtccaggcccccaggtagtctctccattgtcacaatgaggggagtactcgttgcaggcctgtgggagatcaaagtcctccaggcacggtggctcacgcctgtaatcccagcactttgggaggccgaggcgggcaaatcccctgaggtcaggagtttgagaccagcctggtccccatgatgaaacccagtctctccaaaaaaaaaaaaaaaaaaaaaaaaaagaattagctggacatgatggtgggcgcctgtagtcccagctatttgggaggctgaggtgggagaatcacttgaacttgggaggcagaggttgcagtgagctgagatcgtgcccccagctgggcgacagagtaagactccatctc

SEQ ID NO: 239289 - DNA, 533 bp, Homo sapiens
aaaggcaaaggaattggaacactgaatgatattggaaaaaaaaatgaagttggaggaatcacaccactcgtgcccggcccttttatgtgctttttaaaagtacgttatgtatttcagtttttcacacacacgcacacacacacacacacactcacacacagacacacacacacgttcttctctaggttttttctgtaaattttacatctctaggtgggggtagtaggggaagagaagcaggttttttttacagctgatgtgatcactgtacagacaagcttggaaaatgctacccaatctgccaattaattaaagcgttaatctgaggagcagccgggcccagggaatgtttacccagggaggagtgggggtggtaggaactgagtaggcagctccctatatttgcatgaaaatgaaggtgcttaggaaaccctgcttccttttgtctctaaaggtggggcagcctagatcacatccctaaacacttttggtctctttaggaagccttttagggagctggtctctgaaagatg

SEQ ID NO: 239290 - DNA, 576 bp, Homo sapiens
gggagcatgctgtctgagagaatgttctgctagcttccagatgcacaggtttataaaaataccaccctgccatttaaaacatgtttaaaatgttgatagaaaacaatgaatcgtatccttagaaagacagaccctagtgaaagaaacactaactcacacaggtagggtctagcttccataacatttaagtttattctatggaattgttcattggtgctcctgttttagttacttctccatagacttgtttttcccttgactaatcaatgccatctggtgccaggtggtatcctgggtgtagcacagtgacagggtggagactgccctggccgtggcatgtgcagggggcgttcttgagcctgtcttctgggagccctttcttttcctttttccctcctttaggttgaagacttcatcattccctgcgggcagtttctctgtttttcctattttcttttcctcaagaaaaatgtaatttttaagtaacagaattgttttctgtgttgcagcatttaagttgctgagttgagaaatcatggctgagtttgccaagtaaagtttttaaagcaaaaaaaa

SEQ ID NO: 239291 - DNA, 624 bp, Homo sapiens
aatgaaagtatctgaagcaaagtcaacaaaataccaagacttgttagagtcgggtggtgagaacttgggtattacttatattattctccaaagttttttgtatgtttaagcttttcataattttttgttgggcatagtggctcacacctgtaatctcagcactttgggaggctgacgcaggaggaccacttaagaccaagagtttgagaccagcttgggcaacatagcaagatcccatctctatttttaaaataaacattaataaaataaaaattttaaaattttgtaagttttaaaaatgagaaaaataaaaaccgttaacgaaatagatattcatgtccatagctggtaactttgggtaagccagttaacttttccagaatattagtttatttttttctaaaataacaacattaatttcaaattcggagggtgatagctgttgtgttttctaactctacgaaggctttcctgctatatattcaacattgttgttattgaatgactcctgactgaggtttgtgggcttaattattggctagtggagccccagatgggtcctatgtcatgagattcagaatttggaatgtctatggtgctcaccaaaatataatcccaccttca

SEQ ID NO: 239292 - DNA, 498 bp, Homo sapiens
agtggatcatattcctgacttcccaggatggggagctggtgcagccctctctttaccaccctggaaacctcagtgcatcccaccacaaactccctccatgagcttcattagggcaggtgcttccacacatcatctcaatatccaaagggaaactggctctggcaccacctactggagaccaaacttcaccaaaacaaaacaaaaagtggctgacagaaggacacagtgctagggaggacatcagctacctgagatccctgtattcctggcctcctagaagagagtgaattggctcatatgcccaatgtatagctacaacaagcagaatttgagaaagccaccacacaaaagctatctataaccaatgaattcatacagagcctcggttgtctaaaagcacccagaagccaaatgatcatacaaaatatgtactacagtcacaccttcaagggaggaaaaaataaatataaagtcccttgcaaacaatagcaatttcaa

SEQ ID NO: 239293 - DNA, 538 bp, Homo sapiens
ggcattgtggagttgctggacagcttccctacttttcacgttcctatgacacaatgttatcatcgtccttgttgtatcagccagggaagctaaagaatgatgcgctccaccacaatgagggactaaacaacaaaaaggaggcatgagattcaggaagcaaaaaaggaattcatcatatgaaggaatgaagatgttcaaaagaaaaccttcaacctcatgccagaagatgttcccagctgtataaatgcctaactcagcttctagtccttggaaattaagcagctcattgaaaattcaagagttccagccagaagctacagctaggctcagatgttgaaatcagtctctcctgctgatcaaactgtgacatagccaaagcaataggcctggcttttcagttaattctcagcgagcccttcctttccctctgtagtggttggtgtggcatttataatataactcctttatgtacactgtaaaccattccttctcagggcagatggaagtatgaaatctatctatttcagtctataaaatt

SEQ ID NO: 239294 - DNA, 776 bp, Homo sapiens
gtgcagggaagcactccacaccctcacccaggtcctgtatccctgcaagactgcgttggaaagactgaagaggctggagtgcagtggcgcaatcttggctcacaggaacctccgcctcccaggttcaagagattctcatgcctcagcctcgcgagtagctggaattacaggaagctaaagaatgatgcgctccaccacaatgagggactaaacaacaaaaaggaggcatgagattcaggaagcaaaaaaggaattcatcatatgaaggaatgaagatgttcaaaagaaaaccttcaacctcatgccagaagatgttcccagctgtataaatgcctaactcagcttctagtccttggaaattaagcagctcattgaaaattcaagagttccagccagaagctacagctaggctcagatgttgaaatcagtctctcctgctgatcaaactgtgacatagccaaagcaataggcctggcttttcagttaattctcaggtacttcaggatcctgcaataccatctttgtgaacatcaggaatattacgttggtacatacagaaagaagtcttgagtaataccagatatttttggttaataagatgcacccaaatgtttcagaatcatgaggaaactgatgcaactaatgtagaaacatcgactctggagaccagctggagagaatgagaagatatttttttcattccctgggaagtctcatttacatagcttgagttaaattttgctatcaaattttctttaactaaaattttcttttct

SEQ ID NO: 239295 - DNA, 472 bp, Homo sapiens
agactctagaatccagtggatttgaattatacagattttgctagcattttactgctattcaaggtagaactcataatgtccggcataacttcttcaagaataaagaatgacacaatcaaatatgttattactttaatgaaaccataagtaaacattgtcacaaacacctggattctcagagggaagcttgttagaacaataaatgtgtccactttcatccaggtgtattactattctattttaggtcaaatctttttctgttattactgaagtaaataatacatttcttcatgtttctgtccaaattctgtttatttatctccaacagatataacttctctaaaatagaaattttcctcacatatttccttgccaaacgttcacttctgcatgtcaaggaagaaaacaagatttttgtgttgttatggcaaatgaatcagtagctttctgtttattacagtggatataatag

SEQ ID NO: 239296 - DNA, 393 bp, Homo sapiens
ttgagatggagtcttgctcttgttgcccagactggagtgcaatagcatgatcttggctcactgcaacctccagctcccaggttcaagcaattctcctgcctcagcctcctgagtagctaggattacaggcatgcaccaccacacccggccactttttgtatttttagtagagacagggtttcaccatattgggcaggctggtcttgaactcctgacctcaggtgatccacctgtctcggcctcccaaagtgctgggattacaggcgtgagccaccctgctgggcctctctttcatattaatgatcacatctaagcaaggtttaacatgttacatggtgttaaacgtgccatgttgcccaggctggtctcaaacccctaggctcaggtgctctt

SEQ ID NO: 239297 - DNA, 493 bp, Homo sapiens
tccactttttaaaaagagttagttatatgtagcatagtaaaaatatttcttttgaaatatactattatatccatttatttaagttctaatagactatactgcctaaaaaaatagagttgatcttagtcaaatcacttaaatcaggaacctttaagattcagtttaatcagttttgtatataaagtattagacttactttcaccatttttgcccaaaaacaaacttctgtacttcattaaataacatcaacaaaagtaaaaagctaacatcaacctaggaaaaccattttcaccgtaacagttatgtatattaactatattatatacttttaaattagtaaaaaaaagggtaaaagacatgaacaattatcaaaggaaaaaaatcctgaaatattcaaatgtttaccttactaaaggaattcttaatctgctgattatgtttcttaattgtaccatgaattacaaaaacctattggcaagatcagtcttattta

SEQ ID NO: 239298 - DNA, 578 bp, Homo sapiens
gtttttacaactagagaagggtagtggccagggacaccagcttgtttttgttttgtttcacgtgaaaactacaggactctctccttctattgctccatttggagttgtcaagttgagctatcaaaaattgagaatatatatgtctatgttatatccataaaggttgttgtcctttttttctttgaaattgccaaatgatgtggatttagggggagatgaataatgagcagtgggagtcccagtaactgtgaggcttttgggtgggctcagagattgatgaagcataaaagggcagaagcgtgtgggtaaagccagctaaatgccccgtccaaagtgccagtggtttgtgtagatgggctccatgcaaataaatagaattaattaattgatgattttttaaaaaaataagacagcccaacttgcagtgactttttgttttaagtgaaagcaagtttattaagaaagtaaaggaataaaagaagggctattccttaggcagagtgcccaaaactggatttctcctaattctccaatagaaaagaatttcagacacaacaatgatacttaagtgaaaacaa

SEQ ID NO: 239299 - DNA, 376 bp, Homo sapiens
ccaggctggtctcgaactcctgacctcaggtgatccacccaccttggcctcccaaagtgctgggactacaggcgtgagccaccacgcccagactccaggtataattattaaagcacctcccttgcatccacaaaagtgtcctggtgtttgtgataagtcacatggttgtcctaaatataacaaaaaaagagtaccagtgaagattttatttcctcagagaaaaaacttgtcctaaaaaacatgttttactgtagaagttaccccttcattcacatacagtcggccgcttgtatctgtgggttctgcatctggggattcaaccaacctcaggtggaaaatatttcgaaggaaaacaacaataaataatacaaaatgt

SEQ ID NO: 239300 - DNA, 386 bp, Homo sapiens
tgtcacaaaatataaacaaggctaattcaatattttggtctctggcctcagctgagaaataaagattggcctgctagtttcagctgcttccactgagccactgcatgaggatgagggataatttctttcctcccctaggtccaacagcaaggaaggctcttccagacaggaggcatgctggggttagaggtcacagaggaggaatgagtatctggtccaaatagtgagggatcggtccatgaaagtggttaaacttctgcttctccttcaagttgttacttacattgtcactggtttaaatgattcatttgccaactccttcgaagtaaacgttatcattaagaataagaaaataaaaagacactgtctttaggacaatttaggac

SEQ ID NO: 239301 - DNA, 469 bp, Homo sapiens
gggtgtggagaaataggaacacttttacactgttggtgggactgtaaactagttcaaccattgtggaagttggtgtggcgattcctgagggatctagaactagaaataccatttgacccagccatcccattactgggtatatacccaaaggattataaatcatgtctattggcaaagtttttaagcttaaatgtattgtttatacaagatgcttctttactttttgatacatgtggtagtgttgtttcgttggctagcagtttctttttagttgttgtaactgtcaaatttggttcagtcaagggctttcaaaagtgtttacctgtgatctccacatataagcaaatcaaaggtaacattctcttagaagtctctcagttctcagtgttgagacatttgccatgtttgtgtcatatatacacagtagtgccctatagtggtgactccatttgaatgacagtgcaaaata

SEQ ID NO: 239302 - DNA, 120 bp, Homo sapiens
ggtttatagccttaagaaggttttcagtgaggctcaagaaccataaaataatatgctttgttttatgagcttctttggaagtaaatcttgcattcttctatgtcacctcctagagaagcc

SEQ ID NO: 239303 - DNA, 397 bp, Homo sapiens
ccttctgtgggtagcaagaaaacagtcctctgagaagactgtcaccccagacctctcagtggccctccttgggccctggagagtgtcccagacagagcagagataatgagaataactgatgaagacagggactcattgtgcctctgtcaatgtgcagttagtggaggaacccgggagaggacactttcatcaacagagggagttattcctgagctttgttgtcttaacatctgtaattgggcttccttctttctttttgcaattagacgttctgtttgaagacttaaactcaacacaatgaatattgtataacccgctcattaactagacccctgtggccactaagcttcctctgttgtggtaaggaagccatagaaataaaaatactgtccctcct

SEQ ID NO: 239304 - DNA, 374 bp, Homo sapiens
aagactttaagaaactttcaaagctgtatgtacagcctgggatttgagagacattgatcaaaaagctagaaactataaaccaacattggccacataaaaaattgtgtagcaaaagataccagaagccatttgtcaatagtcatgtgatagagtttaggaaaaggaaattttgcaaacagcattcattttagatttagtgttcatattcatattatacaaagagatcctataatttgacagtaaaacccaattgaaatttgggcaaaagatgtgtaaaggcagttcatagaaaaagcaaatgcaaaatagttcttagtcattaaaagatggtccctttaatttactaggaatctgggaattgcagattaaagaaa

SEQ ID NO: 239305 - DNA, 810 bp, Homo sapiens
aagaaagaaagaaaggaggaagagagaaaaggagcgtggaaagaaaagaaaatttcaggagcttctacattggttatgccagcagaaacagttaagccatggaaactgagtcacatacacgctgtttttcttctctggtgcatgacctttgcttctgacctttgtgttgagatgttatgaattaaccacccttcctattcttcattcaaacctcaactaaatgacattggagatagagacccttacctctttacgatggatgttaagtaactcccatagagtatagtcaatggtggccagccaacttgtgtgtgtgtgttttatatcttatatttaaaaaatgaaaaaaatgttgtaattctggccagatacgtggctcacaactgcaatcccagcactttgggaggccaaggtaggcggatcacttgaggccagaagttcgagaccagcctggccaacagggtaaaactctgtgtctactaaaaatacaaaaaattagccaggcgggcatggtggcgcacgcctgttatcccagctgctcggatgactgaggcttgagaatcccttgaacctgggaggtggagtttgcagtgagccaagatcatgccactgccctccagcctgagcaacaaagcaagactttgtctccgaaaaaaaaagagcatgttgtaattctgttcagcacccctgttttttgcttatatgaatgatcttcacctttccccgcactgaggagtgatgatcaccattctttggtgtctgctaccctaacacttggcgcttgaataaactcttttaagtggagcctga

SEQ ID NO: 239306 - DNA, 359 bp, Homo sapiens
tagagagcgtgcctctttatgttgcccaggctggtctcgaactcctgagctcaagtgatcctcccaaaatgttgggattacgggcatgagccactgtgcctagcctaaatattattttaacccctttttcttctaagtttctgaggctcgtttttttcttttggttgatttcaagaggaattccagggcttagacttacaattcctaggtgtgttaaaatatgattgtttagaaaaccacttctggctgggcacagtgactcatgcctgtaaccccagcattttgggaggccaaggcaggtggatctcctgagctcaggagctccagaccagcctgggcaacatggcgaaaccctgtct

SEQ ID NO: 239307 - DNA, 195 bp, Homo sapiens
gccctgtggatgggattagtgtctttataaaagagacctaagagagacctctcaccccttcctccatgcatggacacaggaagaagatggctctctacaggaagagggacctcaccagacaccgaatctgccagcaccttgatcttggacttccagcctccagaactgtcagaaataaatttcttttgtttgtaa

SEQ ID NO: 239308 - DNA, 534 bp, Homo sapiens
atttgaataaacttacattaggagcaccaagaaaaacacacaaaataatctagtttttttttggtcagactatgagaattgacaatgcttggtcaagttcaaggacttccacactcatcagttccattgatccaggaatgctctttctcttctcagtcctttccagcaaaccaattttgtggaaagaccaactaatagttacaaatggaaacttattattaaaaaaaaattacagtataggaacaggtcttcccaatcaaaaataaagtagaacatgagtcagagataaagtcatttcaaatgcatgtagaaaactgaaagtccttgttttttttttttattcacaggatttttttctttcctttttaggttgtggtctagaaagcatattgtgatttgtacaagaagcacattcccattttacaaaagtacaaaagcacattttggacttttaacaaattcaactgttttgtgttctgtgtgagtaaattttaggttgcccatcattgaaaaccagtttaaaaaaaaataatg

SEQ ID NO: 239309 - DNA, 540 bp, Homo sapiens
cagtgtgtggagtagaagacagaacaacgtataccttcagaatgcacagagccaatgcatttttggattacaaataaatcaatttaagacctattgcttctgacaatgatttgcaaattgagaaaattctggaaaaatagacatccaacaaattaacagtgattatacctaatgacagggttacaggtggggatttgtttatttgtatgttcttatttgtttcttgtttcttatgtcagcaaattttaaatagaatatgcaaaatgatgacctcaataataaaaaatattgtgtttattcacaagagttaaataatgtttatagaaaggaaaagatgcgaatgtttttggacagattaggatttaaacaaaaatgttaaacacagaatacaaaatatgttttttctcctgttgtctagcttttgtacagtgaacacatgttgcttttatagtaagaaatatacattttaagtttcaaaattactcagattttgtaaacaatctaaaagaaaataaatgtgtttggaaaatccatttccga

SEQ ID NO: 239310 - DNA, 316 bp, Homo sapiens
aaaacgctttgatggggtcaaggatgacagacttcaaggattagactctccaaaggagaaataaaggattgtgaatagaactaggcaggaatcatgctggggtccagggtgaggtgtgttataggaaaagccccttttgtctctgagttcagagggggcttgttcagaagggacaagaggggcccttgagacctgtgtgaaatgctgccaaactccatgggaagaagaccagaggaaggtttatgtctgaagcccaaggttaatgaagagtgcgtttatgctgactattccctgccctcagaggacagcaccagca

SEQ ID NO: 239311 - DNA, 450 bp, Homo sapiens
ctcccaagtagctgggactacaggcacctgccaccactcccggctaatttttctgtatttttagtagagacggggtttcaccgtgttagccaagatggtcttgatctcctgaccttgtgatccacccgcctcggcctcccaaagtggtgggattacaggcgtgagccacggcacccggcagcacttgctttttctaataacaaagtgccgtgactgctctgccatctgccaagagctgtggaaccaagggtctgggctggaggctagaaggccatggttctggggaccccacttgcaccctcttactgattttatggagtggacccgagagcaccagctctgtctaaagggggcagctactggttttgccttgtatgaagaagagtccccttttgcccaatattctgatttttttttctaggagaatttaaaaattttaatactatgtga

SEQ ID NO: 239312 - DNA, 775 bp, Homo sapiens
gatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctg

SEQ ID NO: 239313 - DNA, 506 bp, Homo sapiens
acattaaattctctttatgtgcttattattaggataaacatttttgttttctactcttttcattgtatatgtacccattgcatatgtagtggaatattacagagacattttgggaaggaaggtcaccccaccagattattttgaagaataataaccccccagaaatgctgttttgaagaataatgacaaaaatgcaaacattatatgtttgaaaagctatatttaaaataaaggcagtagccaatatcttttgagtatattaacatttaccataattcatgcaatgtgctaataattttatatgttatgttatgctttctattgccttctttaaaaagttccatattatctccagcttgcatttgtaacagtggtttcacactccttgggaataatttaatctggacacatataacaacaggtggggtgccctttcttttcagaatgcatgaaggtcgggaactacttgtgagaattgatcctgacataagaggccaggctcaaag

SEQ ID NO: 239314 - DNA, 389 bp, Homo sapiens
  misc_feature (10)..(11): n is a, c, g, or t
gagagagagnnagagagagagagagagagagagagagagagagagagagagagagagagagagagagagagagagagagagagagttcttaatgtggctactggaaaattttaaattacatctgtggatcgcattgcatttcagttggacagcaagcactgcctcatagagattattcagataatgtatgaacttaattatttcatatatgattaacaagcagaccataggccagtgtctgactttcactgggaggtcttggcacccttcctcaccttgatggtaaggccccaggacaaggtggagaggtaatcaagggcatcttagttaggatcagttggcaatgatgaaccggtcattctacactattcagtgatgtgcgggtttac

SEQ ID NO: 239315 - DNA, 426 bp, Homo sapiens
catttcaggaaatttgaaaaaagtacaaaaaaccaccaaaaaaaattacttccattcccaacacccaaattaactgctgttaacattctggcaatttgattccatcattttcctgcatattaccccccttcaatttaatgagtaggctgggcgcggtggctcatgcctataatcccagcactttgggaggctgaggcaggcggatcgcctgaggtcaagagttcaagaccagcatggccgacgtggcaaaaccctgtctctactaaaaatacaaaaattagctgtgcgtggtggcacgcgcctgtaatcccaactactcaggaggctgagacaggagaatcacttgaaccgaggaggcagaggttgcagtaagctgagatcgtgccactgcactccagcctgggtaacagagcaagattccgtctc

SEQ ID NO: 239316 - DNA, 343 bp, Homo sapiens
ccttattttttccttcatctgctccatcgtcttccctacaatatagtcaccataacaaatttgagtagaattttgttttgtgtaaagaatatggtagccatagaagagaacattgacttgaaagaataatatttataaggaaggagttgcaaggaacatctaggaaacataaaagtaaatgatcaaagaagttaatgggttgggtggtaaagtgttatggaagctcagcaactcgggaggctgaggcaggagaatcgcttgagcccgggaggcagaggttgcagtgagctgagattgtgccattgcactgcagcctgggcaacaagagtgaaactctgtctca

SEQ ID NO: 239317 - DNA, 354 bp, Homo sapiens
aatttaagggtgccctgaacattaggatatattagttggtagtagtgatgtgagaccagattgataggcttacattcttaaatagggtggcctgaatttatcagtccaatgaaagtgcatgtctgtgaggcaacaaagattattatgtttgagaattttttttggcaataaaatagtgcagaactaaccaaatacatttattgaccatatgatagaaattgcagtgagtttaggtagaaggtttttagttgcaatgtgaactgtactggttttttgcttctgagcatgttgagtgaagtgattttgagccagtcattcttacccctgtctgaattgtttaaaggagatcaagag

SEQ ID NO: 239318 - DNA, 303 bp, Homo sapiens
agtgctttggtcattttttgttgttgttttgttttttgttttgttttgttttgtttttagacagtcttgctctatcccacaggctggagattgcaccactgcactccagcctgggcgacagagcgagaccctgtctctaaaagaagaaaaagaccacctgggcatgggtctggaacccaccctagtggatcccagattccccacagagtctgtctaccccccttggtggcagttcttgagccaaacgagttactgctagaaattgaagggtttcctttgtgataaagtttttaagtatccatt

SEQ ID NO: 239319 - DNA, 480 bp, Homo sapiens
cttatagccaatggaaaatggaaagcaaaaaccccttaaaatgtcctccagcttcttgggaaaatgtgtaattcccaaggaaaacatgttttgttttgtttcagagatctccaagacatagacccgccctacctgcttacatggaaggacaggtgggtggctgccacagaggtgtgtatgtgacaagtagggagcttcagggaggaggaggccttgactctgcagtgagacagtgagggttcacagccaaactgggggcagtggagtaaacaaaaatccttacaaagcatcacagaaaaaaaaatagaacaaataaaacatcactggttcagaacaactaaggctttagtataattttaaaaaattaaaagtaggccaggtgcactaatcccagcactttgggaggccaaggcaggtggatcacctgaggtcaggagttcgagaacagcctggccaacatggcgaaaaaccgtctctact

SEQ ID NO: 239320 - DNA, 523 bp, Homo sapiens
cagaggcatctgcatatatattttttaaaactctcaaagtgattctgatgcatactgaaggctaagatccaccgatctccacctctctgatggtactgatgcttttctacttggtgatgcagttatcagtggatatgactcttctgcttttctggatttaaaactctgaatctcattagtctctgtcatttctcctattcccaatacatgtacactgactacctcagtgctatatacataataggtaatgatttattgggtgaatatgattatcaccctacatctaatagtaatagctactgctgcaaaagaaaaatgtctataatatatgataaagggaaaggtatgattttaacatccaaaatttggtacaaagttcttaaacaaaaaattgcaaatatccaaatccataaaaagtctttgaaaaatggaaagtttgaaaaaagttttaaaaacttgcttgtttttcttattgcagaaacattttatgttcattactgaagcattaataaatacaagccag

SEQ ID NO: 239321 - DNA, 378 bp, Homo sapiens
ggtaaaaatgaattgcttgtattctaacatagaatagctactacctgttgagtgtttattatatattagacatttaagactaatcaaaatatctaatctaatgaaataatcactgttttgaatttgcttagatttagtagatgtagaaactgagacttagagaggtttatttactcaactccacactgctaattactggtgaaagtagaattttactcctctggttttctcatccagcacatcatcactataacccttatagtttgcttttggcacaagtattcattattaatggaaatgcatagtattatctcagcaaatgtacaaatagtttagcttcactaaactagtcaattttttttttctaaacatcaatgc

SEQ ID NO: 239322 - DNA, 551 bp, Homo sapiens
taattatactttaagttctgggatacatgtgcagaacatgcaggtttgttacataggtatacacatgccatggtggtttgctgcacccattaaccagtcatttacattaggtatttctcctaatgctatccctccccttgcccccaacccctcgacagggccccggtgtatgatgttcccctccctgtgtccatgtgttctcattgttcagctcccacttatgagtaagagcatgcagtgtttggttttctgttcctgtgttagtttgctgagaatgatggtttccagcttcatccatgtccctgcaaaggacatgaacccatccttttttatggctgcatagtattccatggtgtatatgtgaaaatgggcgctctttaatgtgattgatatattaagaatttgagaatcctgcacaaaattcagtcttgagaatcctgcacaaaattcagtcattcccttagtaaaagtgaagtcacttcactgaaaattctcatgcatgggaatgtagggcctgaactgtgtgtcattatgagatcctcttactaatt

SEQ ID NO: 239323 - DNA, 458 bp, Homo sapiens
tcaagagtatgtcttatgtccattactacactgcacattcctggagagcagagtgtttctgatgtatttctgggtctgcaaggcatctaattggtgacttggataccgcaggtattcattgtttgtggtgttttgtttcttgcttggtgtggagacacttctactgaaagaactgtcttacaatgcagggaattgataaggggctatattagagaattctctgtttggatgtgtgattaaatatcttgttttctgaaatttgagatatttaagtactttataaaaataaaaacttgtaagaaattgtaaaaagaaagaaaaggctgggcacggtggctcatgctagcgttaaccttacctgacgtcccttctccaatcctaactttactaacctcagaatagcaataatgataccacctaccttagagggttctctgagtgttaagtgagatacctct

SEQ ID NO: 239324 - DNA, 3097 bp, Homo sapiens
  misc_feature (2588)..(2588): n is a, c, g, or t
taatcagaggataacatgatcagagttgcattttagaagtagtactttggttgtaattttgcaaactggagatggggtgactatttattttgatggcatgttagtcatccttaggagaaatgacagtggcccataataaagaggcatcagtgaggatacagagtaggtagattctagaaaaatttatgagagagaatttataggcatttgattggtatggagagacaagaagaaagccagggattttgtccaggattctggcttgggcacttgagtgaatggtgtaaaactgaggggacgtataggatttacttaccatttcatttgcttgtttttttgtgtgtgttttgtttttctgggagggatgacagatatagctggtgtattagtccattttcacactgctgatagagacataccagagactgggcaatttacaaaagaaagaggtttaattagacttacagttccacgtggctggggaaggtctcacaatcatcatggcagagggtgaaagacaattcttacatggcagtggcaagaaagaatgaggaagaagcaaaagcagaaacccctgataaaccgatcagatctcatgagacttattcactatcacgagactaatgtgggaaagaccaaccctcatgattcagttacctaccactgtgtccctcccacaacaggtgggaattcttcagatgcaattcaagttgagacttgggtggggacacagccaaaccatatcagctgcgttcaagtgaagaaggaaagaagtacatatttcagctgaaactctataagtagttttgaatctgtggtggtagaaggatagagtttttattaatagaaatgaataggaaaaagtggctggttttggagataaacctcttgttgagtatctttgacagtggaacatgcaagtaaagtagcttgtaggcagttaggagataggactgggttttgtgtgagggttaggaggttataatgaaaattttaaaaacagcaacataggggattttgctaaagccttcagggaggatgacttctcacagtgaaggcatggagagaaagaggatggaatggctttagacagttctcttttcctgaggagaggccatgttgggaaggaacgtaaagctccaaagccgaaagtctcaagaaagtgaaaggaaagtaaggtaatgttggaatgtgggtgctaggaagttggggggtgagaaggcaggtagaggagcttccacaaagggaaaggtggcacaaattgctgaagcttcagagaagtagaaaattgattaagaccttcctttggattttcctagaaggtgattattgatcacctttgagacaacactatatttcctttttgttctcaatgattttgccgctcagtgacccctttcctgcccccatacttgtcttttcttttttattattggcttcaacatgactctctttctgcaacccctcagctttcataaattaacccagaaattattttatagcctcctttgagagaagcccttattttcacttccggtgagaccttgaaagttaatttacctagatgctataagcagatcagcaggcatgaccacatactgctttgtggcaattccattgatgtctttatgtccagttatttgtatcaaagcatatgattatgaaggaaaaacaaaaaatacagggtctaggttaactcagcagtagccacatgcaggatataaaatattctcatcctgaaaattcttgcaaaacaatgtgtcctgttttgttgcagttgagtatgtactgattctgtaccttcagccttcatgcagtagaacctggatgacttttgtatgggagatacaaaacccagagtctcactgaattttgtgtatggatatataggtcagacatcagtgtacatgacggtagtacaagggtgaaggatgatggaagggaagttcattaataactggtagtaagtttttgtagctcagaagaaagagggacaagtagaaataattggagtaatatttaacactttaaggaagcgatgtgatgttcagataggccttgaaagataatctctgtagtgaagaggatgacgaagggcaggtaatgacatgattctagaaagcagatatcccacagcgtgcacagaggttagaaaacaggcatctttgagttgaacactagattaattagggaaggttgaagttactgttggtaagatctgatgagagagcctagaatgtccttttaattcacaagcagtttggggggcatggcttgggaagttatgtggttagtgttttaagaagcttagttaacatggtggtgacatacaggtaaaattgtagaaaggtctgtcaataggatggactgagttactggttctcagctaagggtgacttttgcaatcttggggaaatttttagttgtcacaactgggacagagagagatgagataggcctattggcatctagtgcatagaagctaggaatgctgctgaacatcttataatacaagggacagcttcccacaacaagaattatgtggccaaaaatgtccatagtgtcaaggttaagaaaccctagctagnttatgctatagtagcaaacaaccccaagttcttaatggtttgaaacagtaaagatttatttattgctcagactcgctgtacataactatacatcatccacattctggaatccaagctaatggagctaccactgtctggcacattactcatactgtattggccaggacttgttacagaacccctcttaaccacagagaggacagaaattgcaatcctgtcacatccccagaaaggggcaaactgtaatattgactaacagcattagttacaaccatggaaggctgtcttggagtagaggagttgtcagtaagagagaaaccagtttcttgctgattgctgttaattcttcattctttgccccttcaggaaagtaaaatcacagtatatacagaatgggattagaaagatgtagcataggctgggcacagtggctcacacctgtaatcctggcactttgggaggccgaggtaggaggattgcttgaagccaagagttgagaccagcttgag

SEQ ID NO: 239325 - DNA, 1895 bp, Homo sapiens
  misc_feature (1386)..(1386): n is a, c, g, or t
cgcccgtccgaagggtccgcggcaaatcattgagaacaaaaaggaaatatagtgttgtctcaaaggtgatcaataatcaccttctaggaaaatccaaaggaaggtcttaatcaattttctacttctctgaagcttcagcaatttgtgccacctttccctttgtggaagctcctctacctgccttctcacccccctttcctgcccccatacttgtcttttcttttttattattggcttcaacatgactctctttctgcaacccctcagctttcataaattaacccagaaattattttatagcctcctttgagagaagcccttattttcacttccggtgagaccttgaaagttaatttacctagatgctataagcagatcagcaggcatgaccacatactgctttgtggcaattccattgatgtctttatgtccagttatttgtatcaaagcatatgattatgaaggaaaaacaaaaaatacagggtctaggttaactcagcagtagccacatgcaggatataaaatattctcatcctgaaaattcttgcaaaacaatgtgtcctgttttgttgcagttgagtatgtactgattctgtaccttcagccttcatgcagtagaacctggatgacttttgtatgggagatacaaaacccagagtctcactgaattttgtgtatggatatataggtcagacatcagtgtacatgacggtagtacaagggtgaaggatgatggaagggaagttcattaataactggtagtaagtttttgtagctcagaagaaagagggacaagtagaaataattggagtaatatttaacactttaaggaagcgatgtgatgttcagataggccttgaaagataatctctgtagtgaagaggatgacgaagggcaggtaatgacatgattctagaaagcagatatcccacagcgtgcacagaggttagaaaacaggcatctttgagttgaacactagattaattagggaaggttgaagttactgttggtaagatctgatgagagagcctagaatgtccttttaattcacaagcagtttggggggcatggcttgggaagttatgtggttagtgttttaagaagcttagttaacatggtggtgacatacaggtaaaattgtagaaaggtctgtcaataggatggactgagttactggttctcagctaagggtgacttttgcaatcttggggaaatttttagttgtcacaactgggacagagagagatgagataggcctattggcatctagtgcatagaagctaggaatgctgctgaacatcttataatacaagggacagcttcccacaacaagaattatgtggccaaaaatgtccatagtgtcaaggttaagaaaccctagctagnttatgctatagtagcaaacaaccccaagttcttaatggtttgaaacagtaaagatttatttattgctcagactcgctgtacataactatacatcatccacattctggaatccaagctaatggagctaccactgtctggcacattactcatactgtattggccaggacttgttacagaacccctcttaaccacagagaggacagaaattgcaatcctgtcacatccccagaaaggggcaaactgtaatattgactaacagcattagttacaaccatggaaggctgtcttggagtagaggagttgtcagtaagagagaaaccagtttcttgctgattgctgttaattcttcattctttgccccttcaggaaagtaaaatcacagtatatacagaatgggattagaaagatgtagcataggctgggcacagtggctcacacctgtaatcctggcactttgggaggccgaggtaggaggattgcttgaagccaagagttgagaccagcttgag

SEQ ID NO: 239326 - DNA, 370 bp, Homo sapiens
cgttctaggtccagcctcctccccgtcccactaacctggatagtctagcttgagtgcccagtcttaaccagttctctcaaggcccccaggcacagaaaggagggagggagaaatgaaaggagggtaggctgaggtgggtggagcatctgagttcagaagttcaagaccagcctggccaatatggtgaaaccctgtctctactgaaaatacaaaaattagccaggcgtagtggtgggcgcctgtcctgtaatcccacctactcaggaggctgaggcatgagaattgcttaacccaggaggcagaggttgcagtgatctaacatcgcgccactgcactctagcctgggtgacggagaaagactcagtctcaa

SEQ ID NO: 239327 - DNA, 2452 bp, Homo sapiens
  misc_feature (772)..(772): n is a, c, g, or t
  misc_feature (847)..(847): n is a, c, g, or t
  misc_feature (854)..(854): n is a, c, g, or t
  misc_feature (869)..(869): n is a, c, g, or t
  misc_feature (872)..(872): n is a, c, g, or t
  misc_feature (879)..(879): n is a, c, g, or t
  misc_feature (919)..(919): n is a, c, g, or t
  misc_feature (938)..(938): n is a, c, g, or t
  misc_feature (1334)..(1334): n is a, c, g, or t
  misc_feature (1452)..(1452): n is a, c, g, or t
  misc_feature (2182)..(2182): n is a, c, g, or t
tatgtcatcttaaaaatctaaaatataacatggcacataaagccaaaaaaaaattttttttttttgagacggaatcttgctttgtcgcccaggctatagtgcagtggcacgatctgagctcactgcaaccttaacctcctgggttcgggcgattctcctgtctcagcctcccgagtagctggtacgacaggtgcatgccaccatgcctggctaatttttgtgtttttactagagacggcatttcactatgttggtcaggctggtctcaaactcctgacctcaggtgatccacctacctcagcctcctaaagtgctgggattacaggcatgagccactgtgcccggccaaagcaaaaaattttaagaaacacccgattcagtaacaatagctcttaatttagtttatatcattaaatgttttgatcttcatccttgttttaggaaacacaaaaaagcatgcacaaagaggcttataatttttatataatttaaaatatttcttcatttaaacagaaatgttctactctccaacttttcatgtgtacatacttaccatttctgtgggtgtgtgcataaaatgtaagcatcatttgatcaattttctgttgttgccttgtttatatcaatcttctcagttatgaaaactgctctggatgttgttttacagttatctctgtatattggctcataagtccttttgagataaatttcaagtcagataaataggggtaaaacgcaaagctcagctgggcgtggtggctcacgcctgtantctcagccctttgggagggtgaggcgcgcaaatcacgaggtcaggattccgagaccagcctggccaacatggtgnaaccccntctctactgaaaatncanaaacttngctgggcgtgctggcaggcgcctgtaatcctagctactcnggaggcagaggcaggaganttgcttgaacccgggaggcggaggttgcactgagccaagattacactactgcactccatcctggcgacagagcaagactccgtttaaaaaaaaaaaaaatacaggctgggcgcggtggctcacgcctataatcccagcactttgggaggccgaggcgggtggatcacgaggtcaggagattgagaccatcctggctaacatggtgaaaccccgtctttactaaaaatacaaaaaattagccgggcatggtggcaggcacctgtagtcccagctacttgggaggctgaggcaagaaaatggcatgaacccgggaggcagagcttgcagggagccgagatcgcgccactgcaccccagcctgggtgacagagcgagactcagtctcaaaaaaaaaaanaaataaataaatacaaaaatagcactcaaaaatgtatattcttatattgattcgtgtttatattttgttttatatgtgcatatttatgctagttttgtggatcttatatttccacagnattagagaatatattcgaaatattactgtgtttaaaagtatcttatttagtaactcaggtcactcataagtcagaaccagttgtcttaactttcttatttcatcttgggtcaaattaggaactctgcccttgactgcatgatcaatgtgttatttatttttattagagaaactgttgacattcagggatgtggtcatagaattctctctggaggagtaaaaatacctgaacccttctcagcagaatatgtatagagatttgatgttagagaactatacatacgttgtctctgagtcggaataacttaccttcagaatatctaatgtctaataactatgataccgtaccttgttttaacctgattgtctctcttagctgagagagccggacagactccattttagtttctttacttgcagcccctttacccctctcccttaagggcataaccagtgcaagctgactccaagcacatccaggaatacacttactgataagatactgaggcaagctgtaccagcagctcctgggaatgcgctcaaagcccctgcgtttatcactttgtgatagtttaagcccctgcacctggaactgttcattttttctgtaactgtttctgtaaccatttatctttttaactttttgcctgttctgcttctgtaaaattgcttcagctaggctcccccctccccttgtagactgaggtataaaaggaaatctggccgggcgnggtggctcacatctgtaatcccagcactttgggaggccgaggtgggcgaatcacgaggtcgggagatcgagatcatcctggctaacatggtgaaaccccgtctctactaaaaatacaaaaaattagctgggcgtggtggcggcgtctgtagtcccagctacttgggaggctgaggcaggagaatggcgtgaccccgggacgcggaggttgcagtgagctgagatcgcgccactgcactccagcctgggtgacacagcaagactctgtctc

SEQ ID NO: 239328 - DNA, 439 bp, Homo sapiens
cagcctcccaaagtactggaattacaggtgtgagccagtgtgcctgcctctcagacccagttcattgtaatagctagattctttgccggtttattctgctctaaagattctccttgagggaggtatgaaattagaacaagctgcctttctcttatttgtaaatattacactgtcttcctcaggcatttggcctctctttttaaattattgctctaaacatagcttttttataattgtgaaacatgctatgtaaatagagtaagatagtttacggaataaagtgaacacactcctgaacaacccccaagttaacaaaatgaataacaatagctttttataaacttttataactttataaaatagtatttctgtgagacccagttcattctgagcttcagttttcctcaagtttttcataggtttgtgctatttttatata

SEQ ID NO: 239329 - DNA, 325 bp, Homo sapiens
tttatagcagcaaagtcaaaataattaaaatagtaaaaggttattcccttccccatgtattttatacccttcctatatattaaggtattctgtaagtatttaatgatttaaactaagcttgtattctttgccttggtcatgaaacgattagaataaactccccccaaatagctcattgtctgtctagtctccaattatctctgtagagaaaagtactattgtaagtagcaaaaaatatttatgttttacttgagaaaccatatttattctttaatatgtgtgtttacacagaagcttgttctctgaataaaattgtgaaatgcta

SEQ ID NO: 239330 - DNA, 485 bp, Homo sapiens
tatccagtgtgctgggactgactgaaaggttgttatattcttaggtgggaccaataggaaaagcacatccaagataaaagtgctatatttcctctatacttctttgagttgcaccacacttgggttaatagctccattctaagcattacctacaaagaaggagactgagaaagagaaacagaaaggactaggaaccatgagaacagtgtaaaccatgcccactgaggatgaattataggaatgaaggatattttgcctaaaaaatagaagactgagggtgaaataaaagtcctttttagaaaactagacagtggttatgaggagagagaatccatatgcttggtgagcaatgtgtgaacatcgtggacaagtcagttttgcttaagtctgagcagcacgtttgaagtagttgatcggcccacactgtaatgggcattaccttaggggaagttaatggcctattgctatgctacaagtcttcttta

SEQ ID NO: 239331 - DNA, 381 bp, Homo sapiens
cagaaggtgacctgcaacatcgatatctgtcctccagagagaagaaagaaggttttcttcagaagggaagatcatgtgctaagcaacaggaatttggaggcactaggtaaaagagaaagttcaagaaaacttagggtttttcattctacaagaagataattggactgctaccttatttccatctcttgcatgtgtagccacagaaggagcagttgcattttcttttagcacctcatcttgactctaattctactctaaatgtatctgctatagattagcctatttttgtttccatatgtacctttacgataagactgataataaatatccagtgataatctctccatttattcaataaatatttattgaactacattgtat

SEQ ID NO: 239332 - DNA, 444 bp, Homo sapiens
tgcgactcatgagaatgatgttttcttctctggtacataaggttatgtaggtccaatccattgtgtagaagatcttttctcccttaatgggatgtacacttatttttagcacaagtataaaactactttaaatgaagtcagcctcagccagggaaatatgctgagtaataatgttgccaggtactataccactgagttgagtttgcaattcactgctattaatccctgcatgttagttctgaatttttactctttgcatacgtagaaaaaatggtgtttctcttcagagtcaaggagggaaaaaagaaaagttaaaagacacttataacacttttgtgtccacccctaaaatcagcatattgatctactatttttctaggtattgatggaatattgactcatatactttcatacaactgctaataaatatatatatatagactc

SEQ ID NO: 239333 - DNA, 455 bp, Homo sapiens
cggccaagaaccctcccgtagggcagagtgaggattggcgggagagaaaagcctaaagggactgtagcaattggctgccgccttttccaccgtaggaggatcgggctgacactcccagcgttgggacttattcagtggactctttagtatggttatttggatgatggttttgattcggagagtcaaaagccatggtatgtgagggaaaaaaagcagaaagtaaacattgtttctgctgaaagagtgatgaagcagacagatattatgcccctctgaactgatcccacccagggctcaaatttccaagagaactgtatgcttataaatattatgggaccagaagcaaggaaatgaatggattcttggttaaaacagaaaatcatgaattttactttacttttaatttatttcaaattgttcttactccagtagacaatagaattatgaatttctga

SEQ ID NO: 239334 - DNA, 737 bp, Homo sapiens
ggacaatgtgagggcccaagtcctatgggatcactgcactctgcctgagatgcccttaccctaaggaacaaacacagaatcaagttgtcctagaaaggccagggtgggtttgtcctggaggcacactcactgcgagcgtgctctttttccagtatttgaaggactctctttatatgatctgtcttaagagttctattagatgtagcttttagaagatcaattaactatgaatatatactataggcactgaatttagcaagtatagtactattctgttatgctgagcttcttctctctttgtaaatttgatatagtaaattcaaaatccatttcactaataagagttatttatttgtgtcttttctaatcatgcttgagaatcctattcgtcccagaaatttattttcctgtgttatgtgcatgtatgtttttttactgatagtgcctaaagttgtagaagttgataagcttacaagatctctgttgcaatctgtttttccttttaagttggctaaattatgtttattgcaaactcctcatgtatatatggatatgttttcaacttttttatttagcaaaagtaaaaactgctgctttctctgattaaaataaagtggaaacactttaatgtcatagagtgccactttttttgttgttgttgttaaagatatgccatgcatagcaaattgaagtttttggtactagctcattaaaagagtatgggagaggggagggag

SEQ ID NO: 239335 - DNA, 354 bp, Homo sapiens
gaaaaagaaaaatagtagacaactaaaacctcctaccaagaaaacctctgctgttttggataacacgtatgccatattattccactttgatggaaagatcaaaaaaatgcaaaggaattcatgtgtgtggatggcttgagtgcatccacccatctcccaaagcagcgtgtttccaaagggcagagatagcctcatgtcatgcctcttttgtttaatttcctcaagatgcatcattctccaaggagatgtgctcaagttctctgtctctcccacattgttttcaaacctggttaccactgaatgcatttctaaatgacaaggcgactgggtctaaatcttgatatgttgagagaa

SEQ ID NO: 239336 - DNA, 501 bp, Homo sapiens
tatggaaatagtgatgttgcatgactaatatttttatttacccattcccagttgctccactgtctcttttagcttgatgctcaagttccagcactatccagctcctagttgttcagccttattttcttccatttcccccagtatttataaactctatacactatgtgctatacttgaatagctcactatttttattcctccacacctttgttcatgttgtgcctagaacatttccttctcctctactgcccttccatcaccagcctggtaagcacttagccatacctgtcaaggtccagctcaggtatcactctatgaaacctttcagagcttctcagaaggaactcatcctccttttactatattcacttaattctttacatagttcttattatgcttatcagattgaatcataattatttattcccaaaggtagggactcttatttatctttgtgtcctcagcatctagccttctgcctggcaattcttaaatcttctt

SEQ ID NO: 239337 - DNA, 309 bp, Homo sapiens
cttacttttcgtaataacctcgtgaaggaggtattcttcccactttatagataaggacactgaggctcagatgctaaaaggcttgtttacatttgcacatctagagggtgactccaaagccctgttcctgccctgtagcctttgcagatttcaaccacccccgcccatgcttcctgctcccccgccacattgtgacagatgaagccaccactggtcaagcgtgggctgcactcagttggactgaagcacacatgtctgaggagggacttgggccaggggctgggttggagaaattctagaaaaaaaaga

SEQ ID NO: 239338 - DNA, 554 bp, Homo sapiens
taggataaattgctaagtgtaaggttctcaatacttctcccaatatttctttttgtttctccaaaggagagctctctcacaggcctatttttaatgtgttgtataacaaaagaaagttttaaacagagccaaaacaaacatccaccactgcacttagggatgagcagcttcttttcttttgggaagaacaatctgttaatttcccacctccagtgttgtgtcaaccttttggtcagagaatgtggaaatgatttaccaagacagaagttactcccttcttaggtaactagattcatgaatgagcgtggatttcatattctgccagtattttttctattctaacattataataaaaagaaaagaaaggcaaaataacttatgaaaaagtttccattttcactttccatagacttttctgttatttgatcatatgtagatatgattattatgtatttccagccagagttgggatacaattctgttattttaaaatattgcattgaatattcttctgtgttattgtcttctaataaatattttcaatgaccatatat

SEQ ID NO: 239339 - DNA, 205 bp, Homo sapiens
gagatatttaatatgctttttcacgggaagcgtctgtgtatgtgcgtgtgcgcgtgcgcttgcgtgcctgtgagtttagggatgggtgcaggctgcctgcaccgtttcagcacacggccttgtggacacagcccaaatgagttcctaaagatacccagctctctgcctaaatcctctgtatgcaaataaaggtctctgcttgtct

SEQ ID NO: 239340 - DNA, 338 bp, Homo sapiens
ggaaatatgatagtcttcaaataatactgatagttatggagaaaattgactcttcagtctctcaggaaagtgaggaaaattctggcttccatggaagaggccataggggatgtcagttttctactataatgaaaagctggagacaagaaatttggactatgctatgggtaaagaggtgttttctcttaggtataagaaggggtcctggagggtgggaaaaaaggagtcccaaagtagatgagaaagtaagaaaatacatcccttcatgtgtgcagaaatgcatgttgagtgatttgtgaaatactgtggtttatatgtcaaaaacataaactctagaa

SEQ ID NO: 239341 - DNA, 404 bp, Homo sapiens
gaaaatatatgcacatcaatttatgacttgtgtaagtcaattactaattcaattactaatgggaaattggatgaactcagtaaaactgtcttaactatgtctcttgagtttctttttctattacatgctaaattacaataaaaccttgactacctaaactctcagagattcagttttttttttgttttgttttttggttttttttgagtagttgagtatttgtttagaaaacattgctgttgtctgagttgttctgtcacagtaagaaaaatatttaggccgggcgtggtggctcacgcctgtaatctcaacactttgggaggccaaggtgggtggatcacctgaggtcaggagttagagaccaacctggccaacatggtaaaaccccatctctactaaaaata

SEQ ID NO: 239342 - DNA, 377 bp, Homo sapiens
atttcagtgtgtttttgtagtggctggtaatggtcttttcttcccatatttagtgttttttttaggacgtcttgtaaggcaggtctagtggcaacaaatttcctcaggatttgcttatctgaaaagaatctcattttcctttcattgataaagcttagtttgctcaaatatgagattctgggttgaaatttattttctttaagaatatccaatattgggcagggtacagtggctcatgcctgtattcctagcactttgggaggctgagggggggtggatcacttgagctcaggagtttgagcccagcctgggaaacatggcaaaactcatctctacaaaaaatacaaaagaaaaaaaaatagccaggcatggtcaca

SEQ ID NO: 239343 - DNA, 1090 bp, Homo sapiens
ttttttttctctagagaaactcactgcagagctgggtaagttctgggtgcggggccacagtgctgcctgtcagccggaccctgtgcctgtgcagtgggaggaggggctccctttggacagcggctggcaactatctaattctaaaccatccctgtgagcctccacctcttcccttgctaaggggctgaaaggatggctgcctgccaccgtgcagctgcccgagaccctctgcacagaccctgccagctcctcccctgcaaattagacaattcagttaaaattcatcataaaacgtttactgtctccggttcatcttcttaaaatatccttttctttttaatgcaaatggcactaggaagggtggcacctttaatttgcaccaaaatggaaataatttctcagatccacttttctccccagagggactcagagacgtgaaaccatgggatgtgtctctgtagagaggaagagagagtgaacccaagggagggggaatggaggaaaaggccatcatggtgttggggttgggggggcaattcagatgaaactgtaaggttgggaaagcttgtctggcagtctacctcgcccttcaaggggaatgagaaaaacatagccctaataagtcattaaggctatagtctgaattgtaagtcataacactatagcatgaatgcctctcccaggagcatttacttttgaaagagcttgacattgggtggacagatcaaaggaatgcatttttagtagcaaaatgttggagtccttggtaattatttggggaaataattgggtgtgatgtccttccagtccttcagataacgcacccggtgagtgaccgtgaggctcacgtaggcggccctcagtgcctgcacttaggcgggagctccgccccaggaagcttgtgatttcaggcagaaggaacaaccccaaccctgggaagaggcctgtcagtactaagatctggtatcccttctaggctgtgtgcagatttccacctttgagctaagataggatgaggcataagagtcctgcagatgggcctctttttgagggcaatgaaggggcaaagaggaagctgtaaaaaaaaaaa

SEQ ID NO: 239344 - DNA, 319 bp, Homo sapiens
cctctcggtgctcagcggcgcctggaccgacacggcccccgcgggtgttttccagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaaggctgtgtgcagatttccacctttgagctaagataggatgaggcataagagtcctgcagatgggcctctttttgagggcaatgaaggggcaaagaggaagctgtaaaaaaaaaaa

SEQ ID NO: 239345 - DNA, 405 bp, Homo sapiens
ggggcctgtagggccttcaccatcttccacctagaggtggccccacccccaggaatgagcaccgtgctcttgagcctgctgggccagtcctggggcggcaggctgctgcagggtgagacctagtctggtcctttcttcttctactcatgataccttatgatgactagtaatggtggcttcccttggagacagaaactcccacgaggcctgggtagggccgggagtcctctctctccaacgccttccctcaacccgggaggcttcttggggtggaacctggagagctggacagccatgctgtcatttctccacacgcatacatcctgccctcgtctcccacttcctcctggttggtttttgaggagagatgagagaataaaaactaaaatacagagagtgacataa

SEQ ID NO: 239346 - DNA, 647 bp, Homo sapiens
tcataacaactttcagtatcagagtaggctttttttttgtttactatagagactttctttgctacagagtaggcattattattttcacatggcagatgaagaaactgaggccacacagaccaagtgacctgatgtaatttcaaactagaactttcaaaagtgttttgtgcaatggcattattttcagaatgaacttagcttctcaaggcaactacacaaagcagagctgggaatgggagggaggagcacaccagcactagcggtatttaaaatcagccacttccaatgctagtcccttctcagtcagcaataggaatggactttggggaaggagttttgccagcagcctcaacctcaggccagattccaatgactcctggactcctcaaaggcccgtgagtcaatgagagagagcggaagttatgttttcccaaatatacctcatcagggtcctcaatcgactactaaaccaaattgtccatcgaatttattaccacttctcctgaatatacaggaatagatctgaatccagggattttgaactcaggaggtctaattcttacccatcttgttacattggcttcaaaagggaaggacacataattcctcattttgttttataacgatttagtaaaatagggatcaga

SEQ ID NO: 239347 - DNA, 1074 bp, Homo sapiens
atgcacattaaaaccacagtgattccagtttacactcacaaggatggtcagaacaaaaaagccagataacaagtgttcgtgaggatgtggagatattggaactcgcatacattgctggtgggaaggtaaaatggtgcagccactttgaaaaacaatttggcagttcctcaaaaggttaaatataaagttaccatatgacccagcaatttcactgccacatataatatccaaaaggaatgaaaacatttacacacaaccttgtacacaaatattcatagcagcattatttttaatagccccaaagcagaaactcaaatgcccagctgatggataagcaatatgttgtatctatacatacaacatattgtatgtatatggaaatggaattgtatgtctatggacatattgtatgtctatggaaaatggaatattatggccataaaaaagaatgaagtgatgatatatgcttcattgatgaaccctggaaacattacgctgagtgaatgaaatcagacacaaaaggctgcatattatatcattctaattacataaaatgtctagaattgacaaattcatagagacagaaactagtgttggttgccaggggctgaagggaatgggaaaggggaatgacttctaatgggtatgagtcttcttttaggggagctgcataacggaatattccaaaagccacacattaaaggggtgagtttatggtatgtgaatgatatttcaataaagttgtgattaaaaaaataattataccatcctaaacaaaacaaagggggacgacaaaaatatcccgagagggcccaggttaacggagaccgggatcaggcaaagggcgcaaagcaggagcataaacgaacgccacggcgcccgcttaacagccgtggaggtgaaacacaccccggaccttccgagaaccacccgcggggcgcaatggcaacacccagaacgaccgcgagacacagcgcaaggaaagcaacgcacggaagcgaaaaagagacaacacaccgacgcgacacaacgacaagcgcgcgcagcgcgataacaagacgagaccagagcgat

SEQ ID NO: 239348 - DNA, 649 bp, Homo sapiens
aaggtatgcagagccaacagaacattttattcggaatggcagctggtggtttctgttatctgtgaatcattgtgaagtctgtctgaggcagagaggagacagctagccgaattcccctttcgcaaaaactgattcataacattgtaaagctcacagaaaatgcattttgtatcacaagaacacataaaaatctctattttttgacataaaggctatattgatgaactttaaaataaaaagaacctgtaaatgtaaaaccataaagaaacattttttaaaatagtatgaataatttatgggcagttgaatacagcttttgttgctttgtaggtaactcacttataacaattgcataaatggtaatgcagttgtgtgtaacaaaggaccattaattatgacacttatgacaatgataacataattaactattttttgagctgctactatttgctgccacctaacatacattattacatttattccctgcaacaagcctgcaaggtaggtattattctcctgttgaaaatgatgctgaagttcagtcacacaaacaccaagtaccagggccaaactgcaatccatatccccctcacatgaaagttagtgtggtttccactctactgttaccattgatgagacatggtaacca

SEQ ID NO: 239349 - DNA, 363 bp, Homo sapiens
tgttatgtctaagaattctttgcctagccttagattccaaagatttcctttaatcgttcttctataaaatatttatagttttacattcaagtttatcatcctgtttgagttatttttatataagatgtgagatttaggtcaaggattattttttggcctttgagtgtctagttgtttccacttgctgaaaaggctagctttcctccattgaattgcttttgcacctttgtcaaaaatcacttggtcctatttatgtggatctatttctggattttctgttctattctattaatatttgggtctgtccctctgccagcaccacacagcactccagcctgggcgacagagtgagactccgtctca

SEQ ID NO: 239350 - DNA, 453 bp, Homo sapiens
tgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttactgggtacttgagaggctgaggcaggaggatcacttgagcccaggagttctaggccaacataggcaatatagtgagacagtgtctctta

SEQ ID NO: 239351 - DNA, 194 bp, Homo sapiens
agccaggcatcctctgctgcactgggtgtgcctgctttccctattcaaggcagcttcatgtgactgtggacactgtacgccatcctcatcaaagcgcttggagtaggggtgcatggaatggagtttctttcttacaatgggggtctgaaatccagggtttccacaccagggaaaaataaagattctgtctctta

SEQ ID NO: 239352 - DNA, 447 bp, Homo sapiens
cagtcccccacactccaacctcattctctaggagccacccgaagaagattagcatcagcacacggcacggttagtaaatgtgtgtgctgttcaattgtccacatttatggatcaatgcattcaaatatgacatttactttaatgcacctcgttttttaaaaacggtattgctattcttccatactacatatggcaatttttgtctttcaaaacttctatactttggtgtagcagaatacatctagattttgtctttcaaagcttctatactttggtgtagcagaatacatctagaaaaacatagtagaagattatttggatgtaaaaggacataagtataacaattttattacttttctaaaaaaaaggactggatgtttttgtgtaagtattatatcattattatttaagtaatattatcaaataaaatattgcaacaggaactgc

SEQ ID NO: 239353 - DNA, 1769 bp, Homo sapiens
  misc_feature (63)..(63): n is a, c, g, or t
  misc_feature (1130)..(1130): n is a, c, g, or t
  misc_feature (1647)..(1647): n is a, c, g, or t
aaaatgacttccctgggaaccagaacatccaggttggcctcaaacttgctgccaaacaggaantgtggcaagccggagaggattctgatgcttggaagtgggcgaatgttttgattttcaagcaaagaaaaagctagcttcctagaattacaggccagtgaacttgtcatcattcccagagagtgctgaaaagaattaattaaatgatttttcagctgttaaaaagggatcctctgccccagcagaactggcagagatccctaataacagttcctgccaaaaaaaaatgattgcagctttgaaaaagagggttacttcaatgatgaatgagaaagcgttgtagatgctgtctcaggattttggtaaggtatttgagaaaggcactacatttctttgtgaaaaggcaggagaaacagggcttggatggcagtgcagtcccacaggctcatacccaccatgctactcaaactaccgattaatggacctatgtctacctggggtggagggctgcaagggtggacctcagaccccaatctcataatgaggtagtgagtgaggcaagacacccccttacctggccatggcttaagagttgtagagcagagatcagaagccacagccttggtcagagggagggaaacaagcccagctggatgaaaaaaaaggagcatggagacaaaatggggggtggggagcaagggacactgaggacagctgagaaccaggggctgcaggtctgccctggggaggcaggcaggtgggtttcaaaggcggggcaccatcgcttgtggaggtttgtcattctcagtgcactcttgagattgtcacagatccatttaaaagggctgaaaggagacagagatttgtaacctcagacctgccctcctcaactgatttattaccagtgtgaatgaggacgtggatataagacatgttcattaagcctgcaggtgatgtgaaggtggaagagagaactaaaacgttggatgacttcggtacctaggtccaaaaaactcagttgttctgagtgtgtgataaaatgctatttagtcgtgacccgtgaggaggaggtagaggctggagagtcagtacagattaacgtggctacaaaagcgtaaggaagacttagncctctgtagcagaagaatatagttcaagctgagatgggtaacaagccttaccttaacaatatttctctgtcccccacaagtcagaccacatctgaaattttaaaatgagctccagtttccatcactgaagggcaaatcttgagtgtatccattggagaatgccgtagatactttgagatttcattcatatatatatatggattaatatgctcaccctggagagcatttgagggattttaaggccactggcttgaaataagcgacgtgcacctgagggattggatgtatctttggtaacaccatagggcgtaggtttgagcttcttagcctttggcgctgtctgaaaagaaaatggaggccttgggccgggtttggtggctcattcctgtaattccaacactttgggaggctgaggcaggtggatcacttgaggtcacgagaccagcctggccaacgtggtgaaaccccgtctctactaaaaatacaaaaattagccgggtgtggtggctcatgcctntagtcccagctactcaggaggctgaggcaggagaatcgcttgaacctgggaggcggggattgcagtgggctgagatagcaccactgcattccagcctgggcaacagagtgagactccgactc

SEQ ID NO: 239354 - DNA, 358 bp, Homo sapiens
ttgacgttttaataatcaccattcttcctagggtaagatcatatctcattatggatttaatttgcatttccctgatgtctagtgatgttgagcatttttccaggtatctgttggctgcttgaatattttcatgtgagaaatgtctattcatgtccttagcccactttttaatgggattatttgtttttttattgttatttgagttccttgtatactctggacattaagttgacatattttctcccattcagtaagttttctcttcactctgttgtttccccttgttgtatagaagctttttagtttaatatgatcgcatttgtctatatttattacagttgtgcttttgcatccttag

SEQ ID NO: 239355 - DNA, 792 bp, Homo sapiens
agcggatactaaggacgcgacttcttgtttggagagggtggagctttggagtgagacccaagaggccaaatcccaaagagaaaaataggagcctaaataaggatcaggaccaagggaagggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcagttattaaaagagcagaaggaactagaagaattg

SEQ ID NO: 239356 - DNA, 617 bp, Homo sapiens
gcagttattttctacgctacctgtgcgccataaggaatttcaaaggaatattaagaagaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagatgccctggggatggagcatgcctgagatactgtctctaaatgaaagtgatctccgccctgtcctttcaacctcacgttcatggtaagtagaggtccaaatgcggagatggctttccaaagtatgagacagtcagcaacagtggtcccagtgactcaggtgaaaagccaaggtttggagagtcaataccactgttagttcgtgggtggagtaggcgattaagtctgtggaatttcacatgtatttattaaagttaattcaagtaatttggatggtgaggatgggttctacttctatctgcttgaattctaacttcaggtaaaagagaaagaaatatgaataccttcccttagtggcatgctaaaactctccccttaaaatattttttgtgcc

SEQ ID NO: 239357 - DNA, 547 bp, Homo sapiens
agcggatactaaggacgcgacttcttgtttggagagggtggagctttggagtgagacccaagaggccaaatcccaaagagaaaaataggagcctaaataaggatcaggaccaagggaagggagtgaggctcagtgtcatcaaggaacagccaatccaatgagattgacatgagaaatgatacatattcagcagaagatcagaccctaaaagcatgacaattgcagttatcttctctggcaagagaagagtgtgaagacactcctaaatagccacatatggattaattttattttagaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgaggtatatttttctttatatgttactacagtaaaacccaactcaacatgtacttaaaaattcaaatgaagccaatatcattatcaa

SEQ ID NO: 239358 - DNA, 448 bp, Homo sapiens
gaacgtgctttccatgttatagagtgaggctcagtgtcatcaaggaacagccaatccaatgagattgacatgagaaatgatacatattcagcagaagatcagaccctaaaagcatgacaattgcagttatcttctctggcaagagaagagtgtgaagacactcctaaatagccacatatggattaattttattttagaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgaggtatatttttctttatatgttactacagtaaaacccaactcaacatgtacttaaaaattcaaatgaagccaatatcattatcaa

SEQ ID NO: 239359 - DNA, 351 bp, Homo sapiens
aaaaaaaaaagaaactccacagaaattccagacaatgcgatgccagtgtcccaacagcttaggagtagcatcaaagagcctgtccctgccaggcacggtagcttacgcctgtaatcctggcactttgggaggctgaggcaggcagatcagttgaggtcaggagttctagaccaacctgaccaacatgatgaaaccctgtctttactaaaaatacaaaaattagccgagcaccccagctactcaggaggctgagccaggagaactgcttgaacatgggaggtggaggagattgcagtgagctgagatcagatcacagcactccagcttgggcaactgagcaagactccgtct

SEQ ID NO: 239360 - DNA, 1226 bp, Homo sapiens
gtgcctaactcccagtgttaggaagctatgggaagaatccaatattctttagttgttgagaccagtttatatgccatgggattttttaaattgatacataataattgtatatattcatgggatacaatatgttttggtacatataaacattgtagaatgatcaaattaggctaattagcatatccatcaccttaaacctttattattttttgtgagaacattcagaatcatctcttttagctatttgaaatatgcaatgcattattgttagctatactcaccttactgtgtgatagagtaccagaatgtattcctcctacctaactgtaacattatacccattgaccaacctctcctcatcttcccctccctcctgttctccccagtctctggtaaccactatcaagttttttagatttcacatatgagtgagatcattcagtatttttctttctgttctcagcttatttcacttaatataatgttctccaggctcatccatgttgtcacaaatgacaggatttaattttttttatggctgtgcagtattctattgtgtatatatgccacattttccttgttaattcatttgttgatgggcatttaagttgattccatattttcgcaattgtgaatagtgctccaataaacatgggagtgcagatgtctcttcaacctactgatttcatttcctttggctatatacccagtagtgagggtgaagattgctggatcatatgatagatttatttttaattttttgaggaacttctgtactgttttccataatggctgtactgatttgcattcctaccaacagtgtgtgagagttcttctttcttaccatgtaatagtttcatagtttatgtggggaaataaaagtagctattgtttctagttttagatcttgaacagactataaaaaggtgcaatatattaattcacacttaaatcacacaaactcaagttattcttaggtaaaatatcgttgcttgttaattgcataaagtcatctagtttctttagtgagaagagattttatctttctaaaatattaacaatagctttatacattttctgtcctattttctgcattgtactgaacgttgtttccctttttctggtataatattaaagcaggatgaaaacttatttgttaccttcaaatgaaccaactctaatgtattcataccaaaaataaagatttttttgcaataggaatctaa

SEQ ID NO: 239361 - DNA, 294 bp, Homo sapiens
ccagcctgacaacacagagaaaccccgtctctactaaaaatacagaaaattagtctggcgtggtggcagatgcctgtaatctcagctactggggaggctgagttaggagaatcggttgaaccctggaggcagacgttgcagtgagccgagatcacaccactgcactccaacctgggcaacaagagcgaaactccgtctcaaataaataaataaataagtaaaaacccatttacccccacaggcttgtgagactggttggaagaagtgctgctaggcagggcctgtgtgtttgga

SEQ ID NO: 239362 - DNA, 2698 bp, Homo sapiens
  misc_feature (1685)..(1685): n is a, c, g, or t
agacatttatttctcacagttctggaagaaagtttaaaatcaaggtcttggcaaatttggtttctggtgagggctgtctttctagcttgtagatgcctgtctgccttgtcttcacatgatctttcctaagggtgtgtgtgtgtgtgggtgtatctgtgtgtgtgtttgtgcgcacacacacgcgtgtgcacagggctggtagagagtgagctctctggtgtctcttattgtttctttttcttttttcttaccttgttattttctaatctagtcttcagagagatggtgtctcttcttataaaggcactcatcctaacagatcagtgctgtacccttgtgacctaatttaaccttaaatacttccttagaggccccatctccaaatgcaactacactgctgtttagggctataacatgaattttggggtatacaagaattcagttaataatacttgattaccctttatctgcccctgagagggtggttcatcttacccttttttagtcaaatcacatttggtaacatgaattgaggtgggtcagctatggtggcagactcactaagagtgtcatcctcaactatcctgtattgcttgtggcatacctagacattctatggccgaaagagcttgcatgtttaaatatttctatagttttagtccttggcacatggacttgagtccatttctctgtcaaatggcgatagttgttcctcagagttgttactggtcataatttaagggaaaatatattttgaaccataagatgcaaagattgttttttataaaaatgtacaatgttcctttttctattatttgtagagcttaaggacttgaatccagatcttctaattacaagtataagactctaagtagccagacatacccatttttttcaggataattggaattctccatagacaagcactctaggggaagttctggcaagttttatttgcaccatgtaatgcattgaaataaattgtaccatctaataaattgaaatgctgtgcgtttagccctcaagctctgttaagggacagactgcctcctcaagtgggtccccggcccccgtgcctcctgatggggtgacacctcccagcaggggttgacaggcatctcatacaggagagctccagctgacatctggcgggtgctcctctgagacgaaacttccagaggaaggaacaggcagcaatctttgctgttttgcagcctcctctggtgatacccaggcaaacagggtctggagtggacctccagcaaactccagcagacttgcagcagaggggcctgactgttagaaagaaaactaacaaacagagaaaggaatagaatcaacatcaacaaaacggacatccacacaaaaaccccatccgaaggtcaccaacatcaaagaccaaaggtagataaatccatgaagatgaggaaaaaaaccaatgcagaaaggctgaaaattccctaaaccagaatgcccattctcctccaaaggatcacagttcctcaccagcaagggaacataactggttggagaatgagtttgacgaattgacagaagtgggcttcagaaaatgggttataacaaacttctccgagctaaaggagcatgttctaatccaatgcagggaagctaagaaccttgaaaaaaggttgcaggaattgctaattaaaataaccagtttaganaagaacataaatgagctgatggagctgaaaaacacagcacaagaacttcatgcagcctacacaagtgtcaatagctgaatcaagcagaagtaaggatatcagattgaatatcaacttaatgaagtaaagcatgaaggcaagaatagagaaaaaagaatgaaaaggaatgaacaaagcctccaggaaatatgggactatgtgaaaagaccaaacctgtgtttgattggtgtacctgaaagtgatggggagaatggaaccaagttggaaaacactcttcaggatgttatccagaaggacttccccaacctagcaagacaggacaacattcaaattcaggaaatacagagaacaccacaaagatactcctcgagaagagcaaccccaagacacataatcatcagattcaccaaggtggacatgacggaaaaaatgttaagggcagccagagagacaggtcagggaagcccatcagactaacagcggatctctcggcagaaaccctacaagccagaagagagtgggggccaatattcaacactcttaaagaaaagaattttcaacccagaatttcctatccaacctagctaaattccataagtgaaggagaaataaaatcctttacagacaaccagatactaagggattttgttaccaccagggctgccttacaagagctcctgaaggaaacactaaatatggaaaggaaaaactggtaccagccactgcaaaaacatacaaaattgtaaagaccatcgacactatgaagaaactgcatcaactaacaggcaaaataaccagctactgtcataataacaggatcaaattcacatgaaacaataattaaacttaaatgtaaatggactaaatgccccaattaaaagacacacactggtaaattggatagagtcaagacccattggtgtgctgtattcaggagacccatctcgtgtgcaaagacacacataggctcaaaacaaatggatggaggaatatttacaaagaaaatggaaagc

SEQ ID NO: 239363 - DNA, 539 bp, Homo sapiens
atacatgctgcaatttctatttggcatgttatttataccctcaacactcccttttccccagaagaaataccttttagtgaatagaatatattcgataaatacttattgaatgactgtcctttgaatatcattcttggaataagaaaatgttgtaaaggaatcataatggtaacatatagcttttatcttcctggagtcctctatttttttctctctggttcattttgggattacattctgtgatttgctacttattttttttaggcccctgatctttatcatgggagcctaaaatcatgttagaagtatgcattaactagtcagcaaacatttcccaagcacagaatgtcagggactggactgttggtcctgctgatacaaatgactctcaggcacacagactgatttcagctgcaggctaggagaatgttttttgttaactacatgcactttttttttgagacttgcactaaatctttttaaaaaggttatataacatttttaatgggaaatgttcctagtatttattgctatgtaaa

SEQ ID NO: 239364 - DNA, 484 bp, Homo sapiens
tcttcccaccactacaaatcattattactactactttggcaaatttccttccagattttaatgcattcaaaaaatacataattatgctaagtctttgtcttgatactgctaatccatgtatactttatataataatacatagaaaatattctatataaaacatatattgacaaggactatatactactatagagattgtatacaaaatacaactagcatgcattttatatttctacccttttcattcatcataagtaaatactctatgcacataaatgttgcatagtgttccctacagtcgattttccatcatgtagttaacaatttttttttttttagtgtagtagttaagtacgtggactctggacggttgggttcaaatgtcaacacactgattgtgtgaatgtgggcaagatgtttaatctctgtttgtctcagtctgttaatctttaaaataggtctaagagttatatgtagcctgtta

SEQ ID NO: 239365 - DNA, 2044 bp, Homo sapiens
caaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagtttgttcctcttacaccaaagtgccataccatcatcccctttagtaagatcacacttctccaatttctgtcctcctctactcctcaataaacaggaagatgctgtctgtggaaatgcacgtggagctcttgcacacgttttctataacttgtcttcattccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcatgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaaccccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactgacttcagataccccagtgtatctgaagaaagtaatcccagctacttgggaggctgaggcatgagaattgcttgaaccggggaggcagaggttgcggtgagccaagatcacgccactgcactccagcctgggcgacagaccaaaactaccgtc

SEQ ID NO: 239366 - DNA, 465 bp, Homo sapiens
gcacttacatggagctaagctagcctggtggcattacatggaggaatatagtcctagagccacaccttttacctccaaccagcaacctctgtctcccataaactcacttccatcatctggaaaatagaaataataatcatattgactgtatcatgttttcatgatggtgaaaggatactgtgtaaagaatatgcttacctcagtgcctggcacataaaaatcattagctgtcactaccactgttgctattcccattactgctactgttatttgaagaaagcagaatagtgactgtgccttttgcccaaatcttccataggagatagccagggcacggggcaagctgagctcatgggacctgggcacagggatgcaacagggctgccttcccaggtgcagaacatggagtcggggctcatacaaaaggagatcaaggaataaaaccagaatgacaagccaagcatg

SEQ ID NO: 239367 - DNA, 1078 bp, Homo sapiens
agaatctccctccgtcacccaggctggagtggagtggcgcaatctcgtctcactgcaacctccacctccaggttcaagcaattctcctgcctcagcctcccaaatagctgggattacaggtacgtgaccaggcccagctaatttttgtatttttagtagagacagggtttcaccatgttggccaggctggtcttgaactcctgacctcagatgatccgcccaccttggcctcccaaagtgctgggattacaggtgtgagccaccaacgcctagcctcagagacttctagtaacatcatatagttagtaaaggggacagctggttttcaagtaaaggtctgtttgattttttctattatagaaatcctttcccctttcttaatgtctctttggtattcttgaaaaaaacaaaagagagccaacaaataaaagtaattcctcagaatttatgctaattttgtagcaatataacttgcgcatttgactgctgcttgatttttaaaatcaaatattttcctacattgctttttaagggcaaggtgtgtcctgtgagtgtttctcactgttagactagggcagaagctcaacaataacaaaaaaggctggtgactaggaatcctaatttccttccaaccagggcatgtgataacaaagacacttttcctataatcctttgctagtcaggatgtgaactgctatgcaatctcctgttcccaaccttaactatacacatgcattaacacacacaccagatagatacacaaacatgatagtctatttcagctaagttatattcttactaacaccttaaaagctgttaaaaaagaaataatacaaatggaaatctggtaccaagatttctttatactattcatatttgactaaatatccctaatttttggtgaatactagaagaaaatattttaaataaacagtataatttatctttcagataactggaattttattatcctgaggtatataggtggtaacttatgaggtataatctaatctagagacaaaagaataaactaaatccataatttaaaaaatggcaattcacagccaggcatggtggc

SEQ ID NO: 239368 - DNA, 1024 bp, Homo sapiens
agaatctccctccgtcacccaggctggagtggagtggcgcaatctcgtctcactgcaacctccacctccaggttcaagcaattctcctgcctcagcctcccaaatagctgggattacaggtacgtgaccaggcccagctaatttttgtatttttagtagagacagggtttcaccatgttggccaggctggtcttgaactcctgacctcagatgatccgcccaccttggcctcccaaagtgctgggattacaggtgtgagccaccaacgcctagcctcagagacttctagtaacatcatatagttagtaaaggggacagctggttttcaagtaaaggtctgtttgattttttctattatagaaatcctttcccctttcttaatgtctctttggtattcttgaaaaaaacaaaagagagccaacaaataaaagtaattcctcagaatttatgctaattttgtagcaatataacttgcgcatttgactgctgcttgatttttaaaatcaaatattttcctacattgctttttaagggcaaggtgtgtcctgtgagtgtttctcactgttagactagggcagaagctcaacaataacaaaaaaggctggtgactaggaatcctaatttccttccaaccagggcatgtgataacaaagacacttttcctataatcctttgctagtcaggatgtgaactgctatgcaatctcctgttcccaaccttaactatacacatgcattaacacacacaccagatagatacacaaacatgatagtctatttcagctaagttatattcttactaacaccttaaaagctgttaaaaaagaaataatacaaatggaaattggtgaatactagaagaaaatattttaaataaacagtataatttatctttcagataactggaattttattatcctgaggtatataggtggtaacttatgaggtataatctaatctagagacaaaagaataaactaaatccataatttaaaaaatggcaattcacagccaggcatggtggc

SEQ ID NO: 239369 - DNA, 434 bp, Homo sapiens
ctaatgaattttagactgagaatctcattctcctggaactatctatcacttgagaatcagagtaattatttcctattgccctttgtggaatacagttataattgcattactgttaacggtgttcgcattaacacttaattgttaatgtcctcctaatttggaggaaatcatcacctcttcatatttcattgctagaaagagttgttaaagagaataatttgaagcttccaaatggagaaacaagaaatgatgctagaattcagaggtggaatttgtgggatgacttctctttctggtatttgtgtgtgcatgtttgttttcttttaaggtattatacgtctacttccttttgagattaagccacaatgcacagtcattcactggaaagtaacagggattcttgtgatgtggaaacagctcttgggtgcgtggta

SEQ ID NO: 239370 - DNA, 449 bp, Homo sapiens
aaatatattagttattatttattatgattcttatagctcatttatactgtacaaaattcttctgtcattttatgaagatgttacacatatacataacaaaacttagctaattagatacaaagactatagaaccaaataactcttttctaaatattttccctttaaggaggttttgcaatccagctttgctgtggttagacactgttgatgagaaaactttttttttctttcttttttttttttagacagggaatcattctgttgcccaggctgtaatgcagtggcacaatcatggttcattgcagcctcaacctcttgggctatagtcgtcctcctgcctcagtcttctgagtagctgggactatttgatgtgcactcccatgtgcggctaatttttgtatttttttttttttgtagagatgggttttcaacatgttgcctaggctggt

SEQ ID NO: 239371 - DNA, 446 bp, Homo sapiens
cagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttagga

SEQ ID NO: 239372 - DNA, 335 bp, Homo sapiens
tgtgtctttatttctacgatcccttgtctcctcacatgaggagaaaaacccacaggcccagtaggactggaccctacactttctctggtaactccttgagtagcttaataatcaaccttctgaattctttatctggcaattcagaggtttcctcttggtttggttccattgctagagagctagtgtgatcttttaggggtgtcaaagaaccttgttttttcatattaccagaatcacttttcttgttccttctcatttgggaggattatttcaggtgaaaaatctggaactcaagggctgctgttcaggttcttttgttccaccaggtgatccct

SEQ ID NO: 239373 - DNA, 433 bp, Homo sapiens
ctgttataattttcattttacagaagaggaaactcaggcacagagaggtcaagaaaaatgcccaaggacacacagctagtaagtgaagagaaagagtttgaacccaaagcagtctagagcagggcctgtgctctgggccagcacatggggtcaggtcccgttagcgcccttattggctgccagaccattctttcacctgacactttcttcactggaatgtgattgctgctctatgtctctgcctccctgagtgccttgagggctggaactggttttatttatctccgaatccctagaacctaactcagtgctgagcccagaaaaggttccaaataaatgtttctcagtgaatgtgtttctaacccataagtgcctcatacatacattgctagtctaaagagcttttcttttctgatggaattttactgcatga

SEQ ID NO: 239374 - DNA, 428 bp, Homo sapiens
gaaaccagagcacaggaatgctgagtcacacttgcacggtttctcagccagcaggtggtagagtgagcccaatgcctggaccctcagcacctaccagcaggtgcctggcagagaagaggtattcactaagcatttgctaatgaacaagaggaagcagactcttagggaaggaatgaggggtgtgttctgtactgagtttactacttcctgaatgctggggaccaccacttgctacccaatcccaaggtgacaccagacacacccaagggtcttatgagggttgctaggatctactgcatgtctgtaatgtttaactgttttatgaacatggcattgttcttgtaattagaaaagggaaagacatttgttttatgtcaagggatttctcagataaaataggagaaggacattccaataagcaggaacaa

SEQ ID NO: 239375 - DNA, 419 bp, Homo sapiens
ggtttgaaggggaccttttttctgatctgctgttgtaaaaccacagcagctgtggggacaagggtaactctatttcagatgctaatccaccatgtgactcctgactaacctcgagtctgggaatgcctccaagatgtctagttgatgtattattctttatgtagaaatctctgtttactgtaagttttgccttccctcctaatcaacccttgatgttgttgcacacatcataggccatgacaccctcagcattctttcagctatctacacattccttccggagcatgtagacttccctcccgatacataagccatgggtctcaggggttgcagtacacagatctgcctgtctcgtggccatagaagactacacttctgtgtgtaagttccctaataaatcaccctttactgacaaactg

SEQ ID NO: 239376 - DNA, 363 bp, Homo sapiens
cagacatttaggaatgtccaaaagcatcacagacatccaggaaaatatggcctcaccaaatgtactaaatgaggcaccagtgatcaatcctagagtgacagagatatgtgaccttccagactgagaattcaatatacatatatttttttggaaactcagtaaactacaataaaacagaaggaaataaggattctttcagagaactgtaaaaaagtttgaaataattatcaaaaactaaacaaatcttggagctaaaaattcagttgaccatcagaaaaatgcctctatgtctcaacagcagaattgatcaaacagaagagaaaattaatgagctcaggctatttaaaaatacacagaggagag

SEQ ID NO: 239377 - DNA, 220 bp, Homo sapiens
gagatcacaccattgcactccagcctgggcgacagagtgagactcgatctaaaaaaaaaaaaaaaaaattgggaaaaaagtttgatcttaccagtttcaaaatacaaaacgcaaaaccttagggtatatcgaggttaggggtcccaatgatcccaacaggatgtaagcatagtactcaacaggtgctttttcaacccatgcccctctgtccgtctccccc

SEQ ID NO: 239378 - DNA, 179 bp, Homo sapiens
acttgcctccagtatgaggcttctaacacttgggttaccttggcctgtctctgtgtctatgtctgcctggaaaatgacctgcaggcccccagggactgtgttgtttgtttaaggctataaccctgggggcctggccaaaaaacgtacgcattaataaacaaaatgaataaatggataaa

SEQ ID NO: 239379 - DNA, 891 bp, Homo sapiens
tgctgacagttaatcttattcaggccgtattctcatgaggtcatagatctatattaagtttttttacaaagaacaaagatcctggcacactgtaggccaaacaaacgttttctaaatgaagtgttgccttattaacaacctagcttgtaggttgggaagtttttagattcaagggacaaagtagcaaaaatgtgccctctccctcaccctcaccttctccctctccctctctctctcccgtctccgtcgtctctgtctcctgctttccacggtctccccctctccctcgtctccgtctcccgctttccacggtctccctctgttgccgagatcgcactgtgtacccagcctgggccacagtgcaagactccatctcaaaaaaaaaagaaaagaaaaagcctgtttaatgccaacaggtgtgagtggattgcttatggctatgagataggttgatctcgcccttaccccggggtctggtgtatgctgtgctattcctcagcagtatggctctgacatctcttagatgtcccaacttcagctgttgggagatggtgatattttcaaccctatttcctaaacatctgtctggggttcctttatcttgaatgtcttatgctccaacatattcgcgttgttgaagcctcttctaccataagaagctacctccaatgtattggattaccacttgaacacagtcgtgttgggtgggctggatggcgactgacgattgcatcgtccatgcccatataacactttctacctttaacagttctctcgtccgacattatgtgttatggttcgcaaggcgggttggacagccaatactgtccagttttgcacttgctggccccatttggctacatcgattcaatcaaaacaggagtacattcc

SEQ ID NO: 239380 - DNA, 464 bp, Homo sapiens
caggtttataatatgtagaattagagagttagaccatcaagattccttccaggttttagtgtctctgtcagtatgatcttagagataggcctaattgtcatattttggaacttggccccagtgcattagtgagagcctgcaaagtggggtataggtaatgacatatagtagtagggtaatagaatgtcttaagagtaaatagttggccaggcacagtggctcacacctgtaatcctagcactttgggaggccaaggtgggtggatcacgaggtcaggagttcaagaccagccaagccaagatggtgaaaccccatccctactaaaaatacaaaaattagccaggcatggtgttgcgcctataatcccagctactcaggtggctgaggcagagaactgcttgaactgaggaggcagtcacaccactgcactccagcctgagcgacagaacgagactctgtctcaa

SEQ ID NO: 239381 - DNA, 1603 bp, Homo sapiens
  misc_feature (91)..(91): n is a, c, g, or t
  misc_feature (317)..(317): n is a, c, g, or t
  misc_feature (329)..(329): n is a, c, g, or t
  misc_feature (407)..(407): n is a, c, g, or t
  misc_feature (763)..(763): n is a, c, g, or t
  misc_feature (1078)..(1078): n is a, c, g, or t
  misc_feature (1101)..(1101): n is a, c, g, or t
aggatttaaaatgaatgaaagaaggtagaatcattactttttagtggataatttactgacaggtctcatgtgcaagcaccaacagtaccantgatgtattccatttatgctggcacagctgaagccctctgattgcttttctcacctagacatggctctcattaatcaagggaagttgcatagactagaacaagaagacagttttgtcgacacacttccagcactgttctctagcagcatttcgttcctgttccggtatcattgctctcagaagcagaagccctttcatttagttagaaattagcagtagatacctnctctctgaaccntctctgattttgagtgttgagttccagaaattcattttgaattcagttgtttggcatttctggtacagattttcctgnaggaacaatttaaagaaagtgcattaagtcctcctgctagcctatccaaagtctgtttgacttatatgacattgaactatctatgattgaactatccatgataacacagtgtactatccatgataacacagtgtactatccatgatttctagaatattacattcttttaaaaagaagagatgtgttcagtgtacactgattgagccaggcatggtggtggaatgagaaatacaatctatttagtgaaatggaaaattgcaggacaagagagaaatgtaagtcccagatgtgcacagagcactttgctatggaaaccacagagaaggggcatccacctcagcctggctccaggttcnaaatggagagactatgagcattttcagctgcactctcatagaagagaggaacaatccttcagaccaggggaagacagaaaaggagactggccagaagaacacctgggagggagcacagagctcttcattcccaggggttctttatagcatggacatttacagtgtaggtactgcccaaatgcccatccacaccagtgttagggactgaattttgtttatttcatttatcaagatataatagttttgagtcatcagttgtatttctatagcctataaaaagagcaccaggcaaggcagggcccaccaccgctgcanccacacccagagtcttccccatnctgtactgtggactccacatcagacctgggaggcaggactcagtggatgaggctgtgttttgcatttctgagtacagtccacaaaatggtttgcttctgaaaaagcagtagtagtcttacatccaagattattcctaaaataaagtttcgacccacatatataatgaaattgaaactgcctacattggcaaagccagaaagagagtaaaaaagatggggtaggccagttgcggtggctcatgcctgtaatcccagtactttgggaggctgaggcgggtggatgacttgaggtcaggagttcaagaccagcctggccaacatagtgaaaccctgtctctaccaaaaatacaaaaattagctgggcatggtggcgtatgcctgtagtcccaactgcttgggaggctggggcaggaaaatcacttgaacccagaaggcagaggttgcagtgagcctagatcgcaccactgcactccagcctgggtgacagagcgagactgtcttt

SEQ ID NO: 239382 - DNA, 431 bp, Homo sapiens
attgggtcttggtttatttttgtcaaaatccaattttcactcacttttgcctttcactcacttcctcttctagctaggttcagttactttttcatgtgaggccgcatggagtaggccagtggttctcagactttaataggcattagcatcacctgaagtgcctgttaaaacacagatttttctgattccatagttctgggattaggcccaagaatttgcatttctaacaagtcccaggtgatgctgaagctggtcccagggattacactgcaaaccactggtatagaccaatgcttctcaaactctgattatttaataaactcttattaaataatcttatctgattaatatctgattaataacttatctgattaattttagctgattaataactcttatctgattaaaataaactcattcttatcaaacgt

SEQ ID NO: 239383 - DNA, 371 bp, Homo sapiens
cttagggaatgaatctgcagtccttaacctgggattgttcctgagaatttctgttcagtatggaaattttgacctgctccgtttccgacctgagttggttcacccctccttagaaaaccgagtggtccccgctccaggaaggtcaccatattgatgccaaacttagtgttgccacccgatcagcataatacactacagcctagaactcctggggtcaagaaatcctcctgcctcagtctcctgagtagctgggactacaggcatgtgccaccccgcctggatgttctgcagtatttccaaccagcgctgagaaatctctcattcctaccgaggccacagcggacccctgggcccctctaggaaccgtgctt

SEQ ID NO: 239384 - DNA, 352 bp, Homo sapiens
aaactatggagactataaaaagatcagtggttgtcaggggttgaggggagggagggataattagggagaacacaggatttttagggcagtgaaaccactctgtgatactataatagtggatacatgtcattgcacattcatcaaaacccttgaaagtacaacaccaagagtgaggtctaatgtaacatatggactttgagtgataatgatgtgccagtgtaggttcgtctgtacctttttagtgtggcatgatgataatggaggttacgcatgtgtgggagcaaagagtatatggaaatctctttccttgcaattttgctatgaccctaaaactgttctaaataaagtcaag

SEQ ID NO: 239385 - DNA, 448 bp, Homo sapiens
gatccagtgatagaatttaggagacttagaggtgtgaatggactatgtacctctcagattatccttcagaataacaatagctcagaacgtggagatgaggcagcaggtgtgcccacggtgctgtgttggccattgggtgttacagtaagaagcagacccgcgtcttcgacagtcgtcttgggaaggatgagctcaccaagtctggggtgacagtcagggaacctggccctgtggcccctctcctacactgcggtgggccaagggacagctctcagacaccccaggcttccttggggcactgtttgggatcccctgacatatgggctgttaggagaccaaggctgcagcattccctgccagagagcgaggctggaggaatcttagcctggaaaagttttaaaggagttgtctgtggtgggctttaaaaaagcaaatgaaaaacaatagc

SEQ ID NO: 239386 - DNA, 535 bp, Homo sapiens
tcatgggttggaagactcaatattgctaagaagtcagttctctgcaaaatctatagattcatcagaatcacaaaagtgggcttttttgtagacatgggcaagctgatttcaaaatttatatggaaatgtaaaggaccttagcatagccaaaacaatggaaaaagtacaactttagagggcccatacttaatttttatctaattcaagacttaacaaagctttatgctatagtttggatatagtttgtttgaccccttccaaatctgatgttgaaatttggtttccagtgttggagatgggtcctaatgggaggtgtttgggtcatgaaggtagatcctatgtgaatagattaatccccctctctcttgctttcttgcttgccatgtgatctctgtacagctggctcccctttgccttctgccatgagtggaagcagcctgaagctctcaccagaagcaaatactgacaccatgcttcttgtatagcctgcagaatcatgagccaaataaacctttttataaaaaataaattacca

SEQ ID NO: 239387 - DNA, 302 bp, Homo sapiens
tctaatcagctccttggctggctcgggctgacaaaacattattgttctcttaacctttgccaagctgaggaactttacaagcattttttcagtaacagccagagtgatttatgggtttttctccctctagctctccgtggttagaaaaacaaattttatttctcagtctcattccttcctccccattattcccagttctctactgtctttagccataatccttctttatttaatgcaaatattactttattttgcatagtttttaagtatgtctgtgtctaatgttctttaattatggagac

SEQ ID NO: 239388 - DNA, 201 bp, Homo sapiens
ggagagagaggatctggctgttacccagtctggtctccaactcctggcccaggggatcctcccaccccagcctctcaaaatacttaggattacaggcatgagccaccgcacccagccccatatcttaagtgttagtgttactagggtaccgtctcgggcccccacctcctatcatctcatctccctccaggaagtcaaacc

SEQ ID NO: 239389 - DNA, 499 bp, Homo sapiens
tgcttctcttacgcacagcacagcagatccacagcacttacatgaagacggggaccttgcgtattacagaattgtggggtcccctctcccctgaatcaagactagttactagctctcatcttttattgttattcctgtcagatacacttggaggttctgaatcttaattctagtctagaacttaactcatttctaacaaacctggatgaaccctgtttcccctaggacttttaaaattgtaacagtatcttcacctttgtttaccaaacaagatgagacctttcctttgggaaagctttcttttttcttttttctccaaaagcagatacttaatgggaaagcttttattccccttgcctgcctctgggttttgttgaaataatatggaagtttaatttctggatgattaattttgttttactttttgtgccttccattttataaatcctttcttaataattcacaaccatattatcagtaataaacaaattttaccagc

SEQ ID NO: 239390 - DNA, 440 bp, Homo sapiens
atttataaatataagtaatgtaaacatgaaatcccattttagaggcttgggttaaaagctactgcttgatatatattgattattaaaggaaataaaactaatttgtaaatttaggaatataaaaagcattggaccaggattatataaaagccaggtttgaactgggttctatataggtttccatctgccatatctagcagtttgacctgaagcaagctctttaatctctggatatcagtttcctcaaccataaaatatgaatacattggactagatgatctctaagatctcttccaacctttatgttctttgactatactctatcctttaatatcttgctttttcataatttttccaaaaacacatatttgtctttcagtaataattcattttgattctagccagctttgtcctgggctaggtttaaaaaaaaagaaatt

SEQ ID NO: 239391 - DNA, 2213 bp, Homo sapiens
  misc_feature (1)..(1): n is a, c, g, or t
  misc_feature (4)..(4): n is a, c, g, or t
  misc_feature (39)..(39): n is a, c, g, or t
  misc_feature (414)..(414): n is a, c, g, or t
  misc_feature (1958)..(1958): n is a, c, g, or t
  misc_feature (2091)..(2091): n is a, c, g, or t
  misc_feature (2097)..(2097): n is a, c, g, or t
ntgntttctaatatccagggaaggagagtatgatattantcccaatatcacagggggtgtacacctttttgtgacattgagtctaatatccagggaaacagaggatgatattactcccaatgtcgcagagggtagacacccccctgggatattgttcctaatatcccaatggagagaggatgatattactcccaatatcaaaggaaatgtacaccacccctgcgatattgttcctaatatccagagaagaaaagaatgatattactcccaacagcgtaggaaatgtatacccgtgctgtgatatttttcccaatatctggggtgggggggaagaggatcatattacttccaatatcgcagggtgtgtacaccccctctgtgatcttgttgctaacatccaggtttagggaggangacattactcccaatatcgcagggggagtacaccccccgtgacctagttagtaatttcctgggtggagaggatgatattactcccaatatcgcagggggtgtacacagccctgtgatattgctcctaatatccagagccaaagaggatgatatgactcttagtatcgcagagggtgtacacccctcctgtaatattgttcttaataccctgggagggagaggataagattacattgaatatcgcagggaatgtacaccctccccctctgagacccttcctaatatccaggggaagagaggataattttgctcccaatagcccagaggcagtacacctcccctgtgatattgttcctaatatccaacgggggagaggatgatacttctcccaatatcgcaggggtgttcacatccccagttacatttttcctaatatctaggggagagacaattatatgacagcaaatgtctcagggtctgtacatcccttcctgatattgttcctcatatccaggggggaagaggatgatgtcaaatatcaaagggggtgtacaccccccaccacgatattgttcttaatattcatgaggggaacgatgatgttactctgaatgtcgcaggggtttttcacaccccctgtgatattgttgctgatatccacagtgggagaaaataatattacttccaatattgcaggtggtgtataccccacctgaaatattgcactgaaaatccaaagagggagaggataacattccctcaaatttggcaggtggtttgacgccccttgtggaattgtttttaatatccagcggggaagacagtaataccattttggatagtccgatttatccgccccacctttccggaactctgagaccaggaggcggcatgcggtttccatgtgatccccgatacctttgccatcttctgtactgtcagccacaaacgcaggcccgttatctgagctgatccgtaagggcagtcccaatctaggaatcagatctcgaagaagcagacgggttacttcaggagctttctcagttcgtgttggataagcctccacccacccagagtaggtacgcccaagaactagtaaatacttgttacctccacactttggcatctctgtgaagtctacctggagatcttcaaagggggctgctccataagcttgtatgccgggcggaacggctggcacttgcctcgcattacgctgtcggcagataacacaccgctgcgtcaccgttttggcaagtgctgacaaatgcgagacgtagaaataccggcctaacaacttttccagttgactcctgacctacatggcattcgaaacatgagtatacagaagtctttggtaattcaggatcactgatgagtaaaacaagataggagttgaagcttatctttgtttaaaaaatcctttggtcttgggataacaagataatgtaaatatggcttaaaggagaatcatttcaaaaacaaagcaaaacaaggaaatgaaaaataaaatttatggcctggcacagcggctcacgcctgtngtcccagcactttgggaggccaaggcgggcagatcacgaggttaggagatcgagaccagcctgaccaacatggtgaaaccccgtctctactaaaaatacaaaaattagccaggtgtggtggcaagggcctatnatcccngctacttgggagcctgaggcaggagaattgcttgaacccgggaggcagaggttgcagtgagctgggatcgccccactgcacactccagcctgggcagcggagtgagactccgcctg

SEQ ID NO: 239392 - DNA, 2352 bp, Homo sapiens
  misc_feature (199)..(199): n is a, c, g, or t
  misc_feature (2346)..(2346): n is a, c, g, or t
atttttcacattagggtcactaaggtaagcaagtagaactaacatattctttgaagcttccacaagttcgtcattgatcttctgctggaagcaacacagtgtaagtctaagctttctttgaaatgatagactttcaaatctttcaggtgagttatatttctgtagtagctaggctctttttcaggcccctcttctctanttctgcccacatttacccccaggtttctcaaatattacttaaaactatagttattttattcttacattatttaacacaagcaactatattccatctgatctgtggctttgaagataaaaaggtctaagagagacaatcttcagtgcttcgttatctatgctgcatatggacagagttccaagtcctttgccatttcagttgtgttctcagtggcctctggattgtcaatgatgttcttaaaatgtgttatccaggactgagaaaacagtacatgagacctgaccttgtgctcaacttatatttctattaaaatagtggttgagcctgtaggccatgaaatcagatgactggtttcaaattcaggctcagttattttccagctatctgatcttaagcaagttacttgttactgcctcagtttcttcattttagaaggaatgaaatgtgactgtctatcttaagaaatcattgtgatgattatatgttaccaccacatggacccatctgttccagtttgtacttggagcctttccttctctgccattatgaagaatgaatggtccaaggctaagcttccatttttggctccttttgttaattctgccttttcttcctaactctaaatgttgaaatacttctcctttttcttgacattggacctcatctccattttatctatgctctcttccttggtgaaataatacagtcaccaaggccattatatactaattactccaaatctaggtctccctcttagacctcaaacttctgcaactgccaatcaacctctccacttacacgtctacaggcatttcaaaaataacatttccaaaacagagatctttagtttatctccagaagtattttgtctacagttttcctcaagtctgttctttcagttccttgggtcaaaaaccttataaacatactgactactctatttttttcacaacccacatctaaactatgagcaaatcaatcagtgcactaatttctacctctctcaataactgtgtccttctataatgtgttaattatctttgttttaataaattctaaatcatgcttgccttaaccattctagatgaaatgcaattttcattacctatcatatagaagttgaatagttctgttttctgactctgctcgttcataatacaccacctgaactaagtaatgggtataatatacccaaatacatttggactcttcaatatggtcctattgaagaggcacaaaagaattcatttgtgtgctccctttgctaatggtattttcaacgttcatttagaaatgcatttatagttattttatgaacaatataagaaaaattagttgtgtacaagttatgcacctaatttttgactaaaaatgttatccattaatttatttttctactcttacttatttccaataatcaccttcagtgtaacaatttgctaccaccttgaatatttaaacaagtggccaagagttcaaagggaatttctacagcagggttgtgaacatattttaagtgcagcagtactgacagactaagcatatagctttctgagggaaatattgtgaagagacaacattcatgtgtgtatctgtaggttggcccacagtgaaaaagtattatccataatactgcacacatatttctcatatctcaatgcactttatactcttaggaggaaatcccctactcatgggctgttgaagaaccttaatcattagaattaataattttcgtgcaagtagttttattttcatataaggttccagtttcatataaggggttaactttctccttaaaatctagtaaacctgactacataaaagccaaagccatcagggagatagtgttaagagtagacactttctaagttgagatttaaaaataagtaaataaccacttaccatttgcttaatatgtgctaactatagtgtgcattgtaggaaaaagaaatacaaggaacagactcttttaaaaaagattacagggctgggggtgatgattcatgcttgtaatcccagcatctggggaggccaaggcagaggattgcttgaggccaggagtttgagacaagcctgagcaacataggaagacctcatttctattagaaagaagaaagagaagaaagagagaaagaaagaaaganagagag

SEQ ID NO: 239393 - DNA, 393 bp, Homo sapiens
ctgcttggcttcctcccagctgtaaagtggcttatatgccagatctcgctgagccttcttgtaagagaaggtgaacatgctatttgacaatgtcactgtgtggcagtcgaagggcggttgataggtgcaaactggcctgagcaggaggctcactattcccagcaggaagccaatccagtacatcaggaataaaagaaggcttcatctggaatcaaggcaggggccgaactctttgctcaggatgtaattaaggttatcataactttggtgaggcgtgtcatctgagatatagtagaactgtcctaggacacttggggccttcttggggtcccgcaaggccctcaaggccagaatgtgggcccaggccacgttgccaacatagactgggttggc

SEQ ID NO: 239394 - DNA, 511 bp, Homo sapiens
caactcaggtcacttctggtacatgcccatgttagacaaaaagaaaatataacctcagcccatcataagaggccagttaacttatagttctgtaactagaaattttctgacaaagtaaaccaaaaaggacaattgtataattgcgaccaatcatatagtttattcatcttgcttctatatccaccccatatatacttgcctctgacactgtcgttggaacactaaatttagtttgctgtttctcagttcatgaatggctgcttactcaaataaactctttaaaatttgttcctcagatgtttcttttacagtatattaagatgttattactacaccatacacgtgcttgcatcctatgaagatcctccaggtagaggcttaaaaatatttaaggctttgttgaacactctcaagcatttcataaattattgataacccactataccaaccaccaagtcattatttgtaaagacaaataaaataatatgtgtggcaaaattgcacaatatag

SEQ ID NO: 239395 - DNA, 398 bp, Homo sapiens
cattgagaagaaaaccctatcgtgatattcatgttgtctgaatgaataaatcagtcagcaaaggcagcctctcacctccactcaatagaatagtgccagtaggacttactaaatcatccaatgagagaaaaagagcaagggtcttagtgccaaatatccaagaaaattaggaattgtaggaaacttaaatagcacttaaagaatcagaatttatagtttacttagaagcacacagatagaagcgtgcaaaacaagtttcgcaataagattccattgccagaatcccaaaataaagtccccaatggaaggaaactaagaaatccaaacttcttgtctcacaattgttacctaggctgggcctcagcgtaatccaactgaacttaatttttacgtcatca

SEQ ID NO: 239396 - DNA, 425 bp, Homo sapiens
ccgggctgggcaggcaagggggcttctgcttgtaatcctgtcacttttggaggccaaaagtgaaggatcacttgagcccaggagtttttgcctgaagaacatgtttctagaaaaaaaatagaaaattagctgggtgtggtggagcagcagtgttgtgggagagtgatctgtcaagacactgtcgatgttttttttttttttgagacagtgtctcactctcgtccaggctggagtacagtggcatgatctcggctcactgccatctctgccttcccggttcaagcaattttcccaccgcagctacttgggaggctgaggcaggagaatcactggaacccaggaggcggaggtttcaatgagccgacattgtgccactgcactccagcctggacaaccgagcgcgactccgtctcaaaaaaaaaaaa

SEQ ID NO: 239397 - DNA, 449 bp, Homo sapiens
cacttacctccaatttgttgtcagagggtttaacttaaattcacagtcactttgtaaagttgtaacatttttctatggctgataaaagagaagcctttgagttgtggttattattattttcctttatgtagcttacaagctatgacaaattggtaaagactgtctggattgctgagacatgaagaattcagaggacatttccaatctgggagaaataattccaggaaagactgtgatgtctattgttggctcaaagggagaactttgagtatacatgccacatatttaccatttttaccttaaatttctcacaaatatttagttttaaatgttttattcaataatacaatattattacaagaatctagatgagaagtgagcaaactataacctgtgggccaattccagacactctatgtttttgtaaataaaattttattgaatgtagt

SEQ ID NO: 239398 - DNA, 382 bp, Homo sapiens
ctgtctcctcagggctgtggctcccaaagcggcatgggtgctgctggcctaggtcctagggaatacaaagggctgcgctttcccttctccggcagtgactggggaagcagggccagagccaggcccaccgtatccagccgagagctgtggtggggctcccctcttttcaaaagatgctggaaaagggccgttgcctgggaggaattgtagtgcatgtgaactcatggccaggcagccagacagagtggatgcagccctgcagccagagctaacccaagcagcctcccagtgcagtgacgcagactgcaaccttgcagtcttccatgaggcagcagctccagactgtcccgacttgaccactcagtggggagggggaggcagg

SEQ ID NO: 239399 - DNA, 1630 bp, Homo sapiens
  misc_feature (942)..(942): n is a, c, g, or t
ttgaacattcctttagtttccagcttcataatttggttcttattaaaataattctagaattttcatgttttttttaaccagctctctaaattgtgttacatgcacataaaatatgccattttaaccattttcaggtgtgtggttcagtggccttgggtacagacccagtgttacacagccaccaccaccaccatcatctccagagcctttttatcttcccaaactgaagctctgcccccattaaacactcactccccaccccgctcccccagcagggttagatcgcagaggggcctgccgggggctctgaggtgatggaaaccatctgagactgccatggcgatgatcgagaaagtctgtgaatttacggaaaattattgcattatatacataaaagaggtgtgtgtaaactgtgccataataaagcctaaaaattagaagcatgcttgtaacttagtgtatttaaataggtaattcgttcagtcctgaggttagtattattgaaaaggtttaattttgttctcatctctgccgctgtctgtagtgacctatagagaaccactgtgatcacctcctgtatgtatgcaaatctgagcaaacgtaaacatattttcttcttgttttccttccacaatcccccccactcccacccccgcccatgtgtgtctgcgttttcccgcaggtgcatgcaggcccgcgttcatctgtgcagcccttcctgctgccctgcgggccccatgcactgcagaccccgctgcctcagacctgtgcctgcgtggctggcacacctgttccctgagtcggagacggcggctgcctgttgagggcagggtgcgtccgctgcttatagagacgtgaagcccaccatggccattctgttggcgtgcgtttgtcaccagctgtgttcccgtatagaaacgtttctcgtctttggggggcttnttcccattaagctcttttcttaaagccctgaatactaatctagctatgccagctttctgttggtgaatacttgtgtgatatttctgttcttaaaatgtcttaaatgtgacactgtttacaacgtagagctaggttttttaaaaaaatcaaacttttttagctggcacgttaccttacacattccacgattttccatggaggatgtgagttggttcctgctttatttttttattttgctcttttcgtcagttttttcctaatgcttccttcctccctgttgtctagtgaattagtaactttctttaatctctttctttcttcctctggtttgcaaggtataagctctacttctgttatactagtggttacaaaatgtataaactatttacatttttagaaatccaaagttggcccggcgcggtggctcacgcctgtaatcctagcactttgggaagccgaggtgggcagatcacgaggtcaggagatcaagaccattctggccaacttggtgaaaccccgtctctactaaaatacaaaaaaattagccgggcatgatggtgcgcgcctgtagtcccagctactcgggaggctgaggcagcggaatcgcttgaacccaggaggcggaggttgcagtgagccgagatcgtgccacggcatccagcctggctacagagggagactctgtctc

SEQ ID NO: 239400 - DNA, 264 bp, Homo sapiens
tatatgaaaacagtactatggcgtgtgaaccaatttactaaacaaatagcagctgtagtaaaacatctgtttgggaaagaggaaatataaactcataaaatcaaatgaaggcaatgtgatctgtactttcacaatatgagaaaactagacatatggagcagtttgcaaaagattatcaatcattctattaaaaaaaaacaaagtgtgaaacaggtaacattatgatcttcacacaacacattagccagtatctgagtaagattt

SEQ ID NO: 239401 - DNA, 510 bp, Homo sapiens
aggagcgctaagtgaacaaggatgctacatgcaggatccacttgtgtccattgatctctcagagtggctgaggatcataggtttcttcttgaagggctcaaggaatgaagcatcccacaaaatgatcctgctgaataattgccagatgctgctggccctgtacgaatccctggccgtgagcattcctgagtccctgaaggtcttcaagaaagtttaggtgaggggataagagcagctgcattttcaaagtcagtgaaggtagagcattcaagagcattcctctgtattatggaagatatcctgaagctcaatgcctgcaataaaagcaagcttggaagtagggatgagataggccacccagatgatgaatttgagaggtacaaaaacaggtgcttatcatttataattgctattccttgtacttttttgtaattcacattaatcagttttggaataaagagaggatgaattcctttcttgtgatgaataaaggttgtcaatggtcaaaat

SEQ ID NO: 239402 - DNA, 1517 bp, Homo sapiens
tgtctgcagaagtgtggcacattttgcctagaatgacagaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccgctaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcgctttgggaggccaaggcgggtggatcacaaggtcaggagttcaggaccagcctgaccaatatgatggaaccccatctctactaaaaatacaagaattagccgggcgtggtggtgtgcgcctgtagtcccagctgctcgggaggctgagtcaggagaattgcttgagcctgggaggcagaggttgcagtgagccaagatcgcgctcttggctgcgatccagactgcactccagcctgggtgacagagcaagactctgtctc

SEQ ID NO: 239403 - DNA, 469 bp, Homo sapiens
aaaacaaaatgtcagttcctcaaaaatgatatacttggtctatcttccactttctcttctcttaaaaccaaaggtctcttagcacaggtgctgcccctggaattcccagaacatcaacatcagctcccgtcctcatcaaagggtggaaaaaaggaaagcttgaaccagcttgggaaggaccttatctagtgctcctggccactgaaactgcatccgaacagcaaaaaaaggatgaactcatcatactcgagtgaaaaaacatcaccacctccggagtcacgggctactgttccaggggaaagtgctacctaactaaagctaagaaaaacccaaccctcctcatgaagaggagaccctgaaggatctccaaaaccaaagaaagttagcctctatcaataagtacctttgcccctccaaaataaacaaaactgcctataataataaaacttgtaccagatgtgcacaaagc

SEQ ID NO: 239404 - DNA, 161 bp, Homo sapiens
gcatgtgaatgtcctattgctctagcaacatatcttgaaaagactatctttccaccagtattccctttgtctttttgtcaaacatcagttgactgtgcgggtctatttcagggctctctattctgttccactgatctatttgtcccttctgtcgtcttctc

SEQ ID NO: 239405 - DNA, 464 bp, Homo sapiens
ttttttttttttttgagacggagtctcgctctgtcgcccaggctggagtgcagtggcacatctcggctcactgcaagctccacctcctgggttcacgccattctcatgcctcagcctcccgaacagctgggactacaggtgcccgccatcacgcctgggtaatttttttgtatttttagtagagacggggtttcactgcgttagccacgatggtctcgatctcctgacctcgtgatctgtccgcctcagcctcccaaagtgctgggattacaagggtgagtcactgcaccgggcccaaaattatctagatttataactcaattcaataatttaaaatttaaaaatacataaatatctattttgaatgagtagaatttgtgtggagcaggagttgttttttgttactaaatcacttcaaataacttgtttgggttttttactttctggaagatttcagttagcca

SEQ ID NO: 239406 - DNA, 376 bp, Homo sapiens
tgcaagaagtgtgtacactagacattaacagtagtcagaagtttttaaaaaatagtaggacaaaagaagaaaagggtgaggccaggcatggtggctcatgcctgtaatcccagcaatttgggaggccgaggcaggctgatcacctgaagtcaggagtttgagactcgcccggccaatatcgtgaaacctcgtctcctcaaaaattacaaaaaaaattagccgggcatggtggcacatgcctgtaatcccagctacttaggaggctgaggcaggagaatcgcttgaacccgggaaatggaggttgcaatgagccgagatcacaccactgcactacagcctaggtgacagagtgagactgtgtctcaaaaaaaaagaa

SEQ ID NO: 239407 - DNA, 195 bp, Homo sapiens
tgcactgcagcctggcagccccctggcaaatgcaggagaacagctcctcacctgactcaataaaggcagcactgggcagggtcaattcaccaggaagttgaaaggtgatcaaaccacactgagatgacaggaaacctttggcctgcttgctaactttctaatatcatcaaagataaatctaattttgtcgcagga

SEQ ID NO: 239408 - DNA, 598 bp, Homo sapiens
gttttcagagtagatgaaagcagggtgtcttagtaatcttcatcatggcaaacaaaggtgagaagctgatatgatagagaaaatctatggtaacttgatattttaaggtaatttgagtgtgctgaccccactatgcttaattcctttcccacaatctattttaaactacactttgattctcttgagacttacagcatgcatgtgtgggtatgagcagacaagcagacttacctttggagggtgaagacccagacaaactgaagaaacggattcctgaggatgatcaaatacaaatcatttttccagaatcactcaatattgccacatcccaaactaattctagactaatctttagaaagaagtaagctccttaagaaatcctactatgaatgttttttcttcttatggaataacacaagaagaggtacaatgcagactcttaattttgctgtaataattcacttttgtatttaataattgtacttctgtgtgagtgtgtcactgagctatttgtaccaattttcaattgatcattctgagaggggccttgagaatttctgtgtatgtgtatgtatatctgtatttatgtgtagtcaga

SEQ ID NO: 239409 - DNA, 365 bp, Homo sapiens
tcttctttaattaaattcaaggtttgcatttgttcaagaatactacaaaagtaatgtggtgtacttctcagtgtatcacattaggagggatttgacgttggtctgtcccattactgtcccattactttaatcacgtggttaaagtagtacctctcaagtttctcctctgcaaatttgctatttttcctttgtaataaataagtatcttgtgggggcaatactttaatattatataattatcctctttgtcatcacactttgacccactaagcttagcatccattgatgattcttgactaaagtaaattactgctgtgatatttgccagatggtaattgtctatttccatcattttatgttattta

SEQ ID NO: 239410 - DNA, 281 bp, Homo sapiens
tagctgcttgggaggctgaggtggaaggattgcttgagcccagaacttcaaggctgcagtgaaacatgattatgccattgtactccatcctgtttctaccaaaaaaaaaaagtttattgtacaacttggattataatatgaatttaattactaagaaaactatttgggggccaggcgtggtgtctcatgcctgtaatcccaacactttgggaggccgttgagcccgttgagccccagagttcaagaccagcctgggtgacatggcaaaaccgtgtctctac

SEQ ID NO: 239411 - DNA, 747 bp, Homo sapiens
aacatgttccattggatgagaaaacacagaaataactttatatttataaattctaatttaatagtacaagcactgtcaagtgtgtcacagaatgtttctaataatgttaagaaactaaaattttcagtgtcagaaaattaatttgcatcttcaaatcactctaacataatagattgagaatagattattttattgcttattatgctagcatttctataatgtggttccaatttttattgtcttttagtctttaatattctgtaataaaactataattctgaagatctaacaactactaagatctcacaacttctgcactatgataatgtatgtttgagtagcatctttgaagcaataacagaagatattttttcagtacagaatgccgcatttttaaataaaatatttaaataatctgttttgcataaaatatacaaaaggaaagttatacagcaaagacttgactatgtggactccacccaggacagttcctattaaaaaagtgaaaatctgtcaataaatgacaacgaatccatttctacaatctatttctgcaataaactaccaactgtttaacaagaataaaacatatttccaaatgctgaagaaaaaagaaatcacaattgttttaaatcattgagttcaaatttcctcaaagaaagcatacactctatttttccaatacgaaagaaaaactttttctcatcatacattagttcaaaatgtggttattttaaaggaagctgc

SEQ ID NO: 239412 - DNA, 605 bp, Homo sapiens
caagtgattctcctgcctcagcctcccaagtagctgggattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctca

SEQ ID NO: 239413 - DNA, 335 bp, Homo sapiens
ggcctgtcaaaatccaagtaaactaaaaggcaattcctccttgccactgatgcacttttgacacttggaaaaggggagagaaaagtctcttccacttcgcatccaacctataccctcctttcctctgtcgtctccctgcactcataacagagagggacggagagtcctacaagctgttgggtgaccgtggccctagggcgaaatgaaatcgctggccgcattattagggaaacatggtcttgacaattctggatgatcaaaatagcaataaagtctttgatgggaaagacaaaaagcaccctacttctctcccgggtagcagagtgtccaaataa

SEQ ID NO: 239414 - DNA, 474 bp, Homo sapiens
catccttcctgaccagtccaggtggctgtgctcctgcagtctcctccctggtctcgcacactttgacttccttactcaggaggcattgtgaagtctccccgcgatgccactccacctcctctgggattctctgccactcaagtgctgggacgggaaggaggcaccctgagtttattgtgtgagttgaagtggaaggtgatgaatggcggcttcccttggacaacagatctggccttggagtgaaaggaggaagaggctgagtgcagaatgagagatccatgtagccaccactgagaacttcagaccagaagagacaagcagagatactgcaacgcactcatccagagcagaggaaccctattttgagtttacctataggaccttataacaggcaaacatatgatgtcttcatagtattagaaataatgaaatgaaggactatatcagtgacctcctgaaaggttaactggaaat

SEQ ID NO: 239415 - DNA, 525 bp, Homo sapiens
ttacttcctactgcttgaaatctaaatccagagagatttgtggctcaaggatatcttcaaataaaagttttattgctaaaatgtcagttaaaattatgcctaggtaggtgctgaagtaggagaggctttgacgtagcagagtgactggcagtgaattttgtgggtaccttgtgatgagtcttattatcagttacaaatggtcaaaacatgcctaagccttcagctttactaaaagtttaacagaacttggcctggcgcggtggctcacacctgtaatcccagccctttgggaggtggaggcgggtggatcacctgaggtcaggagtttgagaccaacctggccaacatggtgaagccccttctctactaaaaatacaaaattagccgggtgtggagttgcgtgcctgtaatcccagctactcgggaggctgaggcaggagaatcgcttgaacccaggaggcagagtttgccatgagcctctcaccgttgcactccagcctgggtgacagagtaagactctgtctc

SEQ ID NO: 239416 - DNA, 91 bp, Homo sapiens
accacgcctatattcctagctccaccagaggttgaggtgggaggatcacttgagtctaggagttcgagtccaacctgggaaacctggcaaa

SEQ ID NO: 239417 - DNA, 410 bp, Homo sapiens
ctactacaatatttaaattggcctgtcagaggaatgctacctttgctacagtcagaaggttggcattaggaggccaacatgaaatgctgagtttgagaatgcgccatctcaataccaaaaaaacccagtaaaaacataggcaaaagacttgagtaggtgtttctccaagcaaaatatacaaaggtctagtaagcatatgaaaagatgttccacatggctaatcattactgaaatcaaatcaaaatcacaatgaaatactactttatgtcataaaatggctactattaagaaaaagaacagaaaattacaagtattagcaggaatatagagaaattagaacactttgtgcatatttctagtaggaatgtaaaatggttcagctgctgtggaaaatgatatggtgactcctc

SEQ ID NO: 239418 - DNA, 308 bp, Homo sapiens
tcatttctttatctatctgttcatcagatagccactcagttcctacagtttgcccatgtgcaacgcacgcactggaggcctcacagacgcactgtctcctcaaggcgcttgtcatctagtgggtgagaaagcaagtgacaaggcgttggaataagtaggacaggcactgtggtaggaagagtgcatgttctagaagcaccgagagggcacgtcacccccaccttggggtagtggggggaattcatggagacttactgggagatattatatatatctatgtatatgtacataataaatataaaaatgta

SEQ ID NO: 239419 - DNA, 388 bp, Homo sapiens
acccaaaagccactgcctttctgagcttcctctagtgagggagatagaccataaataaacctataatacattgtcaggtggtggtaaatttgataaagaaaaatcacaggccaggcgtggtggctcacacctgtaatcccagcattttgggaggccaaggagggcagattacgaggtcaagagattgagaccatcctggccaacatggtgaaaccctgtctctactaaaaatgcaaaaattagctgggcatggtggcatgcacctgtagtcccagctactcaggaagctgaggcaggagaatcgcttgaatccgggaggtggaggttgcagtgagccgagatcgagctactgcactccagcctggcaacagagcaagactccatctca

SEQ ID NO: 239420 - DNA, 492 bp, Homo sapiens
ataattggaaggttttatattagtaggttaaacctgaactttaacggtctctacttggtgactttggtagggactggtcagaagtttacttttgctttggtaagccccctcttcttagacagtcataaaatgagactcacagttaattaactcatagttccaatcatgttgttttctactcaaaatgtaaaaacttcatgtatcttacaggttagatggcttcagggttttgacctcagactctaattgctatttgtacatggtttatataagaaaatatattctgatgttcaaacaattgattttacatgtgcaagaagcagggatgaagaggaagagtgacaaaatattgataatgttagaatctggctgatggatatgtggaggtttgtcatactgttctttcttcctttaggtatatgttgaaatttttcataatttttcttttaagtaacatctaaaataaactgtatctataagacttacaagaaa

SEQ ID NO: 239421 - DNA, 444 bp, Homo sapiens
cactttactagaaacatgggagatagaagaacatattaaatgataccacacatacttaatcaaacaaacctgaaatgtaggataatctctagggcactggcctggtttcttttaaaaagtcagtgttataaaaaattttaaataaaaatgttctagattaaaagatactgaaaatcataatgactaattaagcttgtaaactttgattaagttccggtttggaaaaaagttgtatgtaattgattattggaaaaattgaatatggattgtgttttagatgatattaaggaatttttgttatttctgttctaagatgtaataatgtgattatgtaggaatgtatccttaatttaaggagatgagtatgttaaatatgatgttgcaacttcctttcaaatgatttcatgaaataaaaaataaatacatacaaatgcatgtaagtag

SEQ ID NO: 239422 - DNA, 472 bp, Homo sapiens
ggcgaggctaggacagcagtcctcggagaccctccgcgccctccccagcggcggcagggcggcaggagccagcagagcttttccaccaaaaccatccttctcagcaccgtgctcctcgcccgctttggctgatcctccagtgggagtgggggcctgggctgcctagggccttggactgcactgtgtcccttgaaacacacccaggaagggacgtgctcgttagcgagtctgctaattatcctgactgtgacatgcgtttgtcttagcctcctcacggcttcttcagcgggtggctggttggttgagataccaagagaggagcaaggccggcatgcgtcgagccctatcgcttccactgggctcagcctcgtgtctgggagggcctctaaaccatgagccgcggcgcagttaaaaataagacaggagaaaggaaaaagaaacaaggcaatacaagagaacttaaaaaaaaaaa

SEQ ID NO: 239423 - DNA, 204 bp, Homo sapiens
ttactccgtgtcacggcatggatgagcctccaaaacaccgcatccagggaagaaaccagatgcagagtgtacagctcatgtgggaaaggcggagggcagtgctggctgtacaacacgcatttcctgtcaccgacttgcacacttaacagtgagagaattttatgctctataaattataaatcaataaaactgttttagaaacaa

SEQ ID NO: 239424 - DNA, 331 bp, Homo sapiens
ccggagatgattatgtctaagggtaatcaggtcacggaagtgtgaaggtaagataaataaggtaaatacaaaaatgaaaaaaggcttaaaagaagcaaaagggagttggtggcaaagaggctacataatagaagggagatctaatgtttggaatatcattaagcagtaagccacgagagacagtctattgcagctgtgtgattgcagtatgtctcggttggtgtcccaagccatgggggcaaaagctgagtgactttaacttctcaggaagtgcaataatcctttcagaatacagtgcctgcaggcctactgccatcaggctatgaaattt

SEQ ID NO: 239425 - DNA, 788 bp, Homo sapiens
gctcttctaaaaaactgctcaacatcaggatagctgtgcttgtacaacatatagtatgtagaacatactatataactacagtatgtaggacataccacataactatagtattagaacataccatataattatagtatgtacactatagttcatgtgtcattttagtaaaattctttttaactgtaaggtaaatttacttgaatccaatggaacaaatttatttaaaagtactaggagttacaatgtatatcatgacaagggaatatactatttctgaaaatcagttaaggaatgctatattaatcattgcagtttgcatttagggaattctgcagtgaagccacagggcaaggattttattatgctgctgttctgtacatctattccttggagtatatgttaactgtgagctgtaaattgcttgcctttgaagatagcttttgtaactctaaagataaaatgcaaagtcagcactatgactttgtttttttggataaaaaaatagaatgattactcttcaaagcataattgattttcccctttcaaagtatttatttttacatataaacatttattttaatgtgtatgtataccttataaagttttttatatacaaacaacagaaagttgaaatgtgattgtactaattcagtaatactacacatattggtaacatagttgttctgtagttctgcaatatgtatcatttggtgggagcccttcttcctgttccccataggcatgtctgtttattgaagagaaggatagcgggaaaaaaggaaagggtc

SEQ ID NO: 239426 - DNA, 1602 bp, Homo sapiens
  misc_feature (1090)..(1090): n is a, c, g, or t
ttttccttcacttaggatcatcattatatcaggcaaggtccttgaagattttctagccttagccatgcattttgctgatgaggaaacaggccagaaaagggtactgtgacttggccaagctctcagagtggcagaactaagataggaacccagctcccttggctgttagcctagtcccctttccaccacacttcaaacactgtcactgcccatgtcacagggacatggcatgttagaatcacccctgtcaagggaaaagtggatggtctcagtaaaatggagattagtacacagctttgagcctttcagagtttccagttgcccgcacctgatgtcccagaactattttttccatcttcccctagaactggcgccagcactatggtggtgtggatgtgagatgagggcctgtttagaaaaagctggacagcaaattcaaacaattgttaatgagtagtaataaaggcctcctggggtgtaaaatttttgtaagacactctgaaacattttcatattttaggtaagggtctagaattaacttggaaattttgggctagagcaaatggctcgataatttgaagaccagtgattgtgtctttgcttttgctacctgtttcagggccatctacacacacccatagtatccactgctggtattctttaaggctggttatgtgtaagcatttctgccatggccagggagaaacgggattcaaatcaattcatccatttttgctaattgctaatcgtttagaaagaaaagtaagcagaaggccgggcacagtggctcacgcctgtaatcccagcactttgggaggccaaggtgggtggatcacgaggtcaggagttagagaccaacttggccaacatagtgaaaccccgtctctactaaaaatacaaaaattaaccggacatggtggcacatgcatgtagtcttgggaggctgaggcaggagaatcacttgaacccaggagacagaggttgtggtgagctgagatcacaccactgcactccaccctgggcaacagagagagactctgtctcaaaaaaaaaaaaaagaaagaaaaaaagtaagcagaaagataaaggnatccaattaaattgggtttgacttttatctttgtttttactgttctcaaatgaagaattgatttgcatgtctttcttgcctgtagaagcatttgatttccttctgtgaactaatctgtagtcttcatttctcttgaaatatatgcccactggtataaaaaaggctaatgtaaacatgttggccatttaaaaaattttctgctaaaaaacctatcagtgtagtttgcagatgcagttagaaagagcagaagtaggctgggcacggtagctcatgcatgtaatcccagcactttgggaggccgaggcagatggatcgcctgagtccaggagttcaagaccagcctgggcaacatggtgaaaccctgtctctacaaaaatacaaaaattagccaggcacatgcctagggtcccagctactccaactgaggtgagaggattgcttgagccagggatgtcaaggctgcagtgagccacattcatgccattgcactccagcctgcaagaccctatgtc

SEQ ID NO: 239427 - DNA, 1628 bp, Homo sapiens
  misc_feature (1573)..(1573): n is a, c, g, or t
tttttaattttacttttctttggtcactctggtgacctacacatggcataaccttaggtagaccccatcataggcagttcctgtgatagaattatgtgccttcctagctccacatggtttgtcttttccaaatctttattggaagggatgagtgtttgaatctcctttcatctggcctttgggactagtaggaccacagtcacagaataaggagttctggttacaacccaagcagaaaatgattcctgaatgttgagttcatagtagctgtattccccacacagttcaaatggtgacattcttaaggcagaggaagaagaacagtcaatccttttatttaattttggcaagactgtggtttatggtgctctggggaaatgcagccacagatgtgtcaacctttaaaaaaattcttggcagtctaacctttaagtcataaacctaaacacagacagtgcatccctgaaaaaagctcgtgttggctgcattgcacacctctatcccaccttccaagacacccatcattccgtctttgcttgtgaaatgcaagttctgtttattttaatcagtatttatttcctagatgatctgggtgcgttgtgattttcaacatgtttgacagttttatggttagctcagcaatcactctatattattcactcccaagatatggataagcacaagggagttactcctttccaattctgcatcgatgttggacctctgtcaagaagcatcataggaaggtggttaagcacatggacactggagccctactgcatgggctctagccctagtttagcattgtatctactgtgtgactttggggaaagttacttaatcttactgtgccttgtcttcaggaacaagaacagtacctacttcctagagcagttgtgaaaaccaaaggagttaatttgtatatagactttagggaagtgcctggcacaatataagtgcttataaatattatctgtcaatattgctaaaggacaaacactatgttttcatatattttacttacatgataatcaaaatgagaaactagttattgttatttaattcattaagtcttctatcttcccctgtgcttttaaaggacttaattaactagagttattataactccttttggggaaaatttctatttttacacatacacagataggaacatgtatgaaagtatatcaaaatgttaacagcatcatctctgggaggtttgattatgaatgatcttaattcattttcattttttcctcatttggatttaataagtctctatacacattacttatagaactttaacagagcaaagaactcaactaacatttctagcactttcagagaatattattcatattatatttgcatgtgttttgtgtgaaacttcacatcaagtattttatgccttaactttttgtgattctttcctcctgtgttttctctgttcaagtgaacacatcagtaggatcagtgatttgtcatgcacagacacagcacataactccacatttcaggtaacagctctttttgtgtgtgtgtgatagatttttactcttgttgcccaggctgnagtgagctgagattgcaccactgcactccagccagggcaattgagcgagactctc

SEQ ID NO: 239428 - DNA, 193 bp, Homo sapiens
ataggtccaagaagaggcacattttactgagttttactttcacattggggcaataagaccttatctatcattcaccagctgtgtgatcttgctgggcttcagtcttctcatccattaaataagaatcacagttcttacctagtagtgatattgtgacatttagacatttagtgacattagacacaatctagaa

SEQ ID NO: 239429 - DNA, 522 bp, Homo sapiens
agaatggggggagaggaggcagctctgacagatcaaggttacaggagctcaggatgggcaggagactgagaggctgaccggatataaggcccagagcacagaagtgctaccttatgaggcttctctgaaggatcagcaaagagtaagtcaggtgcctgggcggagtgcaagactcagatgctgagcaaagggtctgcaaagggagcaaacacaggatcccagagagaggccccaagacgacggtgcacagggaaaggaagcctctaccgtgatgtgtagagtaactactgactgacctgtggcagggaaagcaggagccgtaaagagctatgagctggtgcccacatgggaaacattcatattgcaaggcaaagattcttgggttggataaaatttaaaagaatgctgctaaacagaagaacaacaaaatattaaaaataaaaggttgggacaaaagaatagcatgagaacacatggaagtaaaaagcagggatcacaatattgcttttctgttaaaaaaaa

SEQ ID NO: 239430 - DNA, 350 bp, Homo sapiens
tcccatgcacccctcccccttcccacagcagcccactgagctcggcccttgttgaccccactttctgggatactcttccctactctctgcatctagcagactcttattctcccttcaaactcaaactcacactttccctaaggcccatatacagaacaatctgttctcttcccacccactccacagcactctgtacttccctctagaagtctagaaatttgaaatagtaccatgagttccctgaaggcactaactgtgtcttgttcttctttacttctccagcctgatgacagagcaagactcagtctcaaaaataaataaaaataataaaacctccataagtaatcctg

SEQ ID NO: 239431 - DNA, 506 bp, Homo sapiens
gattttcctggctcaaaatgaagtttgacaagtcttgttttatactcttgtcatcactgggatttcttctgactttacaagaccaacaggaattggagtcagactcacaggggagcctgagagcctctctatcccacaccgctgtgggagccacgcccaggtggggccagggctgcagagggggaagctgggaatggctgggcaaggatagaggcagctcagcttcccctaagcctggggtggcctgaggggccccctgcactatgctggaacgtaccttcctttccaaggaaggaaaacagcagcttctgactcatgactgtgtcctcctgcagacaagtacacagctcatcccctcagagtgtctgagtgctgagctcacatctcatggtggggtgttgcggccatgtcgctgccccatcccacgggcatggtgaggattctgttactgcacactctttagggtcctttatagttaataaaatattgaaccacttccatactgg

SEQ ID NO: 239432 - DNA, 459 bp, Homo sapiens
tcagagcgctcatgagagatgggctagcacagccgagcatgtatgaagggccctggcacaggtcctggcaaccagctgctcagtagatgggtttccagtgaaactggtgaccgtgagaggttgactctctaaatggcaggggtggctttgtgtctgtgtgaccatgcatcccatcaggaaatgatattttagtgcatgcccccattgtgtgcaaatttattgataaattatgggcaagggcggcaatgtagcctagtggttaagggaacagcctctggacacagctccctttggaaccagtgggcacttaaccttcctggctgttcactgtgttctcaagtgcagcccacagcccccgtgtggccccgtgtggtatgcctccccgcctttcccccaccccccagggctgtgagtacatgtgattaataagctgctgtcaagctattaaaaacaaaaaac

SEQ ID NO: 239433 - DNA, 3024 bp, Homo sapiens
  misc_feature (910)..(910): n is a, c, g, or t
  misc_feature (1661)..(1661): n is a, c, g, or t
  misc_feature (1798)..(1798): n is a, c, g, or t
  misc_feature (1968)..(1968): n is a, c, g, or t
  misc_feature (2014)..(2014): n is a, c, g, or t
  misc_feature (2103)..(2103): n is a, c, g, or t
  misc_feature (2227)..(2227): n is a, c, g, or t
  misc_feature (2313)..(2313): n is a, c, g, or t
aattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtaagcgcaacatgaagagcttattctggtccaatggggaaataagcttagtagatattaatcactggtacattttagggtatatcaaaatccctttgagggccggtgattcctggaccctgcccacagagtttctggtgcaggtctagggcaggacctgagcatttatttgcatttctttttttttttcctttttttttttttgagacagtttctcccttgttgcccaggctagagtgcagtggcatgatctcagctcaccgcaacctccacctcccaggttcaagcaattctcctgcctcagccttcctgagtagctgggattacaggcatgtgccaccatgcccggctaatgttgtgtttttagtagagatggggtttctccatgttggtcaggctggtctcgaactcccgacctcagatgatcctcccaccttggcctcccaaagtgctgggattacaggcgtgagccaccgtacctggcaagagtttgcatctctaacagtttcccaggcagtactaaggatgctggtctggggaccacagtttgagaaccactgctctaaattattgatggcatcagaaggggatagcagtctggttttctttctttaccctttaagcaatttaaattaaaggcaaggtctaaaattaattgcctgcaactgagccncagaatggcattaataagttatttaaaatatttcccagcgttttcattgtaaaatgggtaatacctaccttatatgttggaagaattacagaaagtacaacaaaagaagacaaactgcttagcataatccaatgtgtgttaagagctgagacccctgagcttatttcatgaagccctttccagacactctgggttagtctttctaccatctgcccacctacaactatactacttccaactagatttttaagttttaacaggaactgtcttgtatgctttttgttttgttttgcttttgatatggagtctcgctctgtcacccaggctggagtgcagtggtgcaatcttggctcactgcaagcaccgcctcccgggttcacgccattctcctgcctcagcctcctgagtagctgggactacaggcccccgccaccacgcctggctaattttttgtatttttagtagaaacggggtttcactgtgttagccaggatggtctcgatctcctgacctcgtgatccacccgcctcggcctcccaaagtgctgggattacaagcgtgagccactgcgcccagcttgtatgcttttctaaaggagaacagaatagagaagaggttaagttaggatttcagggttcacatcttggagctggtcaatcaagggtgatgggccataatgcagtcttacatcagtatgtcatcctggtgtgcgggtacctgtctctttcctttgccattgccaggtgtcagntggtgtgtggtccatgggaaaagtctccctgcagacacagatggttgggttcacctgcagtttcatgctggtcaagcctgggttccagaaaagcaagaagggagagtgagtgcactcttcttgcttcctgcctccanttttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacangtgaactctggtcctctgcacctgtttatgggccatgcagactggnggggtggcagatgttagcctaagacccctagcagtgcctgttgctttgtgagtggagatagagactcttacatttaaaaatggaaaaanatttcacaaattaccataaattgtagttaatatgtagaaaaactcattcatactacttttctaaaatagacatgacttcagcagcagcttttttttgttgtattttgagacagtgtctcactgntgcccaggctggagtgcagtggtgcaatctcagttcagtgcaatctccgcctcctgggttcaaatgattctcctgcctcagcctcntgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtg

SEQ ID NO: 239434 - DNA, 437 bp, Homo sapiens
acatagttttaaaataataataattataataacagcagttgaagttgcgtgtcaggagcgcgtcctctctctccagcagtaagggtatctaattataataattaagtccaagtgaccttgccttctttaggcaaacaaagtcgggaacaagttgcaactcattttcagaaaaaatcctcaagtcctctgcccacggcggaaagggcggcgggtcggccgagcctgggtggcttcccgaggggtcgcctctcgcccagctcctggcaggggcgcgtgggtcctggcccggggactgcagggccgcggcggggcgggcagggtcagctgggcacatagtttctcggaatccaccctcccggacccccgcagcccagtttctcctcccctcagcccaccttctctgcccacctcctacccggagccggggaggcggccgc

SEQ ID NO: 239435 - DNA, 441 bp, Homo sapiens
cctgggaggcagaggttgcagtgagccgagacagcgccactgcattccagcctgggagacagagctggactccatctcaaaaaaaaaaaaaggaaggagtaatggaataagaacacaaatgataaaagaaagtcatgtttgttgaatacaggaatgattgagtgaatggggttcacaaacaacagaaaatgagctttggggcaagtaattcaatttagagtaatttttagtttgattgaaacatatatttctcagaaacagcagtctttttctagttcacttttaacaagaccattgttactttggggattcccacctcgtttttaaatggtccttttttatgctttcttaatatatttaaaatgctgccaactatcaactcaacacatattattccgttatcctaattactgtcatcattaaacacttttgcagttcaca

SEQ ID NO: 239436 - DNA, 399 bp, Homo sapiens
aaggactgtgtctcatggtacagcaacctcagctaataaaacattacgtatttcttactgtcagaacccatctcaagaaacacagttatgattgtcaatctaatttctattaaacatgctttgcatgtggaatgtggaatccgagaagaattgaggcaaaggaaaaagttattttatagcctcattgaagattatagttatagaaagagatatgaattcttaattgctttcatgattattgaaattagtattttaaataaatattttctgtatatagtactttactgtagctattcagataaggagaaacagtctgaatatacttttatatctaataacaaatgcaatccaagaaaacaccagttcaaactacatttgcattaaatggcttttgaaaat

SEQ ID NO: 239437 - DNA, 526 bp, Homo sapiens
tgagattatctgagaaacttgcaaaaaggataccaatggtcagggagtacctcagaccaactcgatcagatttctggtggttggcatggggattgggattgtatggaaatgttctccaggtgactttaatagcagctggccaagtctgcatttgtggaaatctgcagtatttgaagtttggaggagatcaatttttcatcctttccttcgtgggataaagaatatttcaaccacctctggagaccaaagagttctgagaagttttgaaatagcttgggaaatacaccacgtgcttcacacttcatttttctcctctctctttcattgtttgacttaattaaaatattgtaatgcaagaaggagagatgaggcaaacgtttagagaaggaaaaggaaatgggttcatgtttaaactgactctgagcaagcatggcgatggtagtttgaaagaattctgagcatgtaggaaggtaaactcaaaatgttcttcctgcctgagaagtgattaaaatacctgtgagcacca

SEQ ID NO: 239438 - DNA, 767 bp, Homo sapiens
gtctgtgtggagacgaaagctgcccacaagggagcgagggagctgggagggggtggtaagagatgaggtgggaaggatgggttgggtgaaccttgaaataattgtagttgtactttgtggaagaaaaaaaactttatcatcaaggctttgtcctgatccaacctgaccttcccctcagttaatccgaattactgaggtttgactccatgttcagtttctctgagatttgctttgatttctcttagaagtggagctgctgtttattctcccggtggctctgtgtacacgctctgcccgtggagctgcctgggatgagccgtgagtcctctgagaactgcttcctgtttcgtctggtaactcctaagcctgcctttctttcctacagtctgcatttgtggaaatctgcagtatttgaagtttggaggagatcaatttttcatcctttccttcgtgggataaagaatatttcaaccacctctggagaccaaagagttctgagaagttttgaaatagcttgggaaatacaccacgtgcttcacacttcatttttctcctctctctttcattgtttgacttaattaaaatattgtaatgcaagaaggagagatgaggcaaacgtttagagaaggaaaaggaaatgggttcatgtttaaactgactctgagcaagcatggcgatggtagtttgaaagaattctgagcatgtaggaaggtaaactcaaaatgttcttcctgcctgagaagtgattaaaatacctgtgagcacca

SEQ ID NO: 239439 - DNA, 485 bp, Homo sapiens
taggtgataactattcttgttatcagcagtgctgcggtgaggattaaaggaaataatatgccacgcttagttcctagacctctctaaactgcgtctatgtcctagggggagaactgaatttggaaaccacattcaacccttatgaattgtgaggacaggcaatctgcctgtgtctctgagcctagccattctttacagttgatcagttttaaactcttctgtgctccctactcccagatttttctaccactgttagtctctccatgaagcccgtgtggaaccttggctccagtgtaaatacacataaataaatacccattctctttcagagcatttttttcttcctctgcctttgcataaacctgactctgactttcaaggatgctacttcctgtgtttccttgtttgctcatttttcactaaaaagttattaagcaacttttattttccatgtattatgctggattctggcaacaccaaaaaga

SEQ ID NO: 239440 - DNA, 318 bp, Homo sapiens
tgatgaagtgccagataggatgggaatggaagatatcgtggaagccaactatgagtttgcaagctttgccttcttgaggatggaggatcgctgtagaggaggaaacaaagctggagggtcacataccagctcttcaatccttggcctagaattcacacctgctattcccactcccaggccattggccagaagaactagtcacagagccatgcctgtatttaagcaacagcgaaatgttaagcatgtggggagcagtatatgcctccgccaccctggctgagagtgtgtgtcaataaaccttcttggataaactaatga

SEQ ID NO: 239441 - DNA, 130 bp, Homo sapiens
ggtcccctcctcttttccttttatatctctctcaatttctccctgtctctccctctcaatctctgtccctcacagatgtttgagagagtccagccatttggccaaattctcccccctgctgttggcagct

SEQ ID NO: 239442 - DNA, 119 bp, Homo sapiens
tcctcctttttttttttttttgtgcccaactgctcagcccagctgctaggttaatttttgatgtctctttatacaacttgtcatgactttcttcatattagctttattcctctttactc

SEQ ID NO: 239443 - DNA, 349 bp, Homo sapiens
agtctgagcagacactttaagccatgttgatctagatcaccctattgttccttctgacctgttaggatgactgcagggtgttcagttaaattttttccaggaaggaatctcctgaaatagaatcatggaaaaggcttgtggctagagtcctgggtttgaatttcagcaaccatttagttctcatgaccttgggcaacttctacttttagaaactcagtttccttatcttcagaatgaggataatagtatccactggcaggtgattgcaaaagagtagatgtgaaaatgcccatgaaaaagggctctgcagactgtaccaaaagttcagctattaaagccatttgttgtt

SEQ ID NO: 239444 - DNA, 456 bp, Homo sapiens
gcctgggcgacagagccagactgtctcaaaaataaaaaaaaataaaaataaaaaataaacaaaattttaaaattaaagaaagggggaaacttggaagaaatcttccaagaagtagattaaggaggcaaagaaacagaaaacaggagagaaaagaaaattttaaggtcaatccaggaagtgcaaactttggctaacaggaattctaggaagagaaaacatggagaaaaagacagaaaatcttcaaagaaataatatctgacttttaaaatgggcacatgttttaccttgataaaagtaattaaatcatatgggcaatcacatatctcaatgtttaggtgtttacctgcatgaagtaggtatataaacattattatatattatactatattgttctctggttgttttctatggattatgccattgtctcatttcaattataacctcttcacatccagg

SEQ ID NO: 239445 - DNA, 383 bp, Homo sapiens
ctggaatcattgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgtgatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagttta

SEQ ID NO: 239446 - DNA, 477 bp, Homo sapiens
ccatctttcctttattctagagctcctggcacacttacatgaatctcttgaaagaagagaaatgagagcattcattccatactaatacaattgtgccctatggaaaggctttttgctggcagacatagtagacggaccatttcccaacttctttttctttgccaccttccagccaaaggtgtccatatgacacagctctggacaggataattggaagtctgttgtgggatttctgagaaagcttttgattttctgacagagacatttttgcttccccttaccacttcctactggattacagatgtgatggaaagagctgcagcagccataatacaaccataaaggagaggagaagagaattgcaaaggcatcaacccacattgaattgaactgctaagttaacactagcagttacttgcctccagatatcttggtgtgtgagaacattaaatctgtatgtgtctaaatcagtatggg

SEQ ID NO: 239447 - DNA, 451 bp, Homo sapiens
ccgccaagcaggtatgtcatcttgttggtgaagacaattgataaccaaatctagcattgaaggtagagaaagaacaaaacagggacaagacataggacagtaagatgccttagctatttggtaaatgttgagagatgggaagaaatttaatattgaaagtctcaattatctactctaatattacaaattattaagcacttaataaacataatttgatgatgaaataattctctgtgaaaaagggtatacacatagataaacaaatagataatagatgatggatagatagaagatagatgtgtgtatgtatatatatgtatatatgtatgtatgtgtgtaaatatattatataatctgttatatatgataatcatataatctataacttatagattataaaatcataagtctatattttattaaaatattaaatctgttttattatattaaa

SEQ ID NO: 239448 - DNA, 399 bp, Homo sapiens
actctgccctgataggcttactcatcaagaaccacacagcatcttgcttggctaaaagcactttgtttagaaccaatggggcaagggattaaattggctcacccaccaagtctccatataccgaggggctcagagtcctcaaagcagttttctcataccttttgagacacactgcaccgccagagagaaaaatctatgtagtgctttcatgtcagtgaatgtagaaatcacagctgatgtcagaaaagaggttaagaactacttcagagtgaaacaggccagccgtgttcattcccatgacctaacataactaaaaaccagtagataaatagtggtactgccctatttattattagccttttcaaaccagctgtctcctggcttatggcaaccctaaat

SEQ ID NO: 239449 - DNA, 403 bp, Homo sapiens
ttcacctctccaaagacccagatcatcatttccaactgcttattgtacatttccacttggataacacattgactgtgcagattcatatactgtatttcatcagatctaaattttcatcaattataacataacccattattttatataccgctaagaaaaaaatgccactaatttgttgatgctatgctattcattgtgagaatcatagcaaattgagagatgttaaaaattgggatctaattaaactaaagagcttctgcacagcaaaaaaaaaaaactaccatcagagtgaacaggcaacctacagaatgggaaaaaatttttgcaatctactcatctgacaaagggctaatagaatctacaaagaactcaaacaaatttacaagaaaaaaacaaccccatc

SEQ ID NO: 239450 - DNA, 447 bp, Homo sapiens
ccccctttctctcacaacacacacccacacacagtgcatgttagtggttcaatttaatattttttaattttaatatttaatttaacattaatctaacattttccccaaacatactatttatctttctactcagtcaagacgtagtctcatgtaaaggcttcaaacaggcagatggaaagaagaagactcctttactatagagggttggcctgggccctgagccgtccccacccgacccagggggcatctccttggtggctctggtctgtggctgtttccacagtgaagcaaatatcctttctgtcaggtcccaggggacaaactctgagccagggcatgtggtgggggcctggggactccttaaatcctcccctctctcctaccccctaagggcatctggatcctctgggtaggatgcagagcaaggaccaggccacctgcctccca

SEQ ID NO: 239451 - DNA, 436 bp, Homo sapiens
tccatggatgcagtgttaccatcgaggagctcgaggccgaggtcgactctggcaccctgatgacaagtctggagattcagcagtagaaagaaagcagaatcatccagggatgcagcgttaccatccaggagctcgaagccaaggtcgactctcgcaccctgatgacataaccaagtctggagattcagcagtagaaagaaagcaggatcatccagggatgaagctttaccatccaggagctcgaagcccaggtcgattctggtggcaagatggcagcaccaatctggagattcagcagtagaaagaaagcaggtctcatgatctgagtgtgtaccctctccaggaaggaaactgcatcaatgtctgttcctgttaaatagcaacttttagtctcagcttgttttgttttgatgtcaataaatagtaacaacattca

SEQ ID NO: 239452 - DNA, 371 bp, Homo sapiens
ccaccatccacctctgcaactcttcatcttgtaaaatggaaactctgtacccgttaaatcataactccctattgccttcagctcttggcagccacaattccaccttctgtctgtatgcatttgattattctagatacctcattagtggagtcatagagtgtttgtccttttgtgactggcttatttcacttagcatagtgtcctcaagatttgtccatattgtagcgtgtgtcagccaattgatttttgtatgttgatactgtgttctgcggctgtgctgaacatgttcattagttccagtagtctttatgtatctggattcattaggactttctgtgtacaagagcctgtcatctgtgaatagagacagt

SEQ ID NO: 239453 - DNA, 463 bp, Homo sapiens
gacatagatttatgaggtactgatttattcatattatcttctaaattataaagattgacacattttgaaatttcatattcctgtttgcctgctaggatttgttataatagatttaagttgattgtatatactgatcctaaagatatcagtacaatatagatttgatcactactttgtaaatagaagaagaaatggaacaaaagcatgttttcagttatatactttttcacattactgaatttagattagagcagtccaaaattgcacacatttctttatattatcgaagatacagtttctatagtattcattttttttttttaaagttttaggccggttgctggccggatgtggtggctgatgcctataatcccagcagtttgggaggccgaggtgggtggatcacgaggttgggagttcaagaccagcctgggcaagatggtgaaaccccgtctccactaaa

SEQ ID NO: 239454 - DNA, 333 bp, Homo sapiens
aggtttttactcaaaggcaatgccagagtccttagaatgaccttcaactttaggtctccaaataccctttcctaaaccccctcccctaggcccaccctagccaggagcaggtgttgccctcgaggccttaccatctgcccttctctctgcctggaactctcttcccatcatccctgtggccttggctccagtggtgcttctcaccaaggtgagtgctgaccacctctgctaccatcactccccccgcccctgtgactccggattctcttaactcttttttttgagatgagtctcactctgtcgccaggctggagtgcagtggcacgatcttgg

SEQ ID NO: 239455 - DNA, 461 bp, Homo sapiens
caggggccactctatggggtcgctgtgctctgttgggaaggctttgctctggccggtgtctcccaagggaggcagtgattttgggtggtgcagagatggacacttttcttgtcagtattatacaatgatttccaaagcatattgggaaaaaaccagcccatcaaacctgtttagggagagcctaacgtaggcacttagctcaaaacaatgagatttgctgacttacttactatatggagtactttgtaatctcccccacccttaagaaggttctttgaaattctccccactcttgaggatgtactttgtgagatccacccctgcccgcaaaacattgctcttaacttcaccgcctatcccaaaacccataagaactaatgataatccaccaccctttgccgactctcttttcggactcagcccgcctgcacccaggtgaaataaacagccatgttgctcac

SEQ ID NO: 239456 - DNA, 475 bp, Homo sapiens
caggggccactctatggggtcgctgtgctctgttgggaaggctttgctctggccggtgtctcccaagggaggcagtgattttgggtggtgcagagatggacacttttcttgtcagtattatacaatgatttccaaagcatattgggaaaaaaccagcccatcaaacctgtttagggagagcctaacgtaggcacttagctcaaaacaatgagatttgctgacttacttactatatggagtactacatgggtagccaaggaagggtttggcaaaagctgaaggtggggagcgggcgtggtagctcacgcctgtaatttcagcactttggtaaccgaggtgggcagatcacttgaggtcaggagttcaagaccaacctaggcaacatagtgaaaccccgtttctactaaaaatacaaaaattagctgcacgtggtggtgcataccagtaatcccagttacttgggaggctgaggcag

SEQ ID NO: 239457 - DNA, 379 bp, Homo sapiens
  misc_feature (33)..(33): n is a, c, g, or t
aacgctccaggcacgatgtagagaatcgccccntccaaaagcatattgggaaaaaaccagcccatcaaacctgtttagggagagcctaacgtaggcacttagctcaaaacaatgagatttgctgacttacttactatatggagtactacatgggtagccaaggaagggtttggcaaaagctgaaggtggggagcgggcgtggtagctcacgcctgtaatttcagcactttggtaaccgaggtgggcagatcacttgaggtcaggagttcaagaccaacctaggcaacatagtgaaaccccgtttctactaaaaatacaaaaattagctgcacgtggtggtgcataccagtaatcccagttacttgggaggctgaggcag

SEQ ID NO: 239458 - DNA, 494 bp, Homo sapiens
tgaggaactttgaagctgattctaaaagggtcaagatcacgcaagacattctgggggaaaccaggttatccatgttgagtaaaaacaacaacaaaaatggaatgaattttatttctattgcaccaccatatacaatattaaaatccattcaagtgagattattgcttaaacgtgaagcaaattattgcaaaacattataatttcaggaaaaatatagagaaataaattatgacctcagcatagggaaggattccttaaacataatgtaagccatacaggaaaagatcgacattacattaaaagtatttcttagtcaaaagaaataccataaaaagaaatgaaaagacaagaagctagactgtgatgagctatctgcaacatacatgatagcaaatgattactctccagggcagaggaaaaagtactaagggtaagtaagaaaaatatacaaataattcaatacaaaaattaaccagaaacaaggcaaaaaaaaa

SEQ ID NO: 239459 - DNA, 468 bp, Homo sapiens
caccatgcccagctaatttttgtatttttagtggagacgggtttcaccatgttggccaggatgttctcgatctcttgacctcatgatcagcccttctcagcctcccaaagtgctgggattacaggtgtgagccactgtgcccggttctgtggccttttctaacattatccaagaagccctaaggttccttatgacaggtttggggattgggaaagttcaattttattgtaccgccaatgaaaaggtgctatatttttttcttgaacctcaagggcagaggctgaattaatcatattcctcagctcattccacattatcatggcaaagcctctcttttgctttatttatttattctcttttatcttcatacttaatctcattccattctctgccatgggcaaccattctaatgtgttatgtataatttttgtatatatgtattattataaaatgaggattcttgttttg

SEQ ID NO: 239460 - DNA, 386 bp, Homo sapiens
ataatctggaaatggaatcagtggatcagttgatcacccaaatgtggggagggaagtagtggaggcaaaggcagggttgagagaatagaaaaagtaaaaaatgaattcaaggttttctagctttgacgactgggtgtttgataatgggacacataatacagaagggaaaagaagtatggaagtacactacaacagaagatactatgtgcagttttgaacatgataagctcaaagtacctgtaggacatttcaggtacacatgttcaggtgttgtttggaagtactctctggaattttagagaaatatcagggctaggtttgtagatatggagtgtatcaggctagggaattgaagctatcactaaaggagaacatttagagtaagc

SEQ ID NO: 239461 - DNA, 635 bp, Homo sapiens
tcttctgctctttcttaaaatgaggacagtcccctttcactacattcctaaaattaaaagtttacgtgtgtgtagagattaaaagaatagcacaatggcttgttgtgtataaaaaatatcaaattttgtgtttttcaacataaataggagttgaacagtatagattgcattaaaatgtttgaatgttttaataatacaataaaatagataattagctattaacctattaaaataggtatgaactattagcataccttatgtaggtgaggattggtaggctatacttcaaaattggcaggaatgttttgcaattattcttctcaaggttattaatgattattaaaaattctcttggtattttttttcagaaacttgctcttctttattgtgtacaatgcctgaaggttgtcttagaagtaagctaggctagcactggctcttcccgtgccaatccagatgttccttttgcaggcaattactcctcagtttatttccccagtttatttcccgccaaggatttgtctttttccagggagccaattatgcacgtcttatactataatctgtgtcacttgaatctgaccctgggaaattgcctactttaggaggttgtgctacttaagatcttctaccag

SEQ ID NO: 239462 - DNA, 431 bp, Homo sapiens
tgagagtcactcatcacgagaacagcatgggggaaactgcccccatgatccgattacttccacctggtcttgccctttacatgtggggattattacaattcaaggtgagatctgggtggggacacagagccaaaccatataaggcacactgctcaccaacattaggtagagttcatacatttctttctctcagcaatggacaatggatacattagaatgaggatgattgctgcaatgctaaccagctaataaatagaagtggactgggatgagagtccaggcaattgcctaatgagccccgctatacatatttgcaaaaatgtagaatgatgccattcttttttgttttggcaaatagttatttttcattaaaaatgtaatgttatgttaatattggataaaaattgatttaataaaaatgttataacatg

SEQ ID NO: 239463 - DNA, 523 bp, Homo sapiens
cagagctggcatgtgaatccagctgccctggcctgcaagctaagggcctcgtgtcttacctctgctgcctcacagtcctgtgggtgtttctgtagtcgctgattactcgttgacttatttttgcttttaagacatcttagtataacgacaagctcctggcatgtactattcttaggcatttcacaggagaagttggagcctgggtgggtttggggaggcacccctagtcttggccgctgctccgcccttccaggccacagtttcctgcacatgcttgtgcagctcagtggtcattcgctgtggaaatagcagaattgctcattttcaatgtccggccccatcaaccttcaaaatattccatggcgggccctgtgcctggtccttgtgcatggccttggaagacatggccatggaattaaaaaacaaaaaagctttgactatcagttagcagccatccaacaaatcaagagaccttgttttgaactcttgaaaaagaacataaatgactgtactttttggagga

SEQ ID NO: 239464 - DNA, 220 bp, Homo sapiens
caaaaaaaccatcctgggcaacatggcgaaaccccatttcgacaaaaattaaacaaaacaaaacaaaacaaaaaaacagctgggaatggtggtatgtgcctgtagttccagctactggggaacccgaggtgggaggattgcttgaactggggaggtggaggttgcagtgagctgagatcatgccactgcactccaggttgggtcacagactgagatgcca

SEQ ID NO: 239465 - DNA, 135 bp, Homo sapiens
ctgccctgggtgtctaaaagtctggtgttttttttctttcttcctttgagtagttctgaatagcattgaagaagcttaaaacaggaagaaaacctgccttttcaatcaagtttatttatagctactcccccctcc

SEQ ID NO: 239466 - DNA, 381 bp, Homo sapiens
ctcatcacttctttgttcttggttttcacgtctcaacagggttcttcctagttggggtggtctggagtcagaaaggcccccagggtctccccagattttagaattctaaggcctaacccacaagtctgtggtttggagtgaatttgtatgggttgggggtctccttcaagtcacttaatgctttcagaaaatgtgaaaaaaattagtggggcatggtggggtacacctgtggtcccagctactctggaggttgaggcgggaggattgcttgaatccaggaggttgaggctgcggtgagctatgatagcgccactgcactgcagcctgggcaacagagcgagaccctgtcaaaacaaacaaacacacacaaaccaaccaaac

SEQ ID NO: 239467 - DNA, 187 bp, Homo sapiens
ctctttcttttccctacataggacctgctgagaaacaatatcaattaatcaattatccaagttcagcaatttcagctggtctttttggggatatttcaataaagctttattcatgaacactgaaagttttaattcatgtaattttacatggcatgaaataatataaatctcttacattttcaatcgc

SEQ ID NO: 239468 - DNA, 1012 bp, Homo sapiens
cggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaatgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagatgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcatttatgaaacactttggaaaaagaaaagcctttttgaagaggttccatggatgagtgcacccattcaagttgggttagttggttctgttggtggttgctaacacccctgttttgtgcctgtttcctcagaaaagtcctgttgtgacaagcttgaagccgagttgaaactagatccaagaccatctcgaattcaagcgtgatcaaaggt

SEQ ID NO: 239469 - DNA, 959 bp, Homo sapiens
cggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagctggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagatgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcatttatgaaacactttggaaaaagaaaagcctttttgaagaggttccatggatgagtgcacccattcaagttgggttagttggttctgttggtggttgctaacacccctgttttgtgcctgtttcctcagaaaagtcctgttgtgacaagcttgaagccgagttgaaactagatccaagaccatctcgaattcaagcgtgatcaaaggt

SEQ ID NO: 239470 - DNA, 986 bp, Homo sapiens
cggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacagagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagatgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcatttatgaaacactttggaaaaagaaaagcctttttgaagaggttccatggatgagtgcacccattcaagttgggttagttggttctgttggtggttgctaacacccctgttttgtgcctgtttcctcagaaaagtcctgttgtgacaagcttgaagccgagttgaaactagatccaagaccatctcgaattcaagcgtgatcaaaggt

SEQ ID NO: 239471 - DNA, 453 bp, Homo sapiens
tgctgcccctacacactgatggaaaaattgtgttctgcagaaaactagagttcctcacagggtgaggaagagttatggtcatctgcacagttgtagcccgttgcgagtgttttcccatgtgcacagtgatatctaggcaagtgtgccatgatttcctggtgaggataaaatctatggacggtgagagaactagtcaaggaataactgaagtgagctgcagacaggattatcattttgagtaacatcccaatgtatttgtcatcctttaattaatttttatttttttaattaaaaaataatttttaagtgtaaacctttaatgatccacaaagcccaaaatgtccatttgattttcataggtatcgtttccatatgcttagacttccagcagctattagaagagaaaaatatgtaacagctttgtgtttaattaaaggcaaatgaaatccagtc

SEQ ID NO: 239472 - DNA, 494 bp, Homo sapiens
cctcataacaccatcagacagaacccgaggctacagaagcctatgatttagttagcctaaacccataaatatgtaggctgcatacatatacttactttggtttttggtcaacctcaaacattttattttgtttattaggaagatgtctttcctcattatatgataactattatttatactaaactagtttgagagaaacaatcaagtgaacatgtgtgcaatttgttaaaagaaatcatccaaaaagataaacttagagaaatgagaatttgagcccacactcaattttttgccctaaggctatttttcaacattttacataaaaaataattctctgttttatgctcacacatggtagaccaaatatttgtatgaagatcttcacagcagcttctagaacatatcttccgaaaccttcagagaaattgttttaatttgtcttgaatggcttaagtgatgccttgctggaaataaattgctatattagatgtcta

SEQ ID NO: 239473 - DNA, 380 bp, Homo sapiens
gctttcatgtgaatcctccatttccctctggtctctataatatcactcaatgaagctttccctagccacctatttaaaattacagtaactccatcaatacttctattcccccctcctatcttacttttttattcccagcacttaacatttgacgttgttatatttattgtatgcctcggtgaattgtcctttgttcactgctgtgtctccagcacttagaacagtgcctggcattcttaattgtcacttagtgaatatgaatgagtttcacatttggcagagctaagtttaagtgtggtctttagctttataagtgctgttgcatccctggcacttagcacagtgctcaacagtagatactattcattgtgctaattatt

SEQ ID NO: 239474 - DNA, 340 bp, Homo sapiens
gctactcagaatgcgacggtgaaatgaaagggataatactctcccattctcttgtaatttggaaattctccggacctaaagccagatcagcctctgctctaccagcaccaaaactgtgcacgaggcacactgtagtcatctaaggaactggagatgttagcctgagaacgagaagacaagatgtgcttgctgggctcaaacgtgtgaaggtctactttgtgagaaagggattggattcactctttggagttaagataacttttctaacaatgaaagccatcctagctgacataatgtgaccctcaaacacttcctttattgagtgagaggctggacaaaa

SEQ ID NO: 239475 - DNA, 2224 bp, Homo sapiens
aatttctagagtttgggttcactactttgtctcaccgtgattacagagaagttacaaatatcattactagtagaagactttaatacacctctgtcagcatgttgacaaggaatccaaaaacaaagagtagtctccagattctgcaagacagtgtgaaatggcaccacatggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatttataccacaatattttaaatatatatgagaacattcttacgagcttggtgtctaaagacctctacaaactacagatcttaaaggaaatgctcgtgtggatgagtaaagatagttcatatctgcaagagagaataatggtgatcatcaacaaggtgttaagatttacagtcacaaaagtcagaaaatacttaagtgttgatgctccatgtttgggtctcctggcagcagagctgtctcttttgtgttcccatgaagatccctcgattgtaaaacaagcatcattgggaatgtgtcacctcctctacattgcacggtgtcagaacgatattggaacaaataagcctacaaacggtaaaagtcatagcctccagtttccttcttctgatgtagaatttctacccaaggagtttcaacaagacgaaagtaaaatagctcagagagtagggcaaaccttactgcctcccttgctgactgactttgtacagagtctcctgatgaaactctcttcacctgatgataaaatcgcatctgatgcagcatccatactgatatttactctggaatttcatgccgagaaggtcaccatggtgtctaagatcgtggatgctatttacaggcaactgtgtgataacaattgtatgaaggatgttatgttgcaggttatcactttgttgacatgcacttcacccaagaaggtcatctttcaacttatggactacccagttccagcagacgacactctgatacagatgtggaaggcggcatgttctcaggcgagcgtggcccctcacgtgctgaagacaatcttattgatactgaaaggaaagcctggggaaatggaggacaccgtaacggaagggaaacgtttctctcttgatattaccaacttgatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgaagttatctctataagctctcagtagaaggtcctagaaggtcagaagacactgtcatcgtattaatattcctcactgaagtgagttttgtagactgtgaacagctgtgttctcatttccttttcttacccaaatttaaatcaaaattccagtttctcgtatctctccctctgaatgttggttcttaccaagacttaagatcatgaaagatatttgaagtcggatggggagaggtgtggagttagatctgggttatggaagagttgtcccttcagctttccccagcagttggtttttctctgtttctaggggtgtgaatttgtacaaaaactaattattttttaggaccagtttatatatttctgcatgattgttaaagtatattgagggataattgggtttaataaagatggtagttaacatctgggatctaggcagtacttttgaccatttagagggagaaaggaactggctgagtaactgggtaaaatgaagatgtggaaccatattactttgtatatcaatattgtgccatgtattgtaatactataatggaatcaagcaaattgacaaacttttgtttacaaaaaataaaggctttataacctg

SEQ ID NO: 239476 - DNA, 247 bp, Homo sapiens
tgtttcctctcaagcaatgtttcctgaaatatacctgagcttggaacagcatggatctgtacgagctggtgccccactagttgatgacatggcttcatgaaaacagaggagcacctcaccactagaagagacccttgcagtaggaaacaaagctgcatgagaaaaggtgggatgggatggaaacggcctactcactcccccaggagtggagaggaggaagcctgaagggatgagggcagggttatgc

SEQ ID NO: 239477 - DNA, 520 bp, Homo sapiens
caaaagtatatttacagattttcaaataattaggaaatgttagtaatatttagaagctcctcagatgattctagttttcagccatggttgagaatgttgctaaaaagtagtgttatggctgatttccgagaaggaaacagaggttcagagtggttaagcaacttgtccaaagtcacacagccagaacatagtggagtgggaactccactgaggcaggctgactgcttaacccatgtgtctgttgtgccccaggcactgtcacatattatttcatttaattctctcaacaactttgtttttttaactctgaaaactaatccagaaaagttaaataaccagcccaaaattgcagagctaataaaaggcagctaacagtgttttctatcttgattctatttgggtggacaagtgtgtgtacttgtcaatagtcatttgatgggtcacttaagatctgtacatcacactatatgttgattttacttttaaaaggcacaaataaactgccctctgggtaacaata

SEQ ID NO: 239478 - DNA, 629 bp, Homo sapiens
taagcccttcgataatcaagatgagactcttatgtcttgtatccctcaagttaattccagtgcatttctttaaaagaggtttgggcaagaaagcaatgaatctaataaggctatcagaaaagttcagaacacaatgccacgcttcttcgacaatgaaggcagtacataacaaattccctcatttgcttggaaagtattgatgaaacaattaacttatttcattaatctgttaagaaatgaagtatttttttaaaggactgaataaaagtctctttatataaaatcattcaaataataatcttagctatttcctgtttgtcaaacaaagattaaaagcatgtatgtggcaaagcgtggtggctcctgccagcactttgggatgccgaggcaggaggtttacctgagcccaggactttgagaccagcctggacaacacacgaagactttgtctctacaaaaataaaaataaaaaaattattcatgcgtcacggtacatacctgtagtcacagttgtttgggaggctgaggtgggaggatgacttgagagttcaaggctgcagtgagttaggattgcaccagtgcactccagcctgggcaacagagtaagacctgtcccttaaaaaaaaata

SEQ ID NO: 239479 - DNA, 608 bp, Homo sapiens
gagacagtgtcttgctctgacgcccaggccgaagtacagtggcatgatcatggctcactgcagccttgacctcctggggccaagtgatcctctcaccttagcctctctagtagctgggaccacagatgcgtgccaccacacccagcttatttttgtattttttgtagagacagggtctcaccatgttgtccaggctggtctcaaactcctggactcaagcaatccacctacctccgcctcccagggtgctgggattacatgtgtgagcaaccgtgcccagcccacataaatctttctaaactgtgtctgtgatagtcttttctcctgccatacactttttagtggttctctttgtactcagaatgtaattcatatatttgaacttacaagccccttcaaaacttagcaccaccaagcccagctaattttttttggagagatgacgtttcaatatgttgcttaggctggtcttgaactcctggcctcaagcagttctcccgccttgacctaccaaagtgctgggattacaggcatgagccatcatggccagcctagatatttttttgtcgagaaaagtgagacaaaggaacaccgggatcctcgagaac

SEQ ID NO: 239480 - DNA, 479 bp, Homo sapiens
gggagtgacaggatccactcttaactgctatgtggaccagctggagtgggacaaggataaagacaggaagaacagttaaaaggctgatgtggtaatccagtttaaaaagacagcaacctgcagtagagtgatgggagtgagagaacagtgagaagaaagaaattcgagaatttaggaaagaatcaacaggactatggtaattaccggaagaagctctgaattcaaaaatggtcttaaaaattaagtttgttttgctaaataaccaccaaccaaaaactttaccagtagtcaacatgctcaaatcaacattaaaataagatatacttgagtggtttcatatctaatcactcatatgagcactgccttgctcttcatctatggaacaaattcctcctagaatttactacttagataaaaaactctaaatcagtggttggcctttttgtgcatggaaccctttgaaaaatctaataaaagca

SEQ ID NO: 239481 - DNA, 451 bp, Homo sapiens
cctaaaacaaagactgagagaggttatgtgacacacccaatgttgcagaacatccggtaaaacaggaatttgatctcaggcatctcttcgccatcaccaagaaattacttagctgcccctttaattgtgctttttctgtaagaacagagctcattattgaaggctgtaaagcaacactgaactttcatgcacatctattagatgttaacaactgaactacaacttggaataagaataaaagaaatagaaatccaaggtactatcaggtactattattacaacctcaagtggttcagtttcttgactgagtcttattttattaaacctgagcagatttaaatttaccaaatcatgtttgatttgtccgtagctccaagatctgtggcgaagtccctgtgtaacagcattgattttgctgcagttttacttgccccaagagatttaacattta

SEQ ID NO: 239482 - DNA, 293 bp, Homo sapiens
atgaataaaactgatagctttcaggattaagaaatatatttttgcctatttatttctggtacaggcttctaaaaaagatttttaaaattgtcttcttgatgaggatattttgagtgacatagacccgtccttcaattcttgatggtaaactttctgaagagcaatttttaagctctatgaggaacttacaaagtattcatacctttttaggaatctaagttcacaaaataaactgaagtgttagaaagatttatttcctattatttttggtacagtgttatgcatactagaga

SEQ ID NO: 239483 - DNA, 585 bp, Homo sapiens
taatgatagcagtttgcagttggaggcttaagtagagaaaaggtaacatttacatagtcatcatagggaaatttgaaaggaaatcagcaagatttcaataaaaggatagatgggcagtagagagagtttgattgaaaatggatagcaagatctgtagtaggactgtgtaacttcttgtttttctgttagagctttatcatcttggagcaaaaatagagaaaactgatggtggaccaggaggataacagcgatagagtcaaacttgaatttgaatctctgctatccatatcattggttgggtgactttggttaagttatttaatccatatgagcctaagttttatcatgtctaaaactggcataatacctctattgcaaattatagtattggatgagatcatgttggaaaatccctcacaagttctataaatgttaattcctttttctttttctgcaaagagtgagtcagtaacagcacagtaaggatgacatttaagggcttaattataattccaggctgagtaggaactctaaagtagccaggaataatctcttggactgagtaaaagcggggaggagttgagt

SEQ ID NO: 239484 - DNA, 497 bp, Homo sapiens
ccgactgcatgtaaggggaagtcagcccctcataaagtgaacctaaattgcttagcccccaagaatatttgttctctaatgagcctagtgtgggtaaggctgcacctggtgaagggggcagggtcagaaactccgctgctggagatcttttccagcaaggaaaagtctcctgggacctgaaaggcacttaacctcacccagactgccgctaaagaacaatgaacttaggagtcttcgctgtgctcctcttaagtttgtaagagactgtaataagtctcttactctctccgggcctcagtttcctcatctataaattgaagaatctagaccagataagaggtctccagcctggcttgactagtggaggaccccttttaccatgtatactcttgccaacaccttggaagtattttatcatgcaataatttgtgtatgatgtgtaatagagaagggattgttaaataaaacttattttagatccatgtataaccttaaaa

SEQ ID NO: 239485 - DNA, 373 bp, Homo sapiens
ggaattttctctaacctcataacaaatgaaaaatgaatcttatagaacctgtagtagatatcatactcagtggttaaaagctaaaaacatctcctaaagaaacaaaatgaataagaattggaaaggaaggaagaagacaaagagtgattattcttagatgaagcgataactcaaaataatctgcttatatgaatgataactcgaaataatctacttagaaataattagaattactaagttagtaaaataaataattacaattaataaaagatatcaagattgatggatataaaatcaatatacacaatccagttcactgtctagataatggtaacaaacagaaaaaagaatttaaacaaaacttaccatttac

SEQ ID NO: 239486 - DNA, 1072 bp, Homo sapiens
gaaaggtgggagcgaaataaaacaaggagcagaaccgcgaagaagccatgtttggtgcgtcgaagtttaaactcgtaggacttgggaggagccaaggtatatccgcagaagagaccacccctgccctttcgctttgacgctcattgggccttttggctgcgcatttcaccccgggctgagaaaacaagctggggattcgacaagaatgaactcaaagtctggaaacggcagcttctgagagtttacaatgtttcaccaactgtcgtccaaataagtcgtcacccctgtcagagtagttgcagctctgccgttacccactgctgtcactgtggccgttttattcgcgagggttacagttctgtttagcatgcatctaatgacttaagactccacgcaagtaaaacggagtttcctcccattaagtattggctttgctttaacagtgctttgagaggctctctgtggccaacatatcttctcatatctttgtcctcgtttcccaatctccgcgtggtgaaatcatctatcaagacttggcttaaaggacctctcttctgcaaataatgccatcttccgctaggtgctcactgcacacagactcgccgcccaccacttctgtccaccttctgaactccgatagttatttacccagagactgtttctcatctttaagtgtcgtgaagactttaagatctgttttatctctctataccccaaaatggcctagcacagtaactaggacattgtaggtgctcaataaatgtttgtcgaatatcaatgacagcaggaggcagtaaatggtccctctttgtagggcctacagctgtgcctgagtaggatgtacagaagtcctgcatacgtgtgaagtgtctccaggaagctgcactggaggggacaggaaatgtgggtaatcgtatggtgcaagtggtagcaaaaaagacaacataaggaaaatgttatttaggttttgcccagtcttgctgtttaaagccctgtgttagatgcttttcatgcgctattttactgaatgtaaacaaccaccttattaaatatactcacttttttaaaacga

SEQ ID NO: 239487 - DNA, 382 bp, Homo sapiens
tctgattcctttgcaattttaaaaaatgttaaaaacatgtctttttgggtttgaaagagctaggatgtgcgtctatgtgcttggggtgagccctgggcacttcgctcccctgtggcaacttgtgggtacggtttaactggaccacgctgagcttctgcagcgttggaacctcaagtttggggggactgggcgggcagggtcgcctgccacgcaggcccgagaaagaggagagtggtggagggggcgttctcacgcctggccccagggcacacggctgcgcccgccgcccggaaccccaccggggctgcaagcgtcctcggggtgggttgcggtgggagtaggggagctggggtgcgtggtggtaggtggggtgcgcggccgc

SEQ ID NO: 239488 - DNA, 2319 bp, Homo sapiens
  misc_feature (519)..(519): n is a, c, g, or t
  misc_feature (567)..(567): n is a, c, g, or t
  misc_feature (569)..(569): n is a, c, g, or t
  misc_feature (575)..(576): n is a, c, g, or t
  misc_feature (653)..(653): n is a, c, g, or t
  misc_feature (866)..(866): n is a, c, g, or t
aatgtatttatcttcattgaacagtcgtcttcagaactgttctttttttcttgagacagggactcatgctgtcacccaggctggagtgcagtggcgcaatctcggctccctgcagccttcacctcctgggctcaagcaatccaaccccttctgcctcccaagtagctgggactgcaggcgcgagccaccatgtccagctaatttttgtatttttttgtagacatggggtttcaccatgttgcccaggctggtcttgaactcctgagctcaagtgacctgcctgcctcaaccacccaaaatgctggaattacagtcatgagctactgcaccccatccagcggaattgtcagttctgaggtgacaaatgttccccaaaatcactatgctatgcaaagacatgcattaaaaaccacagggagtctaggcacagtaactcatgcctgtaatcccagtgctttgagaggctgaggtgggaggattgcttgaggccaggagttcaagaccagctgggacaacatngcaagaccccatttctaccaaaaaaaattagctgggcttggtggcacncncctgtnnttctagctatttgggaggttgaggtgaaaagatcgcttaaacctaggagttcagggctgcgatgagccatgatcacnccactgtactccagcctgggtaacagcgagactttgtctctaaaatagtaataaaaataataagataaaaaccccagggcttgtggggaaaattggatcgaggtacaacactaaaaaaaaaggtcatcagtgccacatgaaacaaagtaggaacctaataaaagtggtagagtggttttacacgttaagtgattaagaaataaatagtgcaanaaatatgatactttaccttgaaaaatacctgaagctcagttgcggaagtggacattggaagggttgcagcttgtgagtcactgtgaagtggtggaggagagttatctggatggaatctgatggatttggttatggaagtagcccataacacacacggaatggaggtagctggcagatatctgtgttgcatgcatgtaggcattttgtgtattcctgcattcctacgtgtagctgcgttcatctatgtggagttttctgcattcacccattatttcttgaggatgatgttgtgtgtaagcaaatgtgaacttcgggttatgctcaattattccctaatacattgatctcattgaaacaagttcacattttcaaaacaagcattataacggaactgactctatacagttcatgacatgcagcttctggatttggcgagttggaggaatgagaatatagaaaggttacactctacataattttcttgttctcaagtaacaaacccatgttaattagaaattttagagttaatccattttattaatggtcaacatatacccaaagtatttcacgacaccaacgtgtgcatcgtgtatgtctgactcatatgctttgactcctcatcagaattctgcaggagcccttctccctaggataaatccctcaattttaaggtatgccctgtagggccctttacagtctcaccctgttcagccttatcattagtcctccctcttactcctccccagcccctcaggaatgcatagctgtttcacttcccttaaaccaagcatgctttctcatacttctgtgttgtttcccttcactgtctcttctgaccagagtgattgatgtagccacaaaatagagtcccttccagtctcagcccaagcaccttgtgtcccatggagccttctctgctaggagctttcagcacttgtaataagtagctggggccctagttaagctgcagatttcagagcccctccccaaacctaaagcagcagcatcttgagatggagggtgtcctacgtaatctgcaaatgtttcccgttttgaatgtcagagaactacttgtgtttacttataaggctcttgcaggcgcttgtcactgtatcttctgtgccagatattgtgtctggcactcagtaaacgtttaggaataaatgaatgctgttgagggttttgtgtgttgtgcaagtattgagatgtcttaggctttgctctggcgtcctctagagcctgaaaagttgcttcatttctcagcagcatttaccaaccacttatttaaaaagctaataggaattgttggtatttagtgagagatggggtataacttaagggatgaactaacaaaagtatgataggcatatgaataaaccaggcaatttagagaattatttccttctcacctttttttctttccagaagtctcagaagtggtaatgtttatgtt

SEQ ID NO: 239489 - DNA, 1555 bp, Homo sapiens
atttcaagcactgactgctaagattggcatgtctccagccacgtacatttgcaaaaagtcagatttgcaatgtaatatgtcatggagctcatgcttgttgaagagaatctttgataggctggacacattcattttagtaggaggcagaggtggcctaacagcaaactctaggttcaggatctaattttcatagccttcaaggatgaatgcaatataaactgtgtagtagattgtgatgctcattccaactagggaggcaagcatttgtacctgctatctacaaggcaccaaataatgcatgtgtcaccattgctataaattgtcctcttccaggacctaactatttgggtaaagaacctacagttcccatcaccacctatgtatgtatgtacaaacataaattagtccaaattctaattttctcttatttttctttgtggaaaaacagataagaaagctcagtaaaggaagatataagcaattaatgttacagttcttcaatataataatttgaattaaatgtactaagaagcaaaaactattagtgttgagactatcatgatgaagcttttggtttttttaatatattttcatttttatgcataaaatcttaatacatagaattccatgatgtcatcaggcattaacaatcacttaccttagaaaccaactctttttatctaggcttaacagggtttgtattaatgtattggcctagcactgggccctgctagatgctcaataaatatttgcctaatcactattagacattttaaaatatcttttggctgggaacagtggctcacacctgtaattccagctctttgaaaggccaaagcaggaagatcccttgagcccaggagtttgagaccagcctgggcaacatagggagaacctgtccctacaaaaaatggaaatttagccaggcacagtggtatgcacttatggtccctgctacttggaggatgactcaggaggattgcttgagcctcctaggatgtcaaggctgcagggagctgtgatcacaccactgcattccagcctgggtgacagagcaaaacccagtctataaaaagaaaaaacatatttcagtttatttttatttctgtgttaattgtttagaaccaagaaaatatgagtaccttaaattctgtaagtaaagaggaaaatgtctttaacattgtaggaaattaggaattaagtaactgcccttcatactggtaatcttgatatgttgagggaagtgacttgttataagatagaggccaggtatggtggctcatgcctgtaatcccagcactttgggaggccgaggcgggcggatcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggagccactgcactccagcctaggcaacagagtgagactctgtctcaaaaaaaaaaag

SEQ ID NO: 239490 - DNA, 2584 bp, Homo sapiens
  misc_feature (20)..(20): n is a, c, g, or t
  misc_feature (1124)..(1124): n is a, c, g, or t
  misc_feature (1286)..(1286): n is a, c, g, or t
  misc_feature (1595)..(1595): n is a, c, g, or t
  misc_feature (1599)..(1599): n is a, c, g, or t
  misc_feature (1606)..(1606): n is a, c, g, or t
  misc_feature (2142)..(2142): n is a, c, g, or t
  misc_feature (2459)..(2459): n is a, c, g, or t
tttgaagttgtgcgagtttntgacgatgtgtaaagctacaacacttctctgtgcatgagctttagctctactttaacagtgaaaccagttggcaagagatgtaaccacaaagcagttttataacgtttcttaactctcttccctctcaagtttttagacctttagtcctgccaactccttctttcccctttatggttttaatttaaaaatttgttttatttaaatgggaagaagaattttaagtggaaggaaaaaatgtcagaaatcctaaatagagaggaaggggttttgttgtgactcaaagcaccattgtaagtctcctcctcccagaccctgctaggaacaggacagctgatgtcatgccagtacacacaatgtagattcagtgcaaaaggctgctgcatgttgaaactggccaaaggtaggaaatgactgggactgtagcagacaaaaatgctgattatgtgtaaggatatggtgagacactttttctcataaatatctagtgagatatgggtcagaacaagcctatctccctaaggctgcttggagaggagaaaaactttccatataagatcttactagtccgggcgtggtggctcaagcctgtaatcccagcattttgggaggcagaggttgggggatcacttgtggccaggagttcgagaccagcctggccaacatggtgaaaccccgtctccactaaaaatacaaaaattagccaggcatggtggcgttgctggtagtcacagctacttgggaggctgaggcaggagaatcacttgaacctgggaggtggaggatgcagtgagccgagatcatgccactgcactccagcctgggcaacagagtgagactctgtctcaaaaaatatataaaaataaaaataaagatcctactagatggctgatagcactgggccaccagattgattgctaaaggtataggaagatggaagaggctgggcacggtggcttacatctgtaatgagaatttagggaggcccaaggcaggaggattgcttgtgcccaggagtttgagaccagcctgggcaacatagccagacctcgtctctactaaaaatttaaaaattagccaggtgtggtagtatgcattgatagtcncacctcccaaatagctgggattataggcgcccgccaccacgcccagctaatttttgtatgtttagtagagacggagtttcatcatattggtcaggctggtcttgaactcctgacctcaggtgatctgcctgcctcaagcctcccaaagagctgggattacangcatgagccaccacgcccagtctcagtctagattatttttaacagttctgtcaggtattctatagtctgagctcaacctacctgtatagtctcacagccaatcttatactcaaaccttggaatactcatcccccaactgctactttttgaatcttttattcttaatatttcacgttttaacttcagtgtgtttatactttttgaaatgagaccagaacatagtagactttatagagaagaccagttttacctagattccaaaggaagaattaaactgctgttattgtttgaaatgcgtttttttttttntttnttttttntttttttatggagatagggtcttaactctgttgcccaggctggaggagtacagtggtacagttatggctcactgcagccttgacccctctgcctcagcctcccaaatagctggggccacaggtgtgtaccaccactctcagctaatttttaaaattttttatggagacagcgtttcgctatgttgcccagactgttcttaaactcctgggctcaagtgatcctcctgccttggcctcccaagctggtgaaattacaggcatgagccaccacacccagcctgaaattcttaaaggatgagaatgtcaatgacagagcaccttggcatcattgtgactaacctgggagacagggaagaagcacgccatgggaagtgtttacatttgggtacagctgtgctaagtactgtggagcccatagccttgaggtagacggctactttgccttttttcttgaactgtcttgcagaatgtggatttggggtaagtggtcttgaagcactcatttagtcaccctcaaattaagatttttacttcanctttcttgggcctgtacctccaagatgacaaagaaaagaagaaacaatggtcacaccaaagagggccgcaaccaggtgtacgctattcactgcagccaatttgctgcataaactgtgcccattgtgtgcccaatgacaaggcttattaagaaattcatcataggccgggcgcggtggctcacgcctgtaatcccagcactttgggaggctgaggcgggcggatcacgaagtcaggagattgagaccatcctggctaacacggtgaaaccctgtctctactaaaaacacaaaaaaattagttgggcgtggtggcgggngcctgtagtcccagctactcgggaggctgaggcaggagaatggcgtgaacccgggaggcagagcttgcagtgagccgagatcacgccactgcactccagcctgggcaagagtgagactccgtctc

SEQ ID NO: 239491 - DNA, 191 bp, Homo sapiens
tccaagggatcaggaggggatggcggttcaaaagccctcaccatagaggcgcctccaagccttcgtaccagtggaaatggagaccgggaccaccttcccggcacccggaagcctcccagcccctcctgggccaacttggctgcctattcagttttcttccgtaaccccacagacacgtcagtcaattccct

SEQ ID NO: 239492 - DNA, 466 bp, Homo sapiens
atccaaggcctgctcagtcgatcaaatgtgccatgatcaatatcaagcctggtgagctccccaaggaggctgcagtgggggcctacgtgaaggtgcacactgtggagcagggagaaattttgtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 239493 - DNA, 434 bp, Homo sapiens
acggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 239494 - DNA, 469 bp, Homo sapiens
atgtgtgtatatatatatgtgtgtgagaacaaaagacgtggggactaatggggaggggtggcactgagcaagggtgaaaaactacctgttgggtactatgctcacttccaaggtgacggatttggtcatattttaaaccccagcatcacacagtatacctttgtaacatccctgcatatgtaccccccaattctaaaaagttgagaacaacaaaaaaaagcaaaataaaatatttaaagcaataagaaattgtgacagatctaaatactcttcaaaaataaaaaaaagagccatactagacttataggaaaaatttaattgctatttaattaaaaattcaaaatataaggccaggtgcagtggcttacacctgtaatctcagcactttgggagtccaaggtgggtggatcacctgagatcaggagtttgagaccagcctgaccaacatggcaaaaacccatctctacta

SEQ ID NO: 239495 - DNA, 408 bp, Homo sapiens
caaaaacaaagatgagaaggcagggagaaagaaaagggaaagggggtagaaagggggtagagagagaaaaggatggggatttaactctctgataaatactaacatgtttacaatttttaaaaaatgggtcaggtgcagtggctcatgcctctaatcccagcactttgagaggtcaaggcattagaattgcttgagccaaagagttcgagatcacgctgggcaacacagtgaggcatctatctctagaaaatttttttaaaattagtcaggtgctgcggcatgcacctgtaagtctgaaagctggggcgggggattgttcaagcccaagagtttaaggctgcagtgaattataattgtgccactctactctagcctgagtgacagagtgagaccttgtctcaaaaaaaa

SEQ ID NO: 239496 - DNA, 346 bp, Homo sapiens
ggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttctcggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggc

SEQ ID NO: 239497 - DNA, 429 bp, Homo sapiens
ccatctgctcttggtccaatgtagaatagatggtacctcaggttgcagggagccatcctggttatgccacctctgtccccttgccacattgtccacacaccatccctgctcttggtccatgcattttgtgttgctgttccttggtaacctctgccactgcctatgacagcccgccactggtactatgttatgcaaattgccagcctcaatacaaaccctgtctatgaagaggcacttggttggcagagtgaaaacacagagtaacgagatgccatctgcatttcctactacatagctcaattagttgattgatttgtaacactttaaaaaacattttctaggcaaagcacattaggagagtgttttataatgtattcagtttaattaaaactgcactaagtggagtactttgcttcttggtttgagaaa

SEQ ID NO: 239498 - DNA, 480 bp, Homo sapiens
tgcgcctcatattctttgtctgaattacagaggcagaggtaatcttcccaaggcggtccaggcttcgctgagatgagttatgcagatctatcagcagaatgacttggacagggagaggttccataactgtcttctttccagagtcactcagagccattgtgagtgagactggaaagtagcccactgggaaaggaggctgggctagccccgagtgcccatgtgcagggaggaggtgacctggagccctgtcctccattggagcaaacgtctcacatctactagttgaaatggaggccttgatccacaaggagacacatgcagatgcacctttaaccccagagaaggacaccagtgcctgtcacccgggctcttgtgggccttgtaaggatgatatagttgcaatcagtaaggccaataaattacagattctgaggacaagagacagcattggagctggggtcatacagaagagttacctgt

SEQ ID NO: 239499 - DNA, 1568 bp, Homo sapiens
  misc_feature (263)..(263): n is a, c, g, or t
  misc_feature (644)..(644): n is a, c, g, or t
  misc_feature (1314)..(1314): n is a, c, g, or t
  misc_feature (1328)..(1328): n is a, c, g, or t
  misc_feature (1455)..(1455): n is a, c, g, or t
  misc_feature (1518)..(1518): n is a, c, g, or t
aaacaaagcgatggaatttgaggggtacaacccctacagttctgtccaaattcacttctctaaactcatgttctccctccactccaccctaaaccctggcctcctgaggcaacgaagtttgcctatctggaaccattttctgaagctggatggcagacggggagcctcaagagggaagaaaagaatggcaaacttttcattggcccagtggccggcctcataaatcatcattcataattagaattatttattcccaaatcacnatcccaagccccagtttcccctgtacctaaagctcttttcacttctagttcaagagagtcttgccccctctctgcgtctcaaaagtgatctcttctcttcctctaaactcacctgaagctttcaccaagtatgctggccggttctgcttcctaccctattgcctaccaaaaggagataattccagcccctctttctgagatagggtgttaatgaatccttactgaggcacagacctctggcctcctgcagagaggtcctcctggaagtgccctggggactctggagacctggcctcccagcagccactccctctgcttttaagaggaagctttagcctgagaaagtttgactccttcctgaaagctgcacttatttcagcnaggctgggctcaggtttcagggctcagggactctttctctccctttctccttcccaagactgaaatgcagctgcccagaagtgctgaggaggacacagagtcggcttcctaggcacaggcccagctctgtcccctttccttgtgctgggaccttgagtggaggggaggagtcagggagcctcagggaggcaaagcaggccacacatcgagggaagcggctggggagagctgactcgcaggaaatagtttcaccccagtggtccaggctggggttcccggtagctcctccaccattctccccgcaacacccaaccagctctgcttttaaaaggtgaacacaatctttcagaagctgcagcccaagccctttctggccctggcgaaccttccccattcccctcttgccaaacatttttataccaaaataattagataattaataatcatgtcaaatactgtgtttctggcactccatactttttaagctttggaatctgtgtgtaatagatctaaatagcagcccacaaacttggccaggcaacaaacatcccattcttgattgtctttaaaccaatgtaattctacttctgagcccctaccctcctgagtggcaagacatttcaagtcagaattactggggtctggttgggcgcggtggctcatgcctgtnatcccagcactttnggcggctgagatgggtggatcacttgaggccaggagtttgagaccagcctggccaacatggtgaaaccctgtctctattaaaaatacaaacattatctggttatggtggtgcgtgcctgtaatcccngctacccaggaggctgaggcagaagaatcgcttgaacttggtgggtggaggttgcaggagccnagactgtgccactgcactccagcctgggcgacagattgagactccatctc

SEQ ID NO: 239500 - DNA, 551 bp, Homo sapiens
tcttgagctcaattcagagcagcttggcttttgttctagaggactttgtgctatctacctaaaccaagagtgtccaactagttctgtgttgaggagagaaagttgccaagactgtcctgtcactgtgaggaatgaaccttttccactcaataattttagcaaaaggcataaatttaaaaggagctagatagaacaaataaaatttaacttttaaaaatatattcactggccaggtgcagtggctcacacctgtaatcccatctctttgtttgggaggccgaggcaagtggatcgcttgaggtcaggagtttgagaccagcttggccaacgtggtaaaaccttgtctctactaaaaatagaaaaattaggtgggtgtggtggcgcatccctctaatcccagctacttaagaggctgaggcaggagagtcacttgaacccgggtggcagagattgcagtgagccgagatcacgcctggataacagagccagagtgtctccgaaagaaaagaaaaagaataatcatggatatttgagaaatctgtgtaccatat

SEQ ID NO: 239501 - DNA, 423 bp, Homo sapiens
agaccttggctttccaactagaagatggtgagtgctctctcaccaagacaaaagccttatgaaatgagccagaataatcacccagacagtaaatactcttaaacaacaaccatactcacgctcagtgctatctagaagaattcagagagtgcctacactggtcctaaagttctcactgagctccatgaaagtttctgtgtcagagggggcaggttgagttttggtgtcagacttttgggttctaactttggctttgccacttgccagctgtatgcctcggtttcctcatccattgaatgggttgataataatgatatattcctcataaaattgtgaggatgaaatgagataatccaacatagagcactccatatggtgcctagcacacattaagtaaatgtttgcagttgttatcattggatt

SEQ ID NO: 239502 - DNA, 491 bp, Homo sapiens
gaatgtcaaacttagatttagatctcctgagcttttttccttaactttgctttttatccttactggcttcccagtgtttagaagatgaaagtaaagaattattaaacataggaaggagccacttcctaaggctattccaaagatagcaaaataaatctcacactcaaaaagcagagagagagataaaggtggcagggggtggtggtgggggaagaactgaagtaataaactgaagaacagtaaaacaatcagtgcaaactattcctgtgtcactcctcacaagatagtctttgcaatcttctcaatgcaaagatgacaacctacacgaaagacgccaggggagcagctttaatgtactgcatttgtaagacacctggctatgagtttgactcttgatctttccaacaatttagactcacaacacaaagagaagccatcaaagagtagagtgtaaaaaactacaggcactatggcaaacactttgggggaag

SEQ ID NO: 239503 - DNA, 597 bp, Homo sapiens
gtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgctggcagttcaaattcagctggaaactgtactcaggttcctcctagccctgccccattctttataacatggaaaccctgattccccccgccgaacactttccttcaggcagcatgatttttgcttcaccgtaaacacaccaggatcacggatgatgatagcatttattgcttggaataaaaagtgatttgcggccctgtaaataggacagcaaatagttttgcttttgacgtaaggctcccatgtcacttcatgatttcattcatcttcatattccagtatctgacatcaattcccagtgggagaaattgtgctttgctgcgtgtgtcttaactcagtctctgatgttctggttctgactcaggatgttggtgacagctgcaccacatatgccacgtctttcatgctagactaa

SEQ ID NO: 239504 - DNA, 293 bp, Homo sapiens
cacacacacacactgccccgtggaataggcaggacggggttgcatttcccctcttttaaaggtgaggatgctgagcctcagaaagatcaagtgacctgaacaaagtcacacagccaatgtgtttctccaaaagaaatgaccaggagtcagtgtttctttatacaagggtgtccaatcttttggcttctcggccacactggaagaagaagaattgtcttgggccacacataaagtacactagcactaatgatagctgatgagctaaaaaaataaaaataaaaatcacacacaaa

SEQ ID NO: 239505 - DNA, 419 bp, Homo sapiens
ccaggctctgctcttttaactttggatttaactgatgcttgacagaatacagagaaagattggtctcatcttacatctttccatgccactatttatctcctcaaatggaacaactggagatgctaaaaacccacttcttgaaattacaggacagaaaagaacttgtagtacttcacttccctggcacgtcttgagtgccatagacacttaatagtggctcatgcctcagtggagaactggggaaacaaattgtagaaaccaaaatggaactagagaggatagaaagacagatagtatagcagcttaaggaaagagactcaaatctttctagaggtttcccatctttgattcctcagagcatatattcttgacaaactgcaaaatgattcaatagatatgttatttttaaattaaaaaat

SEQ ID NO: 239506 - DNA, 409 bp, Homo sapiens
ggaaagaatcatgaagggactagtaattaagccttaaaagaagagtaggatttgggtgggtagatgtagcaaactgagttttgggtcagccttaccacagccttgtaccatctgacaagtcattaggactttctgatcctcaatctctttaactgtcaaaggggaataataccagtgctatgtttcagggttgtgagttcaaaatggataatatctcagagtactttgtaaattgtaggtgtttctgtccttatggtggagtatctattgttttctaagtttctaaactcactaactttcctcaatctgagcttttaattaattttttattattatttttgagaaagggctttactctgtcacccaggctggagtgcagtgtggaatgatcttagctcactgtgcgacc

SEQ ID NO: 239507 - DNA, 595 bp, Homo sapiens
aaaacataatgcaggttcagtcaattccgcttctaaatctcagccatgaaggaactgggaaggtgctcaatagccactattaacagttgttccttacaaccacatggcagcactgttgaagatctgtcctgcacagcccggtgaacacacatccattgtattgatgcccttgttttctccatttctgcacaagctgagattgtggtctatgtgtggcctcccagggtacagttcccacagttcatacagataggcttagccaagctttccctgccacaggacacagtgcttgggtggctatgtttaggagttaccagcacaagctatgctgggagcagcccttctcaacaagacttcaggccttgtattgagtccaagccagcaaataaactctcagtgacttcctgctcaattcctcttgggaatcttgggacagggacactattagtcttgacagattctcaattttgaatgtctgggtctgtcttttttttcctaataggcttttggcttcttctacaaatttttcaactcccatcttctgtggccagttcttcatacccaggggaggagatatttgcttttgttctaatat

SEQ ID NO: 239508 - DNA, 696 bp, Homo sapiens
cacatccacatgtgccccatcagcacgcctcctgtttcccctagaccttaagcagtgctgataccacgtctttttaacctcgcatacctgtcttactggtgaaaagggggttcttttttgatttcatttccctgatatgagtgaagttgagtatccattcatttggagattggcatgtgctccctggtgagtaaatctttgccactttccttttgaggtatttggcattttcatattgtttgaggtggctttttataacatccagaagatacggaatctgtggatgtgaattctttatatacatagaaaatatttttttccagtctgtcatcttttaaccttatatatggagtcttttgctctacagatctttataattgtatctaattagatctatcagcatttcctttaatggtttctaggtttcgtgtctgtgtcttccttaccccaggatcataaaataccttgagttttaaaaaaaaaaagtataattgttaatgcatttgaaatatatttttgtgaataggatgaagtagaaatctcacttcctagttttcaaatttgccaaaataatcaactattgcttcccccactagcttgaaaggctgcatttatcataaaccaaatccccatatccccacacaggtgtctgtggatgcatgtgtgtttactcttcagcctctaggtaaggagcat

SEQ ID NO: 239509 - DNA, 371 bp, Homo sapiens
gcaaatgccttcatgtcagtttaggagctgtgtaggctcctatggaatactccaccatttacattttcccaaagacacaattgtacaggttcataggaactcaagaacaggtattatttagcacctttcagagcagtagcttttaaacttttttttgacactaatccacagttaatacattttacatcacatccaagtgtgtgtatatgtatatatatatacctttaaaaataaaagttgcaagaatatgcatccaaactctatgctgtgcatactgatattttctattctcttccttttcattctttttttttttttttcaaaaagtgtaggttaccaccctaaaattagtttcacactcatcatttgaa

SEQ ID NO: 239510 - DNA, 379 bp, Homo sapiens
tccgagtgccatttaggaggtagaatccaaaggccctgtgggtcgagaggatgtgagaggtgtgataagtctcaggtttctgactatggcaattgcatatcctttactgagatgggaaacgcaggaggagaagctaaggggataacagctgtggttcggatcgtgttaagttttaggtgcctaagaggagatatcaggaggcccgtgagtggatgagtcagggctcagagagagatggaggctgagagcttgttttgggcctcatcagtctagagttggtgttcaaagcctttggaggagaagaaatgtgtattgaaagaaaggacctgaggacagaaccaagaggagcccctacctttaagaaagggaaagaaaagca

SEQ ID NO: 239511 - DNA, 481 bp, Homo sapiens
tctcatgctgaaatatgaggaggttgaaatgttgaaggttgggcctggtgggagatgtttgggtcattggggttgggtcctttatgaatggtttggtgtcttccccactgtaatgagttcatgtgaaagctggttgcttaaaagagcctggaacctcctctcctccctcttgctccccctctcaccatgtgatacacctgctcccccttcaccttctacaggtagtaaaactttcaaggcctcaccagaagccaagaagacgctgttgccatgcttgtacagtgtgcagatccatatgccaaataaacatattttccttataaattaccaggtattcctttatactaacgcaaaacagactaatatacgcatccatattcagcttctttgctcttctacttcctatcatattttgctgtaactttctggcacacaagtagacttaagcctgttcatccttagtagggaacattaggaaaca

SEQ ID NO: 239512 - DNA, 326 bp, Homo sapiens
tgatataggtgacttatgcttaaggaccactcatgtggtcacaaggatattctcaccggtatgttgttctgtggtggcagtttggcctgttttgaaaatggcccacatcacaagagtccttgtattattagctcagtcatcatcaggaccttttttttctttcttcttcttatattctctgccagttcttcaatattatgtccaaactgaagattgaaacaagttaatcccactaaactaatgctacatattttcttaggagttgccacagaaataggatcttatatacccatcccatcagtgaaataaagagccttaacaacaaa

SEQ ID NO: 239513 - DNA, 421 bp, Homo sapiens
tttactaactatcctaatgtcacttaaaagaaacaacaaagcagaagcaaccttaaaaagatataacaccaatgttgtagtccctcttccagaatatttagctattcttcaatctatactacagccctgacacgtcacaaagctccattcctgtgtgttatctagatgtaacatatctccagttgaattttcctccctacttcaaaccttataaaccagaggtcagcaatgtatgtcccacagccaatgctagtcagccacctgtttttgtaaataaggttttactgaaactcagctacacatattcatttacatattgtctgtggcttcttttgccttacgacagagtcgagtagtagcaacaaagatatgttggctcacaaagtcaaaaatatttgctacgtgaccatcttcagaaaaa

SEQ ID NO: 239514 - DNA, 355 bp, Homo sapiens
cagattcattgacaggtaaattcaaccaaacatttaaagaagagtgataccatttctacacagactcctccaggaagttaaagaggaacaactaggaggccaatattgttaccctaagaacaaaccagacaaagacatgacatgaacaggagagtacagaccaattatctctcatgaatgcagagttcttaacaaaattctaacaaactgaatctaataatatataaaaaggataatgtctcattactaatgggttttataccaggaattgaggttgtttctacattcacgaatcaatcagtgtagttaatcattaataacagactaaaaaagaaaaactgtatgatcatctgat

SEQ ID NO: 239515 - DNA, 380 bp, Homo sapiens
ataagctaattactctacagaaagtactgtaaacaacttgttattcttactctaatatgcgcatgcttttcaaaattttaaagttcttatatgatgaatgctatctcaagtaaggtatttattcataaggcgcttaaaatgtatgactaataacaagtgcaagcaagacagtgcttcataaaatattattaagcgcactattattgttacgcagtttttttaaaagggtgtaaatatctagaaaataatattcaatacctgctttttaagttgaattgttaaggtttctttttgttaaaatatattcacacaaaatgcatggtatcatagaagtaccccacagatctaaattccttagttacagcacaattttactagag

SEQ ID NO: 239516 - DNA, 460 bp, Homo sapiens
cgcgcccggcctttatgttttaaacatcgtttttgtgttcttgttcagtggttgccatgcagagagtgggatcagtcggcaggcacactcacccatccaaaaccggtttggatgttgggactgatggagggtgtgacaacacttattattcacataatggaatgttctggtgagaacagggcaagcacaggttggcccaggtggcaaaggcaaggcactgaggttgattttcagttttgttgtgaccaggaagcagagctgggctgagggttcttaccagggtgggctagctcaggtgtagggcaaagagacaagcagagagagagaaagagagagagaatgttggggtttgagggctgtcagtgttccaatgtcaaaatgaagttttcctcttaactatggtcccgataccttaatgagaacctgctaactaaataaagaatcttcaaatgagaaatga

SEQ ID NO: 239517 - DNA, 1903 bp, Homo sapiens
  misc_feature (49)..(49): n is a, c, g, or t
  misc_feature (1523)..(1523): n is a, c, g, or t
caatgggcatcgtgtgatgtaggaagaaagggttctggggtctgaggcnggagagacataggcatttgtaagaagaaaatccctccatcatagaggattccaggtagaggcaggttggctggagtggcaattagtccctggttttggcaggtatgaccacagagttctcctctcttgcaagggaacccatgagcttggacagagaggaagttctgttctttcacagggacctgcctggcatgcagttgaggtcagagggagtaaggctagtcctagtacaggtcccattttttccccctaaagccaggcagtacctaaaacttccagttccctgccaccccctccaccccacccccacccccatggtatagttttgactgaacaggaaaaaactagttggctaggctcaggtgtgcaaaataatactgggagaggtgttagtagccagaacacagggctccaccttttgttggaatcgccttcatatgtatatctaagaagatggagacttaatttttaaatctcacactcagttaactccattattgcccaaacgctatcttcctcttttgttgtaaagtagagaaagagggttttccccacatctccccttagtcctgcttagaagatggctgtgggatttgtgcttctttactgtagacagatcatgtcatctggacagcttcttcctaacaataaaaataatattaataataaaccactgtaatagataataaataacaaacttatcatgtgctaggttctgtgctaagccttttcctgggttccttaagaactaggatttgattcatgatcagaacccatggctctttgcctctgtgcttgcctgtgtgcatgtggtcctcatggcggaacacaagaaccacccacaacacccagcaagcaggcccaggatgcttgggtcctgagcccagacccactgtgaatgaattagggcctactgagagatttcctaggattggggaatctgaatgagtgaaaagcatcccgggagatgcttgactaggggctgactgctgctggttctgatgcccaccactagccctttctcttcccatgtgatccttctcctggctgatggtggtcctgctcccgtggcacttgatcagtccttccaccccttagtaatcatcttcccttctctgggctatgggtggttctccccactggccctggtgtttttccacactcactttaaactgtctggagctggtctgctttctttcatgtcagcgggtatgtatctttccaaccaaagagaaaacttctggaaggcagcaacagtcatttgccctgcctcctaacagtctccactttgtccgtgtctgtctctttccctcccttcctctccttttcccttttccttctccacctcagcacacagtgggagcttcctgttccttatttctcaagttgtcctgagcaaatcttcctcttaaggaatccttagtgcctgtccttgaggtgcccagcactggctgtgggcagcagcccttcacccnggccatggcctgccccgcccttcatggctgccccttttatggaagtgttgctggtttccaaagctccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggcatctagagagaatgccttatttttctttccacacataaccacaaaaaagttaaaagcactttttaaaagacactttcccctcaattacctgtggtaagaaatgctgttcttatattacattccttcctcacccattt

SEQ ID NO: 239518 - DNA, 543 bp, Homo sapiens
cggccgccagccccgggcccgcgcccccagagaggccgagctgggagggacgagaggggggcgcgcactccaagtggccgcggctgccgcacccgcgcgaccccgccaggtgcgccgctcctcctgcactttcgggtctgcgcgggcgccactttcttccgcgccatctggtgtcagcctttggggaggggccttccccccaaggcaggggttggccctggattggaggctgaagccctgggatccgggagcagaaggtgccaagccccacctgcctgcccgctcgccactgttgtggagccaaacaattggacgcctgggactgaaacgggaaggtggtgccatgggggagaatccgagccctggggtggaacctgggccaggtggaattacctgcggcggtggttcgagttgggggagttcgggggtccgctgcagccgttcactcattcacttgctcaattcaatcaacacgtgtttactgcaggcctaccatgtgtaaggtggggaggggcatttatcgaaaaagtgaaacacaggtgc

SEQ ID NO: 239519 - DNA, 597 bp, Homo sapiens
  misc_feature (1)..(1): n is a, c, g, or t
  misc_feature (108)..(108): n is a, c, g, or t
ntttacaccttaggtcattacatattaagaatttgaatctatatggtgacaggattttttcaggtttatctcaccccgatgttgggggaaaaaaatctccagaactcnatagtctcttgaaatgattgtccactgaagttccacgtattcataaagtgctcccacaacttgctgacaagcataggtattttacatcctgccatgagtttcaagacattaactcctttagctatcaaaaatggataaaaaccacaggtgactgacaagactttcacaagtgcagacaaaggtttggattcaaagcctggtcatatggtttggctgtgtccccacccaaatctcatcttgaattcccacatgttgcaggagggaatcagtgggaggtaattgaatcatgggggcaggtctttcccatgctgttctcgtgacagtgaataagtcttatgagatttgatggtttcataagggggagtttccctgcacaagctctcttctcttgtctgctgccatgtgagacatgcctttcaccttctgccatgactgtgaggcctccccagccatgtaaaactgtaagtccaataaacctctttcttctgt

SEQ ID NO: 239520 - DNA, 882 bp, Homo sapiens
ccctcccacccccaccctaggtcctggaattcagctcacggcctggggactgcttcaaaaggcaggtcttggtctgaggagagggcagtcagggcatgaagctgcagccgccaccgctgcttctacaaaatctaagcactgggctgcagccatgtcctactgccagcaggaagggaaggatgcaatcatttgtgatgtaaaaagaccatgcagctccaagcaacacagctgatgaccccagtgatccctatggggggagcacggattgaggctgccaaatggagacattaactggaactgcctgtgccttgggggaagggccagcggcccctgtggggaacaattcaagctggacttttcctgcttccactatagtatggagaatgtcaaggggtcagactgtgtagaccaattggggccatgcaggaatgcatgcagaaatacccagatctttgtccccaagaaggtgaggcagaggtagaggaaaagcccgcagaacatgtagaagtagcagctcccactgaggccactgcaaccaaagaggaggaggggtcaagttaatgaaggccataggactccagtccttccaccccttcagagtgacacggaccttttgcaaaatgccatttagtcaccctccaacaaagtgtctttccctctgttgtcctgtaaactgtaatgtacgaaataacatattttgatgatcggggtcttggcctcttgacatatacgctaaaaaaatgggggttgttttatatgtgtcctgtgtaaacctgtcggcaaatatagccaccacttttgaattctcctagatggccctgaattttgccactttgaaataatgtgctactcaatctcagcaaccaaaaaccattatccagg

SEQ ID NO: 239521 - DNA, 832 bp, Homo sapiens
ccctcccacccccaccctaggtcctggaattcagctcacggcctggggactgcttcaaaaggcaggtcttggtctgaggagagggcagtcagggcatgaagctgcagccgccaccgctgcttctacaaaatctaagcactgggctgcagccatgtcctactgccagcaggaagggaaggatgcaatcatttgtgatgtaaaaagaccatgcagctccaagcaacacagctgatgaccccagtgatccctatggggggagcacggattgaggctgccaaatggagacattaactggaactgcctgtgccttgggggaagggccagcggcccctgtggggaacaattcaagctggacttttcctgcttccactatagtatggagaatgtcaaggggtcagactgtgtagaccaataaggtgaggcagaggtagaggaaaagcccgcagaacatgtagaagtagcagctcccactgaggccactgcaaccaaagaggaggaggggtcaagttaatgaaggccataggactccagtccttccaccccttcagagtgacacggaccttttgcaaaatgccatttagtcaccctccaacaaagtgtctttccctctgttgtcctgtaaactgtaatgtacgaaataacatattttgatgatcggggtcttggcctcttgacatatacgctaaaaaaatgggggttgttttatatgtgtcctgtgtaaacctgtcggcaaatatagccaccacttttgaattctcctagatggccctgaattttgccactttgaaataatgtgctactcaatctcagcaaccaaaaaccattatccagg

SEQ ID NO: 239522 - DNA, 607 bp, Homo sapiens
cagaaggtgaggctttgcttgtcgacctgcttcagtagtagcattgacagaacagtctctgtgtactctgtcccctcagtgctttctgcatatgtgttgctcactcatcactatctgcatgttcgtggtctctggaaagaatcaactataatgatcagaataattgcctggtaggacgtatttcctttgagttcagcaagacgtgccccctcacatggtgttcctgttcattcataaggctgtaataatgtatgagttaggagacccttttgaccaattcccctctgttttccatcttggaaaaaccagaactctgttttcttgagcaaatgacgttgccaccagccctgaagctccttttcctgggtttgtaggggttggtggaatcctggcagtctgccgctcttcctggcctccagagatcagggctgtgactttccatctgcagatggcagttctagctgcgaggttggtggccgaggaggacgaggacacagctcagggcctgtccttcaagggcttccgtgtgcagcagcagcactctgtaatatcatagatgaatttttgtcaaaacacagagaaaagttgattacacttctcatttatt

SEQ ID NO: 239523 - DNA, 465 bp, Homo sapiens
catgacacctggcttatttttgtattttgtgtgtgtgtgtgtgagccactgcgcaggccttgggcagctttcttgatctctgttacctcatctataaaatgatgataataatagcttctcccttattggggaattgtaatgattaaatgagataacatgtaaaatgctcagtacaggccaggcatggtggctcacgcttgcaatcccagcactttgggaggctgaggctgctagatctcttgaggccagcagttaagaccagcctggccaatatggtgaaaccctgtgtctaccaaaaaatacagaaagtcagccaggcatggtggtgcatgcctgtaatcccagctactcagaggctgaggtgggagaatcacttgaacccaggagacagaagttgaagtgagccaagatggcgccactgcactctagcatgggctacagagtgagagcctctctcaaaaaaaa

SEQ ID NO: 239524 - DNA, 2240 bp, Homo sapiens
  misc_feature (5)..(6): n is a, c, g, or t
  misc_feature (8)..(8): n is a, c, g, or t
  misc_feature (13)..(13): n is a, c, g, or t
  misc_feature (15)..(15): n is a, c, g, or t
tcttnntnattcnancaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaactttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttacttagctatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagaggg

SEQ ID NO: 239525 - DNA, 531 bp, Homo sapiens
tttttgtactttttttttttttttggtagagtcgggctgttgcccggcctggtctcaaactcctctaactcaaactaaaaagccatcctccggcctcgtcctgccaaagtgctgagatcacaggcataacctgccgcgcccggcccaagtccctatttttctttccaggcttcctaagttcatttaaaggcgaatttatctattagtaatgacggctgacgagtgatggcagagtggacaggtgtaatggagagatgaaaaatgaaccttcgcctgtaatcccagcgctttgggaggctgaggcgggaggatcacctgaggccaggtatttgagactagcatgggcaacaaattgagaccccatgtatccaatttttgtgttttttttaatgtggtgtggtggcgtgtgcctgtggtccctgctactccaaaggctaaggtgggaggatcacttgaacccatgttgaggcttcagtgagctatgattgcaccactgcactccagactgggtaatagagaccctgtctctaa

SEQ ID NO: 239526 - DNA, 344 bp, Homo sapiens
caaacagacttgaaacacttgtacatcagctcagagtgtgcattgtccactgcaaatactagtgcaaattaagaagaagagaaaaaagaaggtccacgagctaccaatgacatctaggactgcttctgtctcatagcacatactcctcccacaaggactacaaatgacaagagaaaatttgtataattggaattctggacatttctcaaatgctcattgactcaaatactttctgctgtatttggaattttcaaaccaaaacatgatagcaaccagaccagaaaaatgtaattgaccagaaatgtcctacaatatttacaatatactcatttttctgcatgttc

SEQ ID NO: 239527 - DNA, 204 bp, Homo sapiens
ttaagagctgtttttgtaggtcagctattttaaattcccctcagtgttttgacatttctctgcacctccaacagatgtctgatcaatggggctgcagggatacggtgccactgccatgatggttgattttagaaaagcttttaattcagaagatgactatttcctcgaaaatcccttccatgcaatgaggacctagacagctgt

SEQ ID NO: 239528 - DNA, 707 bp, Homo sapiens
  misc_feature (391)..(391): n is a, c, g, or t
  misc_feature (406)..(406): n is a, c, g, or t
gccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctcctcgtgccgaattcggcacgagcatttcctcaacttcactactgtgtcgccctgtgggacagggaagtccaagtcggngaagaagcctgtggngaggggttggtgggagatggggagcccatatggcccagtgagtcaggaaaatagggtccagaggcagggaacataaggccacattcgacttgagccataccaggaaatgctctctccataggacgtatgccgtaaatgactctgtaccttacttcatcctttcgttatatagggcgtccttaagtagaggtatttaacacaaaactctgtatggggccttgagccctattctcagccccgtttcttcacaccggggggtgccttcatttcaataaaccctccttcttccttcaaaaaaaaa

SEQ ID NO: 239529 - DNA, 3874 bp, Homo sapiens
aaaaaggtacaactaccttgctgatgctgtacatatggctcacttgtgcccagagagagaataaagccatgtcgaaactatctacgattccttgagtgtttttccagctacctgccacttgcccacccactcccctcagatctcagttagaacatgacaattgggctcatgaacaggatcctgagtggttgcaggtgaacaagcagttggcacaagggcaaagtgatcacatcctgattgagtggctatggacagccatacagactgtgtggaacaacgctggtgaaatacccaaaccatttagaagcagtaatgcctcacttgcctgggactgggatggtgtggctgagactgccttactggcagccaggtgcgctattcagcagccacaagccctacaagtaattaaccaggggcacctgtttgagctggaggtgcatgtggccacagacggttttggttgaggcttgtggcaatgcacagagcgcctaagaatgccagtaggcttttggtcccaactatggaaaggagctgaactccggtattcattgatagagaaacagctagcagctgtatatgctggccttcgggctcatgagagcatgacaggacaggctgcagtcatcatatggacaacttacccaataacaggatggatgcgtctatgtgtaatgaccacctggagtgggatagcacagatgtccactttggcaaaatggggcgactccttgcagcagtggagtaagctgagtacaagtcccatagcagcagagttgcaagaggtcttgggacgtgtagtcctaatgcaagataaggccatgcggcctgaggcacccctagatcctgagtcttcaccatttaaggaagggcatcccaggattcctgagggggcatggtacacagtagatgaggtgctactgctgcctggaccactgttgcagtccaacctagtactgacaccatatggtttgaaactgggtgcggacaaagtagccaatgggctgaactcagagcagtgtggatggtaatcaccaaggaggtgacacctgtggtaatctgtactgatagctgggcagtctactgaggcttaaccttgtggttaactacttggaaaatacagaattggctagtgagccacagacccatttgaggccaagccatatggcaagacctttggggaataggtcatcaaaaagaggtaactatttatcatgtgtcaggccatatgcctttggccacccctagtaatgatgaggcagatgccttggctaaggtcagatggtcagagtcagcaccaacacaagatgtgaccttgtggctacaccggaaactgggacatgcagggggtaaactgatgtaacaattcaataagtgttggggtctgtcccttcccaagcaagacatttgtgaggcttgtcagaaatgcctggcatgtgttcagacatatcctaaaaagaggcagctgcccggtgttatacaacaagtaacaatagggtgagtgcccttgaccaggtgggaagtagactacatcgggccgccgccaaagtcgcgagggtatacgcatgcactaacggctgtagacatggccacaggcctgttgttcacctacccttgcagggtggccaaccaacagaacaccatccaggccctgcaacacttatgttccctgtatggttgtcctctggccattgagagtgataggggaacacatttcactggacaacaggtacaatgatgggcacagcaaatggacataaagtggggattccatgtgccatacagcccacaagctgaggtattattgaatgatataatgggatcttgaagaatggattacgcttgcatgtcaaacccctgtctttgcggagctggagttccaggctggacctggtgctccaaaccttaaatgaatggccacagaaaggtggcccggccccagtggaggctttgtttcactaggccaccacccccattcaattggagatacataccaaggatgacctcctccgatcaggtatggggacaaatggtaacctgttgttgcctgccccaacaaccctgaaggcaggggaacagaaaacctggctgtggccatggaccctccaagctctccactgctggtggttggccatcatagctccctgtggggagggcctacagtatgacttgcatgtcactttttgagtgttcaatacatggcttccaaggttgactgtttgtagaggaacagccagggaaggaaccctcctctgagggacatatgtactatctgatgggcctattatgagctacgctgtgactttggcatggatacaggattctaaggaaccatggagatttgagaaggtgtggtaccatcacccagggcaaaagcccttggtggctgcattgttatccagggatggaaagttagcctatattttgcctgagggatgtgatttacctctgttagtacctgtgcctgctctgtcatttcaaccgtaggttaacatgctccaattgcattgtggactgaccccacacctatgctgaggtgaccaatgtttccaactgttggacctgcactgcctttccagcagcagctgcagacagcttgccccgacacatacatcccgtgtctgcagagaactggacatgcctggagacttgagatcccatggctgatgcctggaacacaatgtggcaagctttggacaaaggacacagcaagacccatggctggaccgtagcattcgtgatgagtggggctggctagtaggggaacatgtagtagcccaagcccaggcattgcagtgcacagagcaacattggggtaacaggatgggtacctgtcacggcctgtgcaaacataacatgtgtcaccacactgaaggtatggtggaacaagtggcctcaccaaggtcggaccccaatggactttttgcctcttgggagcttatgggtctatgaggacacagtagcctttcctatcagcaaactggagtggatgttgtatctgggggtggccttatgtacctgctactgttctccccacattgcccagatgcctgtataactgggaggcactgtgctctcagtttttgcgaatgtgatgagccccctggtgtttctaccctttggcaatgactatccctggagcaggtgtcaaaactgtagaagcacaatttactgctcttgcggagcacaccgctcaggctctgaattacacctgagtgtccctcctcctgttaatgaatgaggttgatcagatcaaaaagtggtgttgcaaaaccaagtggccttagacataactgctgcccaaggagccacctgtgcccttttaggaacacaatgttgtaccttatccctgacaatcagcagaacataacagcagccctgcaaaggggtcttccaggagattaaggtgactgagagcctcactgtcaaccccctgcagagatggtgagcatccctaggttctggcgtacattgggccctaatagtcataagtatcatagctgagatcctagtagtgagctgttgctctctgtattgttgttgtgggttatggactcagggctccgccatataggcatgtgtccctgcctggaggacgccctcagcctagggggtgtagtgtaagggaaatggctgtgctttagtcaggagtaggctgaggcagccttctggtgcagcatgactcagtgggtttggagtgcaagcacacaaccttgctcgttatgtaaccacaccacatgaggcccattaggtaacaactcacatgagctcgtgtttggctcagagccactattgtctgtaaaaggtataccttgctgatgctgcacatatggctcgcttgtgcccagagagagagtaaagccatgttgaaactgtc

SEQ ID NO: 239530 - DNA, 2047 bp, Homo sapiens
tgatgctgtttgctgtagggattgacttaaattggagtcagttcttctaggacagtacgctgtgtgtgtgtatgcgcgtgcatgtgtgtgttgcagataagggcattatcattcggtcttcaagctccttttgtccactaaatttttgtgccctaggatcaattactttcactatttttgtgatccaacctttagcttctgacattcatttgtattgaattcctactctagctggcactgtgctacatattgagaatacaatggtacatactatagactaaattccaagagtttatattctacaggtttagagtaagttggaattccagatattgataagtgccctttaaaaaaaaatgaaacaaggtcctgagataaggatggcctgtttagagcaagaagaaaatccagtgtggctggaggagtgtggacaaggcagggagtgggtagaaatgtggtcagtgattggggctagtgccaggtccaggtcttggtgggtctcctggggcacagaaaagagcttgggttttactctaattgccgtggaagccaatagaggcttttaagcagggcatgacacgatctgatttagttttcaaagaaatcttgttggcagttgtgtagcctttctattcgaagcctggtctgtagatggactggcagcatgagcatcatctgtgagctttttaggaaggcacatttttgggacccactcaggtttcctgaagcagcatctgcatttttaatagaatccccagtttgagaacagctcttgtagagaatagatggggtcagatgaggaaaaacagctttacaagcccccacccttactcttttctcaggtgtagaaagcagattgttatagacagatttctagacttatctcagtgggctgacccaagcttgcttccaaattccactcttttttctttattttttttagataggttcttactctgttgctcaagctggagtgcagtgatgcaatcttggcttgctgtaccctcgaactcctgggctcaagtgattgccccatctcagcctcctgagcatcttggaccacaggcatgcactaccatgcccagttaagttttaatttttttgtagagacagggtcctgctatgctatccaagctggtctacaactcctgggctgaagcagtcctcccaccttgaccttccaaagaaagtgctgggattacaggtgtgagccactgcacccagccccaaattccacttctggttggactaacatagttttttatttgtttgtttatttccctaattcctaggtgactctccttcttgccttttactcagcagctgaactactgatttttcttttggtgttccatttatttatctttctattgattctgtaacttcatagaccctcaataaatgaccactatttccatcataattccaagtagcaattgcataaaatatccatatcttaaaagaaagataacaggacttcattataaggatggtataagtttgacacgcatatttgtaggcaggccgttattactaacttggtattatgaccactttaccatgaagggctttctgaatgctgttggcatgtgtgtcagttaggattaggtttggcttaagcttttaaactgttaataatagtttacacaaaatagaagtttatttctctctcatgtcaaaatctggagggtagactggaattgctttaaaagttctatttcataaagatctcaggtacctagactttttctatttcttttcactgtgtctagcctccattctgaagctgacctcatggtccaggatggctgctttacttcctgctatctcattaaaattccagccatcagaagagatgaagagatggtgcaaaacaagcactgcagcagacctttcagaaaggctgttagaactgctgcatgggccggcacggtggctcacacctgtaatcccagcactttgggaggccaaggctggtggatcacgaggtcaagatattgagaccctcctggctaacacagtgaaacctcgtctctactaaaaatac

SEQ ID NO: 239531 - DNA, 1130 bp, Homo sapiens
tgttttaaatttgcagtttgtggtcatttgtgacagcagccacaggaaataactaccggggtccacaaaccctagtgccacggctgttccaggtgacgctggactgggggaacagggtgatgggggctgcaggtacactgctgcctgtgttctcttcggcacccatgtccatgtgtggaaggcagagagctccctttgcagccgcccattgtgtgcacgtggcaggccagagagctgatgccccagccgcagcctccaccaacaacgataaatacatctgtgtcctcagccgtggttgggctaactccggggtgtgaattaggtggggccgagctccagttgccccctcagtggtatttgcctgcacacacacccttagtgacttccttcccctccctgcaacctggctggtgcttcctggggtcacctccccaataaacacctgcactcactctctcatctcggtgtctgcttctggggcagcctagacggacacagagagcttgtggatggtggatgaacaaggcctgtctgagggagcaaggtatcagggaacctgagcctgagggaggtgcgggagctggagcatgggtctggaggaggaaaaagcactcttggagtagagaaaataagggaggcagaggggatttaaccaatgagaaacccaagaaaagaacctccagggcaagaagtccaatagggctgatttcttttctttgcactctttaaacaatcattatcatagtaaaatatgcgcatagttaaaaaaaaaaaaaaaaccaaactgcctagaatagtggtctagtgaaggcacagctcctcgcgctacctctcgcctccagctcctgcctgctccctgaaggtaaaacctcctttgagcagttttaggctttggctctggaggttgcccccatgcctctgaatgacagctgctgtggttatttggagtttatcagcctcagatattgtctgttgacctgctgcgatgaaggatggagtagtagacggaattataaaatggcccagagtctggcccctggtgcacagctacctccccgctcccgtgcacttctcaaacacggttctgggtgcagctgataacagcccagatcactggactttaagatagg

SEQ ID NO: 239532 - DNA, 615 bp, Homo sapiens
gaagccacagagtcgggaccgggtgcggtgcgcgcgcctcaaagatcgcaaacccaggttacggcggctggccacgcccctccaccgccaggccacgcccccgcagcgctcagtcggctccctgcaaagcccagctgcttccggctttttctccgcgccagtcagccatctttactgagggcagccgtgctccctggcttcaggttaaaggcgtggtggcactgagttaggttaaccgcgggcagagaagcctgtccctagctacacttccctggtagttcgcatagtcacctagaaagatagtgctttcttgcacccgatgggctgcttgttccctccctgtgccgcgcggggcaccctcggacggcgcatctcgcggccattggctgaaaggaagaccgctgggaggcccatcttccggcgtcgcccgggcagcgcggctccggagctgtctgccactcttctcctggtgttccttcagccccgtcagtgacgccgcggacggccttcttatccctcgcctgacagcagtggcctccccagctctctgtcctggctcctattcgcctcctgacagcgctggttgtgttgcttggggcgcccaggcgcggccgc

SEQ ID NO: 239533 - DNA, 412 bp, Homo sapiens
cctaatcttttcctagccacaagatgctctctacaaccctggcagtgaagcaactgaacccagcccctgggaaataagccccagtcctggtaattcctgtaggaattgaaataatactagtgaactatggcgggcacagtggctcacgcctgtaatcccagcactttgggaggctgaggtgggcagatctcttgaggtcaggagtttgagaccagcctggccaacatgatgaaaccacatctctactgaaaataaaaaattagccaggtatggtagcatgcacctgtaattccagatactcaggaggctgaggcagcagaattgcctgaaccggggaggcagagtttgcagtgagccaagattgtgcctctgcactccagtctgggccacagagtgaggctccatctcccaa

SEQ ID NO: 239534 - DNA, 472 bp, Homo sapiens
ccatttcaggaatccagatatggtcatgatggacaggaagagacaagagttacatagaggaattctgggaagataagaaatgtcatttttatgtactgtttgcatccatcagacaaggcatcaggaaaaatgatccttcaggaaagagtgattttttttcttcaagaaattagaagaggggagaaattggtttaagattaaggactccatgcataagagaaactgggagggaagacaggtagaaatgctatggggttaggaaggaagaatgcagaggtggattacttagaattgagacatctgatcaagacagagggatcacagcttttgctaacaaagtactagtggaggatgccactaggtgaggtttaataaataattgttgacaataagttccatttaaaaaataaacaatttatgcttcttctttgcctaagtgtcaaataaaacattcagatttttatttcaaagt

SEQ ID NO: 239535 - DNA, 435 bp, Homo sapiens
gggtggttggtctccatccagagatgtctgtggaaatatgtggatacctggatacgtggcaactatggtaattctttatgaacatccagttgccatccctttaagcaggttgagcgttcaacagtggataactcttccctagagtactagtcaattttgttgtgtgacaatcagaaagcctatttaataccaggtactgattccaaggctgaaaagaaaagagaagaatattatattaagtggaaatgtagtaaatttactactatctaaatcttaccttgctattctgccagtgttttatttcaattcactgccaaataaagttgcaactaatttttaaactaatatttaatgttggagagatttagggatataatttgtactggtatcaatgatacattaaccaaattaattaaaactagcttatactgaaaa

SEQ ID NO: 239536 - DNA, 254 bp, Homo sapiens
ccagagtccatgctctgcctcctgactccactcgcctactgccttgtaaaatagaccatttctatacagcaagaaagtacaaatagaggtgtactcagagaaagcgacggaaagataacatactaaatgtcacagtgattatcataagggtgtggaatcatgtaattttattatgttcttttttgttcaactgcatgtgctaaatgtatttgttgtgtaataaaagaataaatgttataatatttaataccagg

SEQ ID NO: 239537 - DNA, 395 bp, Homo sapiens
atcttaaactcctgggtttgagcagtcttcctgccccagcctcccaaagtgctgggataacaggtattgagccaccccgcccagcctcacgttcttctcccatacccacacaccttgatcttgactcacccagctctctccagcgactcttttatttgtccctgcctccactgccccgtctactcccacagcaccctggccattccaaccagcctcccctcccaacccacgccggcccatctctctttcttgcctgtccccattggcatccatggccctggtccatccatgtggaagcatttctctctctatattcacactaacctacctcttttccccatccctgtctgtgtgaacacgtctttcctccaaccacataccccttcacctcatcc

SEQ ID NO: 239538 - DNA, 379 bp, Homo sapiens
acatctcaggcctggtgagtctggatgtgaccgcttcctgtgggagcccaaggcgcacctgcgtcaggaagcgagacccgcactgggcagagaccaccagcatctgatcctgacccggctcaccgagcactgtgtgccctgtgtcgtgaacaaggacgcttactgtgtctgtggctggctgtggaggcttccctggggctcccaggccctgcctctgaccctcagccttgggagctcagggtcccctcgcacctcggggtccgtgcccaaccacacgatgccccctgtagcctgttttcagaggtcattccccgccccaacacacacactctgcaatatcttaaattatatatatctataaatgatatatacataaaaa

SEQ ID NO: 239539 - DNA, 356 bp, Homo sapiens
gaagagaggaaatcggtgacagaactgaattaagacatctttctagaaggagccattttccagcctcttaccactgccctgggtgatcctctaggtcacacaggagctgatatcatggttgagccctgggaatctcagccacgctctgtccctgtgcatctcatacaagcttccatggtgatgaaaattgttaagatgtcttatgtgaagcacatgggcgttgggtttgctcatcacaagctgcctgctgctgatgctgtttcacctatttaaaatacccaagtgttgctttatttaatggaattgtgcccctgcccctgcacttgcatatggtcttagattgctgctcatttcca

SEQ ID NO: 239540 - DNA, 257 bp, Homo sapiens
tgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgata

SEQ ID NO: 239541 - DNA, 375 bp, Homo sapiens
ccatgtgtggtggcgcccacctgtagtcctagctactcagaaggctgaggcgggaggattatttgatcttcagaggtcaaggctgtagcgagccaagattgggccactgcactcccacttgggtgacagagcaagccctgtctcaaaaaaagaaggaaagaatgagaaaagaaaaccagaggagacctactccaacattaaatgtaaatagatttaatgcttcaattgaaaggcagagatggccgggtgtggtggctcatgcctgtaatcccagcactttgggaggtggaagcgggtagaatcacctgaggtcaggagttcaagaccatcatggccaacatggtgaaatcccatctctactaaaaatacaaaaaa

SEQ ID NO: 239542 - DNA, 416 bp, Homo sapiens
tgcccatcgacagtggactagataaagaaaatttggtacatatacaccatgaaataccacacagccataacaaagaacaaaatcatgggggtttttttgcagcaacatggatgcagctggaggccattatcctaaacaaattaacacaggaacagaaaaccaaataccacatgttcttatttataagcaggagctaaacatcgggtaaacatgggcataaagataacacggtagacaccagggattactaaagaagggaggatggaagcaggtgtgggttgaaaaactgcctattgagtaccatggtcactatgtgggtgacgtcagtatcatgcatacatcaaacctaagtgacatgcaatttacccatgtaatgaatttgcacatgtatcccttgaacctaaaataaaagttgg

SEQ ID NO: 239543 - DNA, 385 bp, Homo sapiens
gtatgaaatgatccatgtgacttaattcaccatgagatttcctaaggccttggtgtgggatttcaatctcccattaatcaaattaaattaatttttgaagcctcttgactgatggtgagtgaatcccagacaaaggcatcccagtgggctaccagtgcctcagatttctaccctgcttgacttgaccgcgtgtgcgtgcacacacacacacacacaattaaggttagggttggaacaaagagaaaggcacacacaacacatacatttctagccattctgaatttctagcagttctagatggtcttaggtcagcaaaggattcttgcactcaacattcagccaaaacaaggctagtgttcttatcatagcacaccccacccgcata

SEQ ID NO: 239544 - DNA, 207 bp, Homo sapiens
tagcaaggatgcaggtcccaccatccatgaatgctgccatttaattcaacatgagaagtgacccgtttcacctgtaaacggggtgggggaactcaaaatactttcaaacacaaggactttgactttacaacgtttggaaaattacagaacacaagaaactatttctatcaaaccaaaagaattcagagtttctcaagagatctctta

SEQ ID NO: 239545 - DNA, 420 bp, Homo sapiens
gatgtctccgtggaggcgacatgtgaactgagccttgaatgatgcaccccagtcacacctggctaggagagacctggtgtgagagccttccaggcagaggaaattactgtgtaaagatccttggatagaaacaagcttgggccaggcgcggtagctcacgcctgtaatcccagcactttgggaggccgagacaggcagatcatgaggtcaggagatggagaccatcctggccaacacggtgaaaccctgtctgtaataaaaatacaaaagattagctgggtgtggtggcgggtgcctgtagtcccagctactcaggaggctgaggcaggagaatggtgtgaacctgggaggcggagcttgcagtgagccgagatcatgctactgcactccagcctgggcgacagagcgagactccatctc

SEQ ID NO: 239546 - DNA, 2160 bp, Homo sapiens
  misc_feature (636)..(636): n is a, c, g, or t
  misc_feature (1129)..(1129): n is a, c, g, or t
  misc_feature (1477)..(1477): n is a, c, g, or t
aataaatgttcagtgagaaccataatgtgaatagtataacccagcatgattttggtgtgaggataattgataatcattttcttccagcagacctacccatctcggtgggatttgcttcaagtgatgtatatgcaaattaatttgcatctcctggtcatatactaattggttggtgagtggttagtagccaagaaacactgcttatggcaagagaaagtcaagtgaaagattaaagaaaatcatgattaataatctgccagctgataaataagatagttataacaccactttggtgaggtgtacgcttttggccatgtgtacactggtgcattttcaagacagtggctatcttttcacttctgtttggctaatcatgttatgttgttctgaagttactgctgccctatacccacttcacacagcctgagctctgtctccttccaatgaacatgaagatcttttgattccgtagttcctggttctgttctgattccgacaggatgctggcatcctcaattaggccagctaaggaaagcattagaaaacagtgatgcactacactctgtggaacttaccgaaaccaacaggattttagagaagaaataagggggagcctgaagctgtcaggccgcaaanaatgtcaaagagaaatgaaacttcagtcttagaatgtcaaataaagtgtgataagaaataagaggagggaagatattccaagtaggtaagggcatcagcataagcaaaggtgctggaaggggtaatgaacatgtaatggtgggtgagcaggactgctgggagcagacagtgagtttgggtagaaatgacatagaagagtgaattggtaaaaatggaagagatgatgggcaaatgagaaagcaacgaagcaaaaaatatatagtacaatatgatattggaggacagaaatgattattgggggtaatttgacttttgaccatttcccaggcttaattcaagtatatttagctttcaaacatgacttctcctaatatcttctacacagctctttcagatgaaaaaaaaattggctaactgggtaaagggtgatacctttatagctctatttttttaatccctgaggaagtgaaccatgttatgagtcacatacatngtgtttaggtaggtgaggaaatgcattgaactgatttgcagagaatgagagctccagacccagacagtgagacttcagaacttcatagatgtcaaagcatctttgacatctatgtcccagctctaggacacattcatgataggttcacttacttccaaacccaaagaggatattcttagacacttcctagtttcttcatcttgtaaaagtggttaagtggcttgtccaaggtcttttggctataaattgtagacaaggattcagagccaagtgttctgtccccaagaatgcttttgtctcttttttttaaatagtaacatcatgaggacatctcaggtcatggctggngagtgctttgtgctctgtaagggactaggaaattgttcacatacttcttcaatattgttcctgctgtgctttttataggataacacattttaactctgtcctcactaccaagactttatataaaatcagctggaatgaattgctggtcaaattcaaaattaatttcatgtcaaagtcttttcctcatgatatttgtgtgttttgtgagaactgcctttcttaaattcttctgaaccaactcataatactccaaatttaaatccatccatctataaaactaccttttctgtatcagtagtactttttcagaacatacctatttctagattataatcaaatattcttaaaataatctggtagtctgtgagtcctttgtctagaacttaattaaaagtggcaaaggaggccgggcgctgttgctcactcctgtaatcccagtactttgggaggccgaggcaggtggatcacgaggtcaggagatcgagaccatcctgggtaacacggtcaccccgtctctactaaaaatacaaaaagttagccgggagtggtagtggatgcctgtagtcccagctacttgggaggctgaggcaggagaatggcatgagcccaggatgtggagcttgcagtgagccgagacggcaccactgcactccacactgggcaacagagcaagactccgtctc

SEQ ID NO: 239547 - DNA, 488 bp, Homo sapiens
tgagatgaagtttcactcttgttgcccaggctggagcgcaatggctcgatcttggctcactgcaacctctgcctcccgggttcaagtgattctcctgcctcagccttccgagtaggtggaattacaggcgcccgccaccatgcctggctaatttttgtatatttagtagagatggggttttaccatgttcaccaggctggtctcgaacttctgacctcaggtgatccacctgcctcggcttcccaaagtgctgggattacaggcgtgagccaccatgcccggcctaattttttatatttatttgtagagacagggcttcactattttgccaaggctggtatttttttgacgttaaaaaactttaaatcaagtttatatctgctgtaaatttccattctctgtttatttcttggacctttatgcttcgatttctcatactcggctgtgctttataaattgcagttccttagccatcactgccattgtca

SEQ ID NO: 239548 - DNA, 625 bp, Homo sapiens
attcttcatctcccttacgtgaaatcttttaacagacacaaggagagaacacaaataatattgttttgaagaaaatattagtgtttctcttgtcagaactttgatttgatgaggtgattaacgaatatttattgagtacctactatgcgacaggcattcttctaggtaacggaataaatcagtggggaaaaaaatatcacatacatacatatcttcccttctgaagcttaactggtagtgagagacagaaaataacttatgtatagtaagacttcccagatatatgcagagagagtgagcaagacagaattaacaaaataatcacatgataaaagccaggcacggtgactcacgccagtaattctagcactttgagaggctgaggtgggagaatcgctggagtctgggagttccagaccagtctaggcaacataataaaactccacctctacaaaaaaaatttgtgttaatcagctgcttgtggttgtgtgcacctgtagtcctagctactcgagaggctgaggctgaagtgggaggatcactttatcccaggagtttgcggctgcagtgagctatgatcacaccactgcactccagcctgggtgacaaggcaagactctgtcta

SEQ ID NO: 239549 - DNA, 320 bp, Homo sapiens
cggcggccgcgcgacacggctgcgagaacacgacagaaggtgactcacgccagtaattctagcactttgagaggctgaggtgggagaatcgctggagtctgggagttccagaccagtctaggcaacataataaaactccacctctacaaaaaaaatttgtgttaatcagctgcttgtggttgtgtgcacctgtagtcctagctactcgagaggctgaggctgaagtgggaggatcactttatcccaggagtttgcggctgcagtgagctatgatcacaccactgcactccagcctgggtgacaaggcaagactctgtcta

SEQ ID NO: 239550 - DNA, 1862 bp, Homo sapiens
  misc_feature (237)..(237): n is a, c, g, or t
  misc_feature (327)..(327): n is a, c, g, or t
  misc_feature (1842)..(1842): n is a, c, g, or t
tgcatttgcatttgcagttattcataaattctttgcatagaccaatgtccagaagagttttatctagttttcttctagtattttttacagtttcaggtcttacatttaagtctttaataatataaggaagatatttctaatagtcagccttctacaatttagttgggcttccttatgtggaaatgcattctctagtatttagtattttagaagccaaatggccaccttttagctccntggtacaggacattcttgcctaaggtaagaagtctaatgaaatggaatcctgggtcccctgggtctatcaaattttatgatgccttaagnaataaaattgtttcagatttttacctggtgatgaaagaaataagtattgaacatggcccaataatactctacattccccaattccacaccctgcaatttttaaatttgatttagtgtttctgggtatttcagaagtcttcttactcccccacagaaatgctctactttttccattgccacatttttgtcagcattcttcactcattaacttatcctaatcctagcgcggctcagctggtccctgaaaactgcaagccaggctaatatttccttctctgacccatccactgtccctccaatactgctagtgctacaagccaggctaatatttccttctctgacccattcactgcccctccaatactgctagtgctacaagccaggctaatatttccttctctgacccattcactgcccctccaatactgctagtgtagcaattctaacaaaggtgagcgcagctggggaggtagtcagggcttggaaagggaaggcagggaaccaggagctctaaacattgttgactctaccaaatgtaattgagatgaagttctatgtttttcctgagccccaagccttccgccagatacctagtgctgccataggttgatgagggaggcaaaaaaaggccaggggtcatcaaaattgtggtcattattaaaggctctgaacctcactgtgatctgatgagttcagctagaccaagggttactattaaaagcaccttgcctagatagagacagatttggacaacatatactaaaacaaatgagtggtctgacttcacactcaggaggtacttgttgaacactgattgtatgccataagggattctaagtaatgaatttatacagagaataagagagatactgtctctactctcagacttacaatctagtggggaaaagaagagagacagaaaaaataactagattatcatcagatagtaaaaagatgcaatgaagagaggtaaaataaggtgatgtgatagaaaccagatggttaatttatatggaggaatctctctaagttattgacatttagactaagagaggaaaggaagatggagcctgtcatgataagattggggggaaattgttccaagcagagggaacaagctagtgcaaatgccacaaagcgggaacaagtttggcaagtttgagaaccagaaatcggaccaggatagtgagagcacaggggaaaggggagagtggcatgagatacactcagaaaggtaaaaacagtccaaatcacatgaaattttggaaaccaggataaaatgtgaaatgtttttctcatgttatgggaagatgtaggaacatttttaaaagagggtttgacatgaatcaaatttgagatttacaaatctaattatggtacaaccatgctgttgcaaatgataggatttccttctttttaaaggcagaatagtattccattgtgccacatggataaactggaggacattaggtttagtgaaattagccaggcacaggaagacaaatattgcatganctcacttataggtagaatct

SEQ ID NO: 239551 - DNA, 294 bp, Homo sapiens
gcgccctcatcctcccctctcagtgtaggacaaagttgcagagtcctcagcagggagcatataattaattcaaaaatggaaactgcagtccatgcggctcttctatcactagggtgtatccagctgttcctgtgggaatccagtcactcttaacttcattatttgcctttcagtataggatcttatttttctggctcacatagaatataggtatttacaggcacaagggctcaagaaatgctctttcccttcttcttggtgcaggaatctagtctatcacatccctaccagacc

SEQ ID NO: 239552 - DNA, 336 bp, Homo sapiens
ctcccagactcagtgattcttctgctacagactccgagtagctgggaccacagctgcacaccaccatggccagctaatttttaaattgcttgtagagatgggatgtccttatgttgcccaggttggtcgcagactcctgggctcaagcagtcctcccaccttggactcctatagtgctgggattataggcatgatccactgcacccagcccaaaatttaccattttaaccatttttagatttacagttcagtggaattaagtacatttaccttgttgtgcaaccataaccaccttccactttcagaaacactctgtaccccttaaacaataactcc

SEQ ID NO: 239553 - DNA, 465 bp, Homo sapiens
agatgatgaaatattttaataaacgatttacaaacaggcttaagtggctgctaagaggagactaaccccaacctgcagtacacatctcaggtgagcagtgccccaagagggcacttctcagctgtggcacatagttggatgggcctggctgcccatcctttacctgtgtgccctcctacagtcactggccctgtggtttccgtggaagacccagcaggggccttctatcccctttgacccatttctaaagactttatataaattttttaaaaatgttttttaaacaacagagagtgagaagttatggaaactcatttaaaaattttttaaaaagtgaaacctctgtgctagccaattcttaaacatggtgtgttttcctgcttaagttatatagaaatattttcctgtgaaaatactttgtctctgtgacaattctcccaaacaaaaaaatctaaataaaaatta

SEQ ID NO: 239554 - DNA, 581 bp, Homo sapiens
tgaaaattgtatgtatttatagtgtacactatgacgttttgatatatgtatacatgtggaatgattaagtcaagctaattgacgtgtccatcaccttacatccttatcatctttttgtgatgagaacttttaaaatctactgtcttggcaattttcaagtatccaatatgttattattaaacactttttatgctctaaataaattgaatttatttttaatcctttggatacttactggcaatatgacacaaattatgagaaaacctgattagtgatttgataaaattaaggtagaaagataaattgtatggactatattgtaatttaaaaattatgtatgtctttatcttatttttatctagacactgccagctcatcaacattatatccagacatgtacaatactgcttaaattcagttgtcttggatattctgtcaacttttagtcatacaaaaatcacaactaggttgggcatggtggctcacgcctgtaatcccagcactttgggaggacaaggtaggaggatggcttgaggccaggagttcaagcatgggcagcataacaaaattctgtctctaca

SEQ ID NO: 239555 - DNA, 1272 bp, Homo sapiens
  misc_feature (716)..(717): n is a, c, g, or t
acataatgttataaataagaaaactgaggctcaaaaagttttacacttgtccaaaggtatccagcaggctgcagacctggactttgaatccaagtttttctcattcaaaatatgttttttctaatgcaatatgaggcatgaaggcaatggtatccttttgagaggtgtgatggtaagttttatgtcagcttggctaggctgtgatgtctaattgcttaaccaaacactggtctaaatgtttctatgaaagtatctgtggatatgattaacactcacaatcagctgagcacagtgggctcatacctgtaatcccagcattttgagaggccgaggcaggaaggtcacttgaaccaaagagttcaaggccagcccagggaacatggtgaaccactgtctcaacaaaaataaaaataaaaattagccaggcatggtgtcatatacctataatcccagctacttgggaggctgaagtagcaggattgcttgagcccaggaggtcaaggctgctgtgagtaatgaccatcacaccactgcattccacttggatgaaaaaccaaaacattgtcaccaaaaaaacaaaaatgtataaataaataaataaataaaatttacaatcagttgactttaagtaaagcagtgtatccttcataatgtgggtgagactcatcggattagttgaaggccataaaagcaaaaactgaggcttcccagagaannaggaattttgcctcaagaccataacacagaaatactgcctgggtctttagcctgccagccagccctatatttttcagacctgccagctcccagaatcacctgagccaattccttaaaataaatctctctttttctttctctctttgtatatatataaatatgtatatgatatctccaatatatacatataattgaggggacataaatataaatcaatctctctccattaatatatgtatataataggttctgtttctctagagaaccctgactgagacaaagagtaactgaaagtcacccaagagaatgtggaaaagagtcaaaggaaatgtatttctccctcaataggtcatttcctagacaactttccagaatacgacaagaagcacataacttcatgatcaaggtcagaaagatgctttttctgtaaagtgcctcatgagaaattttgtatgctttatttttttcaaggtgaaaaaaagtttgtgaatgtttaaaaataattcttttcaaattgtcccagtgcagtaatttttagaatgcaaactcactctg

SEQ ID NO: 239556 - DNA, 622 bp, Homo sapiens
ggggtttcccagtcaggctgtgtaaaaggcgggcaattttttttttttttgctgttaacctctgtgctggttttactcttgaacagggctaacatgtaaacatctacaaattcttgttttttatttaaacgtatgcttttacaaatgcaaggaacccttcactgaaataaaaaacaaacaaaaacagaacaacaacaaacgcatctactttggacccagagaagaaggtaaaggcatatgtctgatgtcatcaccactatttcaagaaaaatccacatgaacaggggacataaaagtagtgaaaatgagcaagcagttagggaactttacattccaaactcccaaagagcaggaggagagactggaaatttcaccccacattctctcccctcacttatcacaaaaaatcacattgtattagttcagtaccttatgaatcagagactgaattacatttggcaagaaccctctctagagtgaaatggaccagaatggaaaaacctacacaaataagataacccacctccggtccaagacttgaaaataactaaatagaattacaactgcgaagctattctttggaatgatgctttgaccaaaatagttcgacacacctgctacc

SEQ ID NO: 239557 - DNA, 374 bp, Homo sapiens
agggaaaaaatattttcttctgggtggccctaaactgctttctttttccccattgcaaatgtatttttatgctgggttacatttccaaaacaggagtgttttttttctatcgttgaaatgaaacaaacaagtttgctttcagagctacagaaatgcccaactgttaggaaaaaaaaaacaaaaaaccgttttccactggccgcttgcctctcttatccccatgcaaccttgcctattggcccctttccctaggagagcccctggggctgtctgatggaactgattgtaaaactattttgtgcagtaaaaaagtcgtttcttcaaaatctgagaccacccagaacatgcccaatctttggcaaatatcgactggt

SEQ ID NO: 239558 - DNA, 278 bp, Homo sapiens
actgaagggatttaggcttctgacttctctgctgcatctgaaaatctaaataatgaatatattagtccatgatatggtttggctgtgtccccacccaaaatctcatcttgaattctaatccccatgtgttgggggtgggacctcattggaggtgattagataatgggggcagttccccatgctgtttttgtgatagtgaatgaattctcatgaaattggatggttttttttttttgagagtcttgccccattgcccaggctagagtgcagtggtgcga

SEQ ID NO: 239559 - DNA, 425 bp, Homo sapiens
cagagagcaataaatgccttctgaaaaaatgacaaaaatgagcagggacaaggggataaaatgccagaagtgggatgggagttgtagttattaaaaaggcagtcagccacagcctcactaagaagagggctgacatatgtgccaagaattgtagaaggtaaggtcaagcgaaggaagagcattcaaggccacactcccaaaggtcctgaggcaagaggatgtctgaggtattcaagaaacactcaaagtgaccatagtgactggtagagtagagaaagtatgggggagaaaggaggagatgagattggaaatgtttggatctgggtttgaaaatgggagttgattatggaagactctgtgcaggctatttaaggattgcatttcttattctgaatgaggtagggaaccattaaaatattttcagc

SEQ ID NO: 239560 - DNA, 401 bp, Homo sapiens
aaactaataaagggaagcagatttataagtcaatcaaaaacagttataaatgcaagatgcattattctggctttgcaatttgttgctagttgctttgaacatggctgtgtcttttttttctggaaaatacttttgaaattaaaccacaaagccacagagtaaagccctgatttaaggaacaacctagaagcagtttttgtaaaacttcttctttttttccttatatatgacaagaataagctacactctgatgaaagtcctttgaatttcacttccaaaaatgtctcccaattttgtttactttttcttccctattatcaataatactctccttcttttgtcatgattacagcagctggtctccctgtccttcgtattcactcccatgatattttcataaa

SEQ ID NO: 239561 - DNA, 614 bp, Homo sapiens
agatacaggaagctcacaattagcctaggaagagaaaatggcgacagaaatatggacgaagatagagattctcatcactgttgcttaaaaagaattcaatcatcaatttataatttcagaagagttctgataagttcctggaatgagacatgctcctaaaatatactaccatcactataacttagaactaggctaagtgtattacatatattaacctaactgaattacctatcaaccctatgaggtaagtgcttttattatctctagtttataggtgagaaaaccaatgcttaaagaggttaagtactagctgcttgttacaaacaaaatatttgtgttcccccaaaattcctatgaagttctgacctgcaatgtgatagtatttggaggtagggcctttagaaggtaattagggctagatgagatcatgtgggtggggcacccatgatggaattagtgtccttataaaaagaggaagagctggtgttctctgtctaccaactgaggacacagggagaaggctgccgtctgcaggccaggaaaagagccctccccagagctcaaccatgctggcaccataatctcaactcctagcctccagaagtatgaaaaat

SEQ ID NO: 239562 - DNA, 387 bp, Homo sapiens
gagacaaagtcacactctgttgcccaggctggagttcagtgatgcgatctcagctcgctgcaacctcctcctttctggactcaagcaattctcgtgcctcagcctcctaagtagctgggattacaggcgtgtgccactacacccagctaatttttagtatttcttgtagagacagggtttcaccaagttgcccaggctggtcctgacctcaggtgatctgcccttcttggcctcccaaagtgtagagattacaggcatgatccaccgtgccctgcctgggttcttctgaattcaaggtctttatgtgtttttatgtctcttgcttgagattaggatatgggattatactcattcaccacccatcccctcccttcatgaccatctctc

SEQ ID NO: 239563 - DNA, 527 bp, Homo sapiens
aaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggttgttttatatttgttgattgggaatttttttttcaagaaaaatgatctgatgtgttaattttattcctttcgtctttttcttttgtctatctcatgcttttcagtgataatttttattctcattcatatagtcatgaaataccaaatgttacaataattatttcagataataatgtctaacacattaataaaagtaatttagagactgtaacttggaccttcatatttatatttatagccaaaattatatttaatcagtagtctaagaatttttttaattccataaattttaagaaataaatttcattttatctctgcttatttactgaa

SEQ ID NO: 239564 - DNA, 352 bp, Homo sapiens
aaatatttaatgtttatggtatcacagaggtatcaagttgggcgaccatttataggattccagagaagactcttaactctactctcaagtaagggttttcattgtactatatagagaagagagactgtatatttctaggatcttaacactgacagtgtttttgataggtgctggggtaataattttagaaacacgattgtatctgatattttaagttgggaatccagaaccttccttactatagctggtgccaagatactgctgcaactttttgtactaaatagtaatgaataacatatatggttacctttccacctaaccttttcctcttgtcagtctttgaattagagcg

SEQ ID NO: 239565 - DNA, 374 bp, Homo sapiens
ggccccccagggagattgaaaagggagggccagaggacagacatgaggaggagacacacaggaacccaaggaggagggtttccaaaaggtgaactggctggccatgggctgtgtccagagagggcagaggaggtgacttggccctggggaggctttggggggatccttgtcggagcagccttgggtgaaggcagaggagccgtaaaaagggaggcagtgaaggctctagctacaagggagagagggacaagggggagagacaggggagcagggtcccgaaaggtattatttttaagtggaaacaattttttaatttttaaatgtttttcattaaatcagaaagtacatttatatggttcaaaattcaaaatcca

SEQ ID NO: 239566 - DNA, 493 bp, Homo sapiens
ttctttttttgagacagagtcttgctctaattcaatttctgtatctggccgtttttaggatatgctctttgtttttggtattctgctctttcagtacagtgtgtctaaatgtgcaatttttattttttaatttttgctggtataaattgtatttcttttatttgtgccttttactagttctggaaactgctcaaccattattttttttagtgtgataaaatatgcatgactcaactattatctttaaaaatagtctctctcctccattttctctattttctgcttccagaactctaataagcttatggtgaaccttttcattaattcctcatatattttaacttctctgtcatgttttcatccccctttccctctacagtacattctaggtaagttcttcagatctgtttctcactaattgtctcctcttgcatctaatctactgtttaatgtatacatcgaggattctttccccaacaactatactttttat

SEQ ID NO: 239567 - DNA, 173 bp, Homo sapiens
aagggagagaagctgccaggcccagtcccttcccggtcttctgcaccctccctcgtccatcctgagcaccagctgggagccacaggggctgtttcccttcgtcccgcctctgctgcctgtggggagttcccttgggtgcacgacagtctgccctgcccgtgcggtcaggagaa

SEQ ID NO: 239568 - DNA, 954 bp, Homo sapiens
aacgatggtctcagctgtggtgtttaaaaattcttcagaccaggctgggtgcagtggctcaatggggtaaatgatcaagactgctctggatctgaggtcattagtttggatgctgtatccaaactatattctgcatgaatggccagaggtgtgaggggaccagtatctcaacacatctgtaacgcaccctaacacaatacactggttgagaaattctagtttaaataacttgtggagatcacgacctgaatagtcaaaatccatgcagcaggttgagaaaactatttcacaattcctcttatttcaagagatacgcaatcaccttttgcagctttcaagtatagaccagatgtactaacaggcaaccatttcgtctggaagatcatctatttggaggtcactgacacaaaaaaccaaaaacaacaaagacaaaacaagcctccttaccctagctcagaaggataagcttttcctccacttcatattgattctcttttcccatgtcaatttaaggtggtaaccatggccaacaacattctctctcacctatcatactaatgccatataagtagtagtgtttttgttttttcaagtggggaaatatatacagctcaaaaaaacaaaaaaatatctagcaactaactccttggcagttcccttgactctctgacctttaagtcccaaggttctaagtatacaatgaataagaaaactacctgttcaaacccaacagaatatgtttttttctggtttgattaaggcttcgaatttggaacataaatactctcagtaatacttagtaattcatgaagttactgcttgtgtaaacttgcagaatatttaactttaggagattataaatcctaacatgcccctaggggccttctgcttttattcctacatacaaaacatacaacatgtttgtttttaaaaacaatgcacataggccaggtg

SEQ ID NO: 239569 - DNA, 1008 bp, Homo sapiens
aacgatggtctcagctgtggtgtttaaaaattcttcagaccaggctgggtgcagtggctcaatggggtaaatgatcaagactgctctggatctgaggtcattagtttggatgctgtatccaaactatattctgcatgaatggccagaggtgtgaggggaccagtatctcaacacatctgtaacgcaccctaacacaatacactggttgagaaattctagtttaaataacttgtggagatcacgacctgaatagtcaaaatccatgcagcaggttgagaaaactatttcacaattcctcttatttcaagagatacgcaatcaccttttgcagctttcaagtatagaccagatgtactaacaggcaaccatttcgtctggaagatcatctatttggaggtcactgacacaaaaaaccaaaaacaacaaagacaaaacaagcctccttaccctagctcagaaggataagccaaaagaaaacaggttaacggtaaaaatgtatgattaaatgaagttattgttttttttcctccacttcatattgattctcttttcccatgtcaatttaaggtggtaaccatggccaacaacattctctctcacctatcatactaatgccatataagtagtagtgtttttgttttttcaagtggggaaatatatacagctcaaaaaaacaaaaaaatatctagcaactaactccttggcagttcccttgactctctgacctttaagtcccaaggttctaagtatacaatgaataagaaaactacctgttcaaacccaacagaatatgtttttttctggtttgattaaggcttcgaatttggaacataaatactctcagtaatacttagtaattcatgaagttactgcttgtgtaaacttgcagaatatttaactttaggagattataaatcctaacatgcccctaggggccttctgcttttattcctacatacaaaacatacaacatgtttgtttttaaaaacaatgcacataggccaggtg

SEQ ID NO: 239570 - DNA, 1897 bp, Homo sapiens
aaacacttgcaaccacaagcaaactcgccgctccctgggtcccttcccagtggactctgcacattgggagccttataaagtagcctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgtcgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttca

SEQ ID NO: 239571 - DNA, 402 bp, Homo sapiens
tatttttagtagagacgaggtttcaccatgttggccagactggtcttgaactcctgccctcaggtaatccacccgcctgtggccccccaaagtgctgggattacaggcgtgagtcaccactcccagccctgaatgatctttcctctttagtgtgttctcacaaccacctctcactgagctttcttgttttttgtttttgtttttgtttttgtttttgtttttgtttttggcagagtctggctttgttgcctatgctggagtgcagtggtgcaatctcagctcactgcaacctccgtctcctgggttcaagcgattctcccacctcagcctcctgagtagctgggattacaggcacccaccaccacacccagctaatttttgcatttttagtagacacagggt

SEQ ID NO: 239572 - DNA, 639 bp, Homo sapiens
ttattcattcaagagatatttagaaagtccctctgtaataaaatactttatgaggtaccgataaatgcaagtctgtatgtgtattccaaaagttcaacgttcacaaagagtagagccatcctatccacagcaggtctgttgggatcactgagttcaaatcactaaccacaacaagtgttatcctgtgtcaacaacatccttcaaatccttcgaaacacctgattggaacttaggtaaggtttaccactgtgccaatccactgctttccaaaagagtgagcacagagcagtattgggttagtgagtagaagaaaaagaagcttctgctcctgcattttacaattttctaccattgatgaataaatcttctctctacaaactctatacactgattatatttcctacctaggcacaaggctcacacatttgagcaggaagtctgtgtaagaaaagagaggctaggcatggtggctcatgcctgtaatccccacaccttgggaggccgaggtgagcagatcacttgaggtgaggagttcgagaatagcctggccaacatggtgaaaccccatctttactaaaaatacaagaattagcaaggcgtagtagtgcgtgtataatttcagctacttgagaggctaag

SEQ ID NO: 239573 - DNA, 367 bp, Homo sapiens
ctgaatttttatattagtaattatatttaaattataaattaaaaaatacggaatatgttaagctgtctttaaattaatattggaagtatacctttttagaagattattgcaaaatttgctcctcagttctgcaaacttagggaagttttagaaaataatttacaagtagtcagtaagtagttacacattcaaggattgaaaaatatgaaatactattttctgtagcttataaaccaacactaagagatgtttctcctttgtatttataatgcatttgaattacattctttggatgtatgatgtggtaaattactgtaagaaactcactgtcatctaaacctcaattataataaactattttactcta

SEQ ID NO: 239574 - DNA, 380 bp, Homo sapiens
tgtttttcttaaattcactatggctgtactctccaatctgtgaatctactgattcacaggtaaagactgcctggtaatgaagtcatcttcggtacttgattaactaaatcccattgggttatatcagacagagagagatactaaatcataattaactgtaaacagtgttaatgaggtttgggtgtattattcataaattttgagattactttttaattgaagaaagtagtaacaaaaagtaagaggcagctgttttttgacagcatgagaaaagatttgaaaagatagactgtgatggtctattttttttccttcagtttttttttaggttccctgtgcattataaaagacaattactggccattaaggcacaactaatt

SEQ ID NO: 239575 - DNA, 340 bp, Homo sapiens
tttttaataattctattttttctccactaatttgagatgttgcttttattgtatactaaattttcactaatatttgggtacagttctggaattttgattctgtgattgaattctttttgaatttccataaagataagacatattgcaataaatatgaatctttatcccaataaagttgattattgcaggggttgaaaaagtaattttttgtttattcttctaaggtcttagctaggatcccttgttaaaaaaaaagacacattactagaacaaaacaaaccagaagtttatcaacatgtattccttttgtatacataggagatactcaggaaaagcggga

SEQ ID NO: 239576 - DNA, 2133 bp, Homo sapiens
  misc_feature (802)..(802): n is a, c, g, or t
  misc_feature (1146)..(1146): n is a, c, g, or t
  misc_feature (1636)..(1636): n is a, c, g, or t
gaaaaacaatgtttttagagacagggtgttgctacgttgcccaggctggactcaaactcctgggctcaagcgatcctcctgcctcagcctcctcagtagctgggaatgataggcgcgtgccatcatgcctgtatgaagtggaaatgaaaggctggtataagctgtaaagtctttttgttcttagagatttttttctcattctaaacattatcagacctgaaaagtatttgtcgtaatgactgagacggtcctggggtaacagcgtcttcttaacggccactttaattggcgtagtttacacctagcctctccgagaactggaggacactggtaatcactattagatattgagtgctgactgtatggcagacacataagcattggtgatctcctgtgaggcaggtattgttattcccaatttatagatgaagaaacagaagtcagtgaggtggagtccgtttttgaggtcacgcggctagtaattggagcctggtttagaaccaagtcagtctcattccagaatccagaaccagtgatttgtaactgatgcacttgtctccaaagggatccagcactgggttttctcatttttaatgcatccattccttaaagcctctgttcacagtcacaaggtgtactttttaaaggaacacagcacacaaatgtgaccgctagtggacagcagtggcagcccagttggatggcagagcctggcatgccgactgggacagaagccccagcacacggtgtgatgatggcgtctccaggctgacctccatggcctcaggaatcaaagtcctcngtctctttcacgcggggttcagaaagaaaactcggctatcttacatctcctctcccctgtttatttgactaaagtgaagttcatgtggcttgagcctcgtttcctggggaaatcagcctggcttaggattccattgtcttctgggactgggaagatgtggaaggctgacctcacgcccagctgaaggtcaccttcccagactctgagctcggctgccttctgcatcgccacggctggagggcctggcccaggccgtggctgcatgctggctttccactgtctcggtgtccctgctgcctgtcagtaatgtgcccagcaccttctggtgtcatgtcccctcttgnttgtgattcttttcctgagctagtccattttctacctcgagtctgctctcctgccattcccaggggccacagctcagtaatgtgggtgtcagggaaccccaggccaggcccccttgtgccactgtggctctccccaaagcagggcaccaggctggctgggggggtcctgcccagagctgccccacgctgccgtgtttgtgctgctgctgtgcagtggtgatcttgccaaaatgtggcttttcctttctcactcccccagagctcccagaaaagtctctaggacttttcttccccctaaataaaagtcaggatgtgaagccttttgacagaattggagtttactgtcatctgtttccgtttctctaagatagggatcctggcgaagcccatgaaagccatggggcgctcccaccgaagcctccgaggcacagacctcccgggagtgcctgtgggcgctgcttccttaaactgcaggaggctgcagcctctngttgttcatgcgtcgttttttcatagtgtgtgtgggtttagagctacatgggttcttttctcacttatctgttcataccgcatgacaccgtccacttcaggcacagttgacggccgtctggaggtcatcagctgagggcacagtttgcctggttcttctataataggttaagtatttttttctccatttttttcccttttaaaagtactgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctc

SEQ ID NO: 239577 - DNA, 387 bp, Homo sapiens
gaacctagtgcctctttttaggaagtttttattggatcccagctatgaagaatggaagcaatcttccaagatgtacaaacatacaaaagtgacataactaaatgaaagtagagaaaatcccaaagacatcactgttctccacgttaaaaactaactgggcagctatcaagcatattgttattctctattgccagaggaatcctatgcagaagcttttggatccaaattaaatacattctctaatccctggggatagctcaagattctccttcccaccagctctattgtcaagaagaagaagctctgatacatgtcaagaacattccattgtaaagagtagagctttgggtaaaagaagtgaataaattatttcccccttgcattata

SEQ ID NO: 239578 - DNA, 482 bp, Homo sapiens
agggaagaagaaaaaggtaactttaataaccctctgccaactgccagagggaaatgctgaccatctggctcaatatctggccctggagatgctgctagttgacccttgacacccaagtagaagcaggtagttcctcagccacctccatccctgccctcccgagatccaggtgcagattaggctgagcttctggcactgctggaatatagagtgtggttcaaccccagcccagagggttcttacaagactggtcctttctagagaggagcgctgccctagattgtaaccattcctcccgtgtgcatggggacagcacagtgtaaggaaaagaccatgcttttggagtcaggcagaataaggtaaggccagactctcccatatatcctcagcaggaacatgttagcaagctaagatatctgtacttagcttcctaatctgtgaaattgtaacatataccttatgaggtcatgatgaggacttaa

SEQ ID NO: 239579 - DNA, 1794 bp, Homo sapiens
  misc_feature (106)..(106): n is a, c, g, or t
  misc_feature (870)..(870): n is a, c, g, or t
  misc_feature (1748)..(1748): n is a, c, g, or t
  misc_feature (1750)..(1750): n is a, c, g, or t
accttgcacaaaaacatgtgggcagaatggccttggtgggtaatcaagactggatgttaagccagcgggttgctgttttatctctcccggcctatctcctaccccncccccaacaacctgcatcaccctgttggcaggagctcagagccactgtcaccctcttggaaactatttatgtagcaagaggcatagacatgctcatgtcctgtgacccagtaattttactcttggaagtttatttacaggctgagcttggtggctcacgcctgtaatcccaacactttgggaggccaaggtggcaggatcgcttgaggcaaggagttcaagaccagactgaccaacataacaagaccttgtctccatttacttctttttttttaatgaagtttatttttaaacagcatgggagaagcttcagaatcatggtgcatccacagagtcaaatagcctatagccgaaagcgtgattctgaaggctctatagaaaaatgggcaggccttaccatgagggggaaaggagtggttttgtgactcaggcatctggataggctggatgcctaaagaactagaacttggggtaaaatggaagcacttgtgttggttggggcagggggaatgggttggtttgttttcccctatgctccattgtcttttcaattaaactgtaaaaaaatgaaaataaaagtaggctgctctagcctgaagagcacttgagcactatagagagcaatcggctgtggagtggattgcgggcctctatgtactgcaatcagtggagaggattagttcccctctcatacgtttccggaaggttcagaacactagtgtgcaacataacactccagtcaaggccaccagtcatgttcttcangttcccagaggtccatcccaccaaaaatgactggacaacacctggttttctccacacagtcagtgaagccacaccccatggctctgctaaacaccctggagtggtccatgcctctgccttcctctcaccttagtcacctactccacctgtgaggcccgggggctactgccaggatgcatgttctccagccctcctctgccctccatctcgagtccaaccctggccatttccctcttggtcctgtcccttccataccgataagcagatgacaccactgtcacttcacatccttcagtggttttccatcacccttagaatagacgcccacattccttattgtcatgatctacacatgctacaggccttgggcccttctttcctttctcagcttaacttgaacccttgccctcattcttgtgggagaaccttctccctcatccagttcttgtgacagtcggacttcttcaggcctctcctggccacccattatacagagcccatgccctcctgctgtcacactgctttcagccttccatgtcatggcacacataggaaacagtggcatccacagggtgcaatgggtaatttggaggcgagactaggggaaagtgcatgtgctgtttctaccatagaaattataaggatggtggctcacgcctgtaacctgtaatcccagcactttgggaggctgaggcgggcggatcacctgagttcgggagtttgagaccagcctgaccaacatggggaaaccccatctctactaaaaatacaaaatgagctgggcgtggtggctaatgcttgtaatcccagctaccaggaggctgaggcaggagaattgcttgaacctgggaggcggaggttgtggtgagccgagatcncnccattgcactccagcctgggcaacaagagcaaaactcagtcttg

SEQ ID NO: 239580 - DNA, 603 bp, Homo sapiens
gtgttaatgtcacatgcatcagaggagatgaggcttgaacccaggtttccagcagggttcagcccaggagcacgtggacccatcacagtgaaacctttgagaggcttagctccagaaggagatattgcccctacagcccaccccaggtctcacaggggcagagctgcttggcttaggcactccgtaacctgagagtgtctctcttctcatgctgatgatacagcaagcaggagtagttgggcttctcccccaagacccagatcagaggggctgtgcagacaagactccttcttccctgggggctgtctctgccccctgaatctggatgctctctgagaagctgtagtaactatgtgtgtccccatgcatgtgagtagtccttagagggctgaaaggctctgaactctcctgacctcccagtttacagtatttttattattaagatacagattgatcatccggcaacctagattttacatagcagtgtgggggcagagggaaagcttttgttccaccttctgaaggttcactgtcgaaatgaactgacaataaacaggtgaacaggaaaactcggggcaaatggttgaagcttatataccctat

SEQ ID NO: 239581 - DNA, 453 bp, Homo sapiens
gctctgtgggcgacaggtgcgtctggcctccctcatcctcctcttcctcccactctgtggcatccttagcgcgtgtcgtttcctgctcccagaaggtcaagcagcacagtagtggcgcccggagttgatgtcggtgaggacagcaacaaagaaggtcggtggattcctctcgggacacatctgccacccgctggactggcaaaacagctgggggaatgggttggcctcccagtccttctccgggaagaactgcagaatctggccctggcctttcccactcccgcgcgggtgcggcctgaatgccaccagcaggaagtagtctgtgatccgcgccatggggagggacgctgggcgggctccgcggctcggggactcgagggctgcgcgctcatggcccgggcctggccctggaccgcacacccgggacaccccgggttcgctccgcggcggccg

SEQ ID NO: 239582 - DNA, 388 bp, Homo sapiens
cacatataacatttaaacatttaatacctttttttggtattactgtatttattgttagggtttttcatgccttatttcttgctgttttaaatagtacagtgtacactgatgcagtttgaataactcagcaggtaggatttaaggttgtatacctctattttgttgttgacgatcagctgtacatctctggaaggtgatccttcttatacagataccaaaaagcacttagtgatttattttttgtccaggacaggtttctgaacatttctgcttgtaatctagttttcttttaagtttatatcaggataccaaagcaacatatttagcccccacgtctgttgagtctttaaaggacctactaagattattagtatagattctcaaatat

SEQ ID NO: 239583 - DNA, 705 bp, Homo sapiens
taccttttgttttgtgctgacatattggattaagttgtgaaatgaagtttttatcccagcttttccaatatatttctcataaatattggaaaacaatgcagaaagaattatttataatgttgtttgaataacaatgaaatggaaaatcaaagaaatctgttgtagggtttcacagagcctttattactgataatgttcatgggtaagaagtgtgtgctagttttactgtgtgtgggatatgcctctctccattttggtgttctggggtccttttggtaggtgaagtggggtgtgttgttgcaataagaaaacttagtaaagcaaatttatttcttaccctcaaattgtgtaataagattactttcatttttaatgatcactttactataacaaagatatttgcaaactcatcattgctgggctgggcgtggtggctcacacctgtaatcccagcctttgggaggccaaggctagtggatcacttgaggccaggagttccagaccagcctggccaatatggcgagaccgcatctctactaaacatacaaaaattagccaggcatggtggtgcatgcctctaatcccagctactcaggaggctgaggcacaagaatctcttgaacccagacgtggaggttgcagtgaaccaagatcacgccgctgcactccagcctgagtgacggagtgagaccctgtctcaaaaaa

SEQ ID NO: 239584 - DNA, 342 bp, Homo sapiens
aggagtgatcaggcaggtcaggaaaatgaggaagagctgccacagactgaagagttgtcagtgacacaggaggaaaaccaaggcagcacagggtcctgcgagccatgtgaatcgagtttttcaagaagagcttcatcaactgtattctaacaggtgttctggaaaatacttcagattgaggcctttatcctggtattgaaggatctaattttcagaaactgcttttttttttttttaaagatactttaaacagtggtagtgttaccggaaaggggtcctgatccagaccgcaagaaaaagttcttggatctcgtgtaagaaagaattcggagtgagtccata

SEQ ID NO: 239585 - DNA, 255 bp, Homo sapiens
tgaggagcattgggttttagtcttagtaattagccttatgacctcaccaatgccctggaagtaaatggtctagtgttccttcatacaatttacaaggcttgaggtcaagcaaacctttataataagtattagaactgtcaatgttataagatggcaacagctattatttgtttatgctttatttgtagaagccttaatgattctttggttttacaaaaagaaaataatcaaaaggtcactttcagacaaaaaaaa

SEQ ID NO: 239586 - DNA, 730 bp, Homo sapiens
gaaaaagatacagaactaactctaaaagaattcaagaaaaatttaaggatgggaaaagataattatacttttttagttgcacagggtgcgaatggggtggaagaaattgagcaaaaatgtaattagtttgttacttctaaccaaaccacttctgaagcataactttataggctcttactctgatttttcattctatcaaacatatgaattagtgggaaattatagtggtactttaaatttcttggctgccgctatgcatgtttttttcttagcctaagaaaactatctaggaatagtgaaaaaacatagaaatccttactaattaataacactactaaactgacaataaaataacatcaaaaactaatatcactacagtcaaggatgttttaaaattgaatagaggctccaaaaggatttaaataaagaagtgccaaacaatgtggtcagcaccttaactcattagttaaccactaataaaaattttcttatactagtatctttttcccaacaaaagagacaaaatgaggtttcaagggtatcataatttggcaaaaagttaacattctccatcttctgcaataaacactgattcatacatacaatctattcccaaagcttttagagatacgtacacagaaggcataaatgggaaagaatttatgggtgaaaattaatgccttgtaagaaattcattaattttttaaatataaagttcaaggtaatcacc

SEQ ID NO: 239587 - DNA, 676 bp, Homo sapiens
gaaaaagatacagaactaactctaaaagaattcaagaaaaatttaaggatgggaaaagataattatacttttttagttgcacagggtgcgaatggggtggaagaaattgagcaaaaatgtaattagtttgttacttctaaccaaaccacttctgaagcataactttataggctcttactctgatttttcattctatcaaacatatgaattagtgggaaattatagtggtactttaaatttcttggctgccgctatgcatgtttttttcttagcctaagaaaactatctaggaatagtgaaaaaacatagaaatccttactaattaataacactactaaactgacaataaaataacatcaaaaactaatatcactacagtcaaggatgttttaaaattgaatagaggctccaaaaggatttaaataaagaagtgccaaacaatgtggtcagcaccttaactcattagttaaccactaataaaaattttcttatactagtatctttttcccaacaaaagagacaaaatgaggtttcaagggtatcataatttggcaattcccaaagcttttagagatacgtacacagaaggcataaatgggaaagaatttatgggtgaaaattaatgccttgtaagaaattcattaattttttaaatataaagttcaaggtaatcacc

SEQ ID NO: 239588 - DNA, 541 bp, Homo sapiens
ctctaatatttgatttaaggtggctagcccttttggaataaacctatgaaatgtttcttaccttaaaagaatgttgcaagatttgagacattgatatttagacaaatgtaacacttctgagaaattgtaagatgacataatggaaatagtaataaagtaagtggcaaatgtggttttaaaacaagccagcagtgtctggatttgtctactgatttataggaaatacatgataaattacatcacagatgggcagtgaggagtatctagactatgggaaattctacaggacccaaaacctggtttcctcaacaaacaaattgcaaggaaggggtgggggaacctatataaaatacataaaagacttaccaatcaattacatgtggacttcatttgtatccctagtgaaacaaacacattataaaataaaattatgccattcttgaagcagttgagaatttgaagtctcttactgaatatttaatattaatgaattattgttgatttaatggtattgagtttatatgttaaaaaatccacctta

SEQ ID NO: 239589 - DNA, 616 bp, Homo sapiens
ggaggaaacaagacactctggctttctgaattgccagagttcttgcactgtttcttttgagtagttagaaaccttctttcctggatgttgttagagagctgaggctttgtgcagggttttaatttctagctaaattcttgtccatggttacacaggggtctatattagcaaaatatttttggtgttgaagttttgggctgtgatccagtaggtggtgcttaagtgtattggccagtaggtaggctcttgctctgccatatgcagggcatgctccctctcagtgctctgaaagtgtgggctcctttcccacttgagtactggctccagatcttggcttggcacactgcagctctgggatgagctcagattttatgttccctcgccagcttgaaggctgcagcagaagaaaccttagcagtggttatggcagagggcctttcacttgactcttggtggtccaccccagagaaacgaggagctgctatcagccagtgcaattggccaaagatggggcagctgtgctgtgggcccaagccagagggtcccggtttggtgaagagcagggctacgggtgggtcacaagagagatagactgagttcttctccttagggcaac

SEQ ID NO: 239590 - DNA, 262 bp, Homo sapiens
ataagaaggcaagtttatttatttatttacatgattatttgttgtaaaagtttactgtttattgagatggcacttgggtagcaatgtcttgtccactaaagaacttatagtatcaccttttgtaaagattgatttagactgggcagggtggctcatgcctgtaatcccagcactctgggaggctgaggcaggattgtttgaggccaggagtttgagaccagcttggacaacataggaagatcccatctctacaaaaaataaa

SEQ ID NO: 239591 - DNA, 316 bp, Homo sapiens
tgtattgttcaatgctatattcctgtagaatggtgcttggcacttagaagtaccccataaatcattattggacaagggttagcgggagcgacaactctaaaagggaatctgaagcagtgatggaaaggaggagccaatcaggggaggggctgggggcctagtagaaggaggaaccaatcaacggagaggttgggaggggacttggcagaaggaggaggagccaaccaggggagcggtttagggggtctagcattccaacagaaggaagaggctttgtagaggtcttgagagacaggaccttggtgtagtttaagaa

SEQ ID NO: 239592 - DNA, 273 bp, Homo sapiens
gagagagaatgatgaaagaggatttaattgggaaattggctcacacaattgtggagaccaagaagtcccatgatagctgcaagctagagatgctggctcagtcaaagtcagaaggcctcagaactaggaaagccaatggtataactcccagtccaagatcacaggcctgagaactcagggcaatgctggtacaagtcctggggtccaagggctgcggagcctggagttgttgtccaaggaaaagagaaagggtatatcacagcttcagcagat

SEQ ID NO: 239593 - DNA, 500 bp, Homo sapiens
ggcccggcctggctgaggccgcagatgggccggatcgtcagccgctgacgtcggggccccgcccgccgggcctggcatttgggccgcccggtcaatgccttcgacgcgggctgggcgatgggccgggggcaacgagcgcggaggctgcgcgcaaggccctctcaccccgcggcctcgcgcggccagagtccctcgcgcgggctcacgcggcggcggcctgggccttccgggcgtccgcggggccgagggcgcttacccgggcaggcgccgcttcggccatggctgcccgcgtccctcgctgggttgcagtccctggacccggcctgtcgggcccggggcggcgcggcagcgacggcggaagcggagcgggacccgcctaacctgagagctactgccgggcggcagcgaactgcgtcccgagccacgtgccccgctggccctttaaaaaagagctgcgctcggcggccgagcttgaggacgcgcacagcgccccctgcagc

SEQ ID NO: 239594 - DNA, 460 bp, Homo sapiens
cagtttgttctcgaatgctttccttccagcaattgccaaaagcagagagtgcatgtgtccagcacttggacaggtgatttgcggtgtggctgaaagagccctgggttgcagtggtagaatcgggagatctagatttgaactccatcttacatggatctcactcttggtgagagcgtgggcagatgagctcccttgggtgcagtgtgggaatgaaatcaacaccgtctgcctcacttggctccggtccgctgcctcacctgcccagcaagcactgcccactgatccccagcccaccttgcaatttgctcccaagtgcagcccttgcctcaatccgtgtgggtgagcgtagggggagggtacagcccgtttgatgaggagcccaaggtgaggtctgggagtcttgggtcctggcagacaaggagatgggatgaggcatttctctgataccttgccttccttt

SEQ ID NO: 239595 - DNA, 951 bp, Homo sapiens
tttgtttgttctgttaagtacctaagtaatgtgtttttaggaaaagaaacctagcaagaacattgtagacaaggctaggcaaagatgatctatccttcaggtgatgtgtctgtcctcaagatcacttacaaagaagaggattggactggaagttactacttcacaattttagttttgttttcacatctgttacttcaatcctgatgacaattctgaaatggatacaactactactatgtatccttctttcactagtgaggaaattgagatttggaattgagaagtgaagagctttgctggagtcacacaggtgggaagttgagagccaggacttcaacccagcaaatctcctaactccaggtagaaggttcttcatgctctaccactttaataagaatgctctagactttgttaatacattagattagtaagatagcaaactcctactcaacctggatattgggtctatgtcttgttgttatagagtctttaacttttacagagacatgctaaaatatttatagttgaaatggttaggatttctttcaaagtcatccagtggtggaggaaaagatgaaatgtgtggagatagagataacgataacaacttttgaattgataattgttgaagataatatgagatgggttcatgtggtctgttctactattgtatctatataaaattttccataatttaacaaaaaactcccaatcttacaatatttatcagacctacagtgtattattttctaagttgtttctaaacttgtttccatttctgatgacttaatcaatgtctcaaacatttctaggcattctccatctcatgcattccttctgttcctctgcattagtttctcccttcctgttctactgaattacaaccttgcaagaaattaaaacctacctcccttccaaagaaaaataaatttaaattaaaagaaaacctaa

SEQ ID NO: 239596 - DNA, 464 bp, Homo sapiens
atttcagtcaaagccttggtaaaataaccagtttctccaactgggccctgttacaaaagaaaacagattcttactgtacttatgcaaataattatattgccataaattacaaatacaaataatttccaaattctggagaaatcagatagagagaaagaaatatgcttcaaattttgtttacaggagtacactttacccaattggtgcaaaagtagttgcaatttcagaccatgaattttaaatcgttataactaggctcaaacactttttttttttttgagacagcctgggcaacagaacgagactcggtctctcaaaaaaaaaaaaaagtttagctcccttaagccatttctgataatttattctaaagataaaatcaaatgtggaattcatttataaaggtatttattgcttcatttataatggtgaaaaaaataaaaaatctctatctccaataaaaaaaa

SEQ ID NO: 239597 - DNA, 1296 bp, Homo sapiens
gagtttcaccctgttgctcagactggagtgcagtggtgcaatctcagctcactgcaacctctgactcctgggttcaagcgattctcctgcctcagcctcccaagcagctgggactacagatgtgcacaaccacacccggcctgaatttttctctatttacccaatctgcattgatggaggatgataataaataccaccataaggacaaagaaccttatcttctccatcccattttcatcacaaagagtaaaaacagcagtcataaaattgtttggcagagaataaaataggttatacaggatgtttaattacaatgttaaaagttggggattgggaaaccaagggattcttgttctgacaataaagctgctcaatatttacaaatgtgagcagttttaataccgaaacacttaacgaaggataactggctgtacagctatactgaaaaatcaatacaaagaaatattctatttttaccagtcagttttaagcctaaaacttttccactctgaaaatttagtagaacatttcaacagtgatgaccagatgtaagagttatttaaaggtcaaaaagccttttgacttttaaagaacaagaagatgaatcatcaagtcacaggactaagaaagacctaaacacaactccattaaaaaaatatgaccacaaatgtgatgacagggcacgcagtgccttaaatttctgacttaagtcagcagttacattccatcagattccctagctcctcacagttggtcttgtttcctgcttctaccaaagggtcatcctcctattttgctttttccctttagtaataattctttcttccatcaaccactcgagtatcagataactctggaagatttagtttaggtttgcattcttccttgcccagactactgcaatagcattgtaatgagtttccactgataccagaaagatctttctaaatggaaatctcatgttcatttatcatttgaaatccttcgacagttcccaggctttagtattaaataaaattcatcagagtggtatataaagcctcttcgtatgtttatatttagccccctctctcaccattctttctcaactaattacttgaagttacacagctagtaaggagatatgcttttcaaaactttcaatgacacactccattcaaaaaggtgacgattcaacttgaagggaaaatgttattataagatgttaactcatctttaaaatttaatggaaatccttgcaagtgggcggtaaatatgaataagatacggtgaacaggaaatactacaaagctgagg

SEQ ID NO: 239598 - DNA, 1242 bp, Homo sapiens
gagtttcaccctgttgctcagactggagtgcagtggtgcaatctcagctcactgcaacctctgactcctgggttcaagcgattctcctgcctcagcctcccaagcagctgggactacagatgtgcacaaccacacccggcctgaatttttctctatttacccaatctgcattgatggaggatgataataaataccaccataaggacaaagaaccttatcttctccatcccattttcatcacaaagagtaaaaacagcagtcataaaattgtttggcagagaataaaataggttatacaggatgtttaattacaatgttaaaagttggggattgggaaaccaagggattcttgttctgacaataaagctgctcaatatttacaaatgtgagcagttttaataccgaaacacttaacgaaggataactggctgtacagctatactgaaaaatcaatacaaagaaatattctatttttaccagtcagttttaagcctaaaacttttccactctgaaaatttagtagaacatttcaacagtgatgaccagatgtaagagttatttaaaggtcaaaaagccttttgacttttaaagaacaagaagatgaatcatcaagtcacaggactaagaaagacctaaacacaactccattaaaaaaatatgaccacaaatgtgatgacagggcacgcagtgccttaaatttctgacttaagtcagcagttacattccatcagattccctagctcctcatccctttagtaataattctttcttccatcaaccactcgagtatcagataactctggaagatttagtttaggtttgcattcttccttgcccagactactgcaatagcattgtaatgagtttccactgataccagaaagatctttctaaatggaaatctcatgttcatttatcatttgaaatccttcgacagttcccaggctttagtattaaataaaattcatcagagtggtatataaagcctcttcgtatgtttatatttagccccctctctcaccattctttctcaactaattacttgaagttacacagctagtaaggagatatgcttttcaaaactttcaatgacacactccattcaaaaaggtgacgattcaacttgaagggaaaatgttattataagatgttaactcatctttaaaatttaatggaaatccttgcaagtgggcggtaaatatgaataagatacggtgaacaggaaatactacaaagctgagg

SEQ ID NO: 239599 - DNA, 442 bp, Homo sapiens
tctctttgggaaagttcaaaatctgtctattatcagtcttcagtcacctctcctttttctattcaacaaataaatatttaaagaatgcctaaccatgtggctctgtgttaggcatttggcaaatagagaggagtaagcagacagggttgctattcttagagaattccaatgaccattgccaacaatagcatttcaatcaagcaagcataacatgagaatctcccatgaaattctcccataacatgggagaatcaagcaaacacaacatgggagaatctcctgttgtgtttcaccaggtctatctctgggggaaatagatctgagttagtgactttggctgcatcttgctggaattcttcctacgactctctcacctctgcaactccactcagatataccaaggaattcctctctgctctggcagttctaagaaaaataatga

SEQ ID NO: 239600 - DNA, 529 bp, Homo sapiens
aagttttaacatatttgtaggtgatatggatggtgacattgcaatgatctttcctcttgcttacttcaatgaacttgaaaatatggttgcattttaaaaggcctgtgctacctttatgagctgtagcactcactgcagaggtctgcggcttcactcctgaagtcaagtcggggagaccatgaaaccaccggaaggaagaaaccccggacacatctgaacatgtgaaggaacaaactcctgacacaacatctttacgaactgtaacgctcaccgtgagggtctgcggcttcattcttgaagtcagcgagaccgagaacccactggaaggaaccaattccagacacattatcactaattaaacctatgtctgtaccttctagcattatatataaaaagtgcaacatagaaaacaaaatttaaatccacaactatttaatattcacaacttctggatttatctcatgttgcaaactatttttgttaccctattctttgagaaatataaaacatcagtatttcattggtgaaa

SEQ ID NO: 239601 - DNA, 2302 bp, Homo sapiens
  misc_feature (903)..(903): n is a, c, g, or t
  misc_feature (1156)..(1156): n is a, c, g, or t
  misc_feature (1343)..(1343): n is a, c, g, or t
agcagagatgcatggtatagagctatcctgtgcattacgatagctgctagccacatgtggctgttaacactgcagtgtgctaggtctgaattgagaggtgccgtcactgtaaaatacataacaggtcttgaagatttatatattaaaacctgttcatcatctcaataatttttagattgattatatgtagaaataatatttttgtagtttgaatttaataagatattattaaaactggggccaggagtaggggctcatgcctgtaatcccagccctttgggaggtcaaggtggaagaatcacttgaacccaggagttcaagatcagcctaggcaacataatgatacctcatctctacaaaaaaataaaaattgaaaaattaattacacttggttgttttcatatttttgtgggattacaagataaaatttgaaaaatagatgtagcttgtgtttgtggcttgcattattttgctatttgaaagtccaagtatagagtgaggcacagcatagactggaggcacattgcttcacttcaaatcctgatccttccccctactcgttttgtggtctttggcaatttactaaatctgtctttcattctttgtcttatcatcttgtaaaatcaagatagtgatagtacctaactcaaaatattgttatgaggatagtttatatgtctaaatcatttagaacagtatctggcatagagtgcatactcttcaaatgtttgttgaataagtaaataaacccactggtcatgtgcaccttcaccccagtaggtagaattatcaaagaagtaatgcagtttttaagtagcagtttcgtgaataacctgtatttttctaggagcaatagtagcaattgtagactgacatggtgaacatttttgatggtttattagnttaatttccttctcctcactttcttcctctctccagaacaggtggaaggaaaggagcaaaactcaaatatattaatttcattactctctagtaggctttttgggagaatgattctgaaatggatggcaagtcaggaatttttttcttcgcattatggcagtttcctgttactttatgtaggtaccttgaaataaatctaacatatgaaaactcaagcttctatgttacagagtggattctttggatccattgnagagcattgtcagcagccatccagacacctccatgtattcatgtattcattaactagagaagagacactttgaagtcaatcaaaatttaaaatatttatgaagcctatatataaagggaagatatattggttgtggcagagacactcttaaagtggcctccaattcttgtctcctggtgttcacacncttgcgtgggacattcctcttgcaagtaggcaggacctgtaacttgcataaccagtacaatatggcaaaggggatggaatattcatgatgacacatatgcagtaacatgaaaataagatgtcagcacccatccttctggagtttctcctttgcttgatggctttcagaaagtatgcagccctgttgggggacctgcatagcaagagacttctggcagcttctagtgactgaatgtggcctctgccaacagccaacaaaacactgccaagaattaagttctcccaacaactggattaagcttataagtgaatccttccccagtcaaacctctgatgagaccacaccctgccaacaccttcatttcagccttgtaagaccctatcagaggactaggtatagtagtgccaaactcctggcccacaatacatatgtgttcttttaagctgctagtttgtggtattattgttattcatcaataaataactaatacactggcatttttactttcccaaatttaacctccaagcatattttatggcaaaagcaagacatatgcattgaaattattgggtgatttttccttttcttctttttactagcatcagagggatttaagtatatgatacttagcagtagaatcagtcactatatttataatatttcacagcatttaaaacagtatatacaccaaagactttaggttggcagacaatgattcagttattcatatgttgatctgatataactatgttgttaggaatgtatgagacacatatatttgggtttctgaagacagatatgaactgaagacaattttttcaagttattagcatcttccaggtggtagttggaatactgaaatggattaaatcacctgatcatctgtagacattaaagaaggctaaggacagagtccctgaagtaacaacttttaaggatcatgcagaaaaagaatcagc

SEQ ID NO: 239602 - DNA, 853 bp, Homo sapiens
  misc_feature (725)..(725): n is a, c, g, or t
  misc_feature (758)..(758): n is a, c, g, or t
ggaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaacctgatgaattaatggattccaaattgagatgcgtatttgaaatgcccaatgaaaatgataaattgaatgatatggaacctagcaaagctgttccactgaatgcatctaagcaagatggacctatgccaaaancacacagtgtttcacttaatgataccgaaacanggaaactaatggaagagtgtagaagacttccgggagaaatgatgaagtatccgaagaaaattggacctgagagatgaagggtaggggtcaaaaag

SEQ ID NO: 239603 - DNA, 786 bp, Homo sapiens
ggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacagacggaatcttgctctgtggcccaggctggagtgcagtggcgcgatcttggcttactgcaacctccgcctcccgggttcaagtgattctcctgcctcaatctcctgaataactgggattacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtt

SEQ ID NO: 239604 - DNA, 1135 bp, Homo sapiens
ggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacagacggaatcttgctctgtggcccaggctggagtgcagtggcgcgatcttggcttactgcaacctccgcctcccgggttcaagtgattctcctgcctcaatctcctgaataactgggattacaggtgcgcaccaccatacccggctaatttttatattgttagtagagatggggtttgttggccaggatggcctcaaactcctgacctcaggtgatccatccaccttggcctcctaaagtgctgggattacaggtatgaggtattgtgcctggccccctatattttcatactttgagttttttaatataacttttatttattaaaatttttaaattttgtaatgacagggtctcactatgttgtccaggatgatcttgaactactggcttcaagtgatgctcagtgtcccaaagtgttgggattacaggtgtgagctcactgtgctcagacaacttttattatttttaaaagatgttttcataagtcacataaccctttctgggtcttgccagcattaaaatgagcaatccatagcttctcatttcatgaaaagatctcagtcatattcagtttaatcaatgagttccagtgagttctggtgttctgcagcactatggagtaatatggttaactataatttattgcatatttacaaaaagcttaaagagccagctttctatattttcataaagctagaagagaggattttgaatgttcacaacacaaataaatagtaaatgtttgaggtgctggacatgctaattaccttgatttgatcattacacattgtatacacacatggaaatatccctctgtatctcataaatatgtacaattattatgtatcaactaaaaac

SEQ ID NO: 239605 - DNA, 1189 bp, Homo sapiens
ggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacagacggaatcttgctctgtggcccaggctggagtgcagtggcgcgatcttggcttactgcaacctccgcctcccgggttcaagtgattctcctgcctcaatctcctgaataactgggattacaggtgcgcaccaccatacccggctaatttttatattgttagtagagatggggtttgttggccaggatggcctcaaactcctgacctcaggtgatccatccaccttggcctcctaaagtgctgggattacaggtatgaggtattgtgcctggccccctatattttcatactttgagttttttaatataacttttatttattaaaatttttaaattttgtaatgacagggtctcactatgttgtccaggatgatcttgaactactggcttcaagtgatgctcagtgtcccaaagtgttgggattacaggtgtgagctcactgtgctcagacaacttttattatttttaaaagatgttttcataagtcacataaccctttctgggtcttgccagcattaaaatgagcagtaaaatgatgggtttggatgggcccacccagccttaaagtttaatgattctaaatccatagcttctcatttcatgaaaagatctcagtcatattcagtttaatcaatgagttccagtgagttctggtgttctgcagcactatggagtaatatggttaactataatttattgcatatttacaaaaagcttaaagagccagctttctatattttcataaagctagaagagaggattttgaatgttcacaacacaaataaatagtaaatgtttgaggtgctggacatgctaattaccttgatttgatcattacacattgtatacacacatggaaatatccctctgtatctcataaatatgtacaattattatgtatcaactaaaaac

SEQ ID NO: 239606 - DNA, 664 bp, Homo sapiens
ggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtt

SEQ ID NO: 239607 - DNA, 377 bp, Homo sapiens
catctgaatggtgactttcttatttggaagcttttcctgacttgatcacctttgctcctcacagcaggtgttactctaagtaggcagatgaggaaatggaagctcagagagctcagagtgcccttcccaggactgaggtgggagcccagctttccagtgcctgctctagagctccttctgacataccacctacctcctgccgctaatcaaggcacattcatccctgctgaggggcgaggggcttttatcttcaaggtcattttgttgtgtttaaacaacacaggtaaggaaacagttctaatactggccacctgtgatctctgacagcatgtctttatttagttcagggctaagtaaactttttctttttctttttt

SEQ ID NO: 239608 - DNA, 289 bp, Homo sapiens
ttcgggagcttggaattttgatatgtgctaggcagagagggtactttggtgaccagcccccttgggcactgagtctctactaagctttctggattggcaacatttcacacatgttgttacaactcattgctggaggaattaactgcatcctgtgtatcttcactgatagaagaattcttgcaagcttctgcctggtttcttctggactttgccccatcctccttttgcctttgttgagtcagctttgtatcctttcactttaataaaccatgtaagtacaacaactaaa

SEQ ID NO: 239609 - DNA, 446 bp, Homo sapiens
ctggttgctaaaaaactggaagttactaccaatggaaatgggtgacatctccatccttggagatcatcagaggtgaccagacaactacaggttctaatgatttcaacattcagctgcccgaaggcaggggcctggatggaatttttctttctggtacctttcagatctgagaatctgatcctaattcagaggtagaggaaaacaggtaaaatatttctctccctaatgtgatagcaagtaaaaatgaaaaataaagggcctaaggctggctgtgatgtcattcacctgtagtcccacctacttggggagctgagagaagaggagtgtttgaacccagaagtttgtcgctagcctgggcacatagcaagaccctgtctttataaacaaaacaaaataaaataaaaatttagaaaataatagaagacctaattctccttcttgaaaac

SEQ ID NO: 239610 - DNA, 408 bp, Homo sapiens
ctggttgctaaaaaactggaagttactaccaatggaaatgggtgacatctccatccttggagatcatcagaggtgaccagacaactacaggttctaatgatttcaacattcagctgcccgaaggcaggggcctggatggaatttttctttctggtacctttcagatctgagaatctgatcctaattcagaggtagaggaaaacaggtaaaatatttctctccctaatgtgatagcaagtaaaaatgaaaaataaagggcctaaggctggctgtgatgtcattcacctgtagtcccacctacttggggagctgagagaagaggagtgtttgaacccaggaggcggaggttgcagtgagccgagattgcaccactgccctcagcctggcaacaagagtgaaactttgtcc

SEQ ID NO: 239611 - DNA, 2290 bp, Homo sapiens
cgggtcctgaggaatcctacacaagctacttatatcagtgatcactaggataatccatagaacttttgggaaagaagtttaagacctttctcccaccatttcagcaggataaattccaactggattagaaaatgaaatgttaataatgcaaataagtacatatttatatctgtatataaaatacagttgatatttgcctggtgtttaggtgtctaaaggactttctaagcataaaggcaaaaaaaagtcataaaaatgctatagcagtttgagactctatgcaggaaagggcatcatcacgtgcatggatgaatctgtatctaattttaaacaatttccaatggtgcctgtttccttttctttgaaaatctctggagaaatagttcctcttgctgtgtctttctttaggcaagaatttttactaattgatgtgtagtctgaatcctggctaagtataaaccttttattttttatacctgttcttagtgaaaatgaaactgtgactttttttttaattccttttgttggtcaaaaactacaattaactcttctgagtttcttctctggctgaacaaacaatggtcccattggcctttcagggaactccaggccgtctcaaaaaccttcatgtttcatttcttttcagagctcccaaaaagaatagcttgctcttgacgttgtacatgttagtggaatgatcaggactactttgcaaagatgaaaaatttgtgtttctagtgatttgaaaatagaaatctgatgtaactattagatattgggaaagaaggtgacgaaggtaggtatcaccgaaagcacttaacaattctgaataattctgtacttgattgcatttatgtgtatcataggaacagttgggtttccttgagtgttaaattatttattcacttattccacttcaagccagctaaatgattgtttccctgatggcaaaagtctcagattgattgcacagtttatttggttggattgtttatgctctttttattatttattcttatttcaccaatgaaaatatcactaagttctttggtttgttgacctgattgtacctactttgacaaatcactgcctttctggacccagttttctcattaagtggcagtgataacctgtcatacttacagatataaaaacatgaaagttaaagtattgggtaatactttcctcctatcttttttttattttgaaaaagataaaaaattggcataatgtattagttaagatggaataatcatatgttgatatccagccatttcttctctcaaatgataggaagatttttatgtgaaactacttgtgagagatcttaacaatttgtagttagagaaagcactattatatcatttggaaatgcaagaaacaagttacctttggggcaacagaggcccttgtcattttctcaaaagaaggaagcatcagcattttgatgatgatgttgagattgtagaaatgatgaaggtgaaaaagttattctagcttatgtttagcaaaatgaaatgaacccaaataataaaacagttacaacattgaatctctttgggagaaaaaaaaaagatagaatgctaatgtccttcagaacttcttaaaccagaaccttaaaaaaaagagaagcttttaaaaaatcataatagtttatgatcttgaagggtttaaaagtatttgatgaagatgtcttttgaatttatttgtaggtcttcttgtgtatttaaaagctaagttatcttgtaatcatttttttctatacctttgtcagtaacctcttagtgatgaaataaaaaagattaggtaatcatccagcaatggggaagaagttaaggaacaaagagctcagattaaactagtttttagaatctaagcatttctgcatgaatttgaatcatggaaaacaaaatgtagcactccaacatttgatgcaaaactaaaagtggaatactgctttgatatttgaatgaattgaaaaataattaacatccttggaactgtatgtaaagaaggacttcacaagtattatagatacccccaacctcagcccttttcccatgtatctctttgatcacatccctacctcatagatcacccatgtgctgaagactttcagttctgtatgttcattctagatctcctgaactcaagatcagaatatctttctgacttctgactgtgtatttctggatgttatacaagaacctcagctcaaactcagtattccctaaaccattgtttttgaaactttatgttggatgtgaaatctgtattgtagaataacatt

SEQ ID NO: 239612 - DNA, 508 bp, Homo sapiens
gcacatgtcccacatgcttgtttcctaggacagaacccaaatatttgatccttggacttacgaatttcatcaagagaagttaaagtatgagttacaggaatgtggaggatgaaccgagttcctgggttttcgacaactatgtgactgagacaaaatatacattagaagaaagtaacacggagtttggaaggatagaagaccacagttcacagtacaactaactggaaatatggtgtcaatgtgtctgtttcagaggagaaccagtccacttgaatgaggtcactgtgactcaaacattatgctgtaatgttatcctgaaagagcttcaataaatctaaccactcatgaatgtctagataacacaaatttggcaagatctaaaaactagctaagattgatagtgacagtcaaaggagaaagttgttaaaacactggaaactctcatgggatgatgtctgttaatgatttgaaatgaaataaagttgatatccttggccatggaaaaaat

SEQ ID NO: 239613 - DNA, 1081 bp, Homo sapiens
ctctgcctcaagccccctggatgggattcaaagtaccagtgaccttaggtgctccagtggcttcttcggggaaaggaaccacactttcaggactgggaagttcttcccatcaccaccccaaacccttcctgttgccctggaagccccagtcctgttctcagcagaggtggcacggtgttggctggtgcgggcaggggaaggttgttgtcctctgagcaggggcacacgcctccacctgcgggggctgctgttgtgtttctgtgtgtggcttcccctgtttgcggctgaggcttgaacttccgggcctgcacagcttacagctgcagcgtctccccgtggctgactcagggtgactggcctcctgctccgaaatgtggagttggtgaggctgggtggctgtgggctgcctgaccctccttccctgccctagggtttctgtgatctggtgagtcagttgctccccagtgtttaacagacattgaggacaccctcttatctttacacaaagtgtctcttatagtagaaaaaaaaaatgaagcccagggaaaaccagaaatgaagctggcagagatcaaagtccaagttagagctaaatattcactcctggctttgctttcctggcactgatgccggaacaggacaagccatttagctgctgtggggttggcctgagactgcaaagcacaccttccagaatgccatggtgtgcagggggctccaggactccccagcacgccctcagctctgacctgacagtcatccaagctgggtcgctagccttggccagctctatttgcctatgtcctgcacacctttgcccactcctgcccccgtctcaactttgtcccccgtctacccatgcaggatccccaacctttcccttttactctcctccccatttgtccttgccaaccccgggtgtttgtaaattttgaggtggaggggatgggccagggaatgtgagggcggaggcagattgaggtttgatacaaacatgtaaataaacttccttcttctgtccactccccaggagtggtgctcacgggaacatcactcgcccccaccgccagctgactttttc

SEQ ID NO: 239614 - DNA, 343 bp, Homo sapiens
ctaatgacctcctgcctgctgcctcccagctcttatatgacttatgacaattactaagacaaattgatatctaaacaaagtctcttggggattttttgattattgtttgctttcatatcttctgaatgatcaaaagaggactctaacaggaacctttgatgtttatccaagtaaattcaggtttttcctgcaataacgaaagtaagcttgtttgtggtttgtgaagatttaagcaaaggaggagagaaaagttgatttttaaaaactgtttcttaaaagacaaatctttaaatgaacacaagaaagaatttaatttaacaattttctgagatcaggttccaac

SEQ ID NO: 239615 - DNA, 464 bp, Homo sapiens
tgaggtttccccagaagcagatgccactatgcttccagttgacagcttgcaaagccgtgagccaataaatctcatttcttataaattacccagtctcgggtatttctttacagcaatgcaagaacggtctgacatagccttatactatcttcacgtgttaaaagaggacgggattgggccgggcgtggtggctcacactcttaatcccaacagtttgggaggccaaggtgggcagatcacctgaggttgggagttcacaaccagcctgaccaacatggtgaaaccccgtctctactaaaaaatacaaaattagccggacatggtggtgcatgcctgtaatcccagctactcggatggctgaggcagaagaatcgcttgaacctgggaggcagaggttgcagtgagccaagatggcaccattgcactcactccaggctggggcaacaagagcgaaactccatctt

SEQ ID NO: 239616 - DNA, 401 bp, Homo sapiens
cgtgagaacctctgcaagtcaggttcccatgattgtataggatgtgttacggcagggatctgaaagctgatgatttcatcactagctggaagcatcaggatcgaaacgatgacagttgcaaaatgttcatcaagtgagagctgcgtcctcgcgagaccgaaacgccgcctctagcacctgaaacacaagccctcagaggagcagatgattccctcaggatttaagaaaattgaggacttcagttttcgaagccgcattatttcacattgctgatacctctagcgcctgaaacacaagcgctcagaggagcaaatgattccctcaggatttaagaaaatgaggacttcagttttcgaagcagcattatttcacattgctgatacttttaggcaaaaaaaaaa

SEQ ID NO: 239617 - DNA, 441 bp, Homo sapiens
ctcacttctgggattttactcatgctgaattgccagcctacttgagtacattccttcccaactccaattggccaaactttgtccagtgcctcctcctccaggaggcctacccagattttctccacatctctccctcccttgacaccttcagcagagggtcagctgcacatctgagtacttagtaaatactcagtaaatgaagtcatttctggatgaatgaataaaaaaatcatacatacacataaatctaacaagcactgagatggtcgaatttttgtttttaatattgatttaaatataacagctcccaggggctcctctcctctgttccatcacatatgaagtctctcacttgcaagcaagaaccagcctgaaaacgttggttttgtgtgctctgttaaaaaaagaaagaaaaattctatgcaaattgctttaaaattt

SEQ ID NO: 239618 - DNA, 437 bp, Homo sapiens
tgacgagtccccttgttgagcccaacattaactctttagctgctgggtcgtgaagctgtcctggggaggggtccgggtggcagtgggacactcagagggcctggggcagccactgtactaacacatgcttaaggatttcagtgttttaataagtggtacggctatcctggtgtgtactggctgaaaagcagccctgggaacaaattgttattggaagttaaagattctccaattaggcaggttttcacaagttatatacccatttgttcatattggatcagcaaagattctatctgaaggcagagttctggactagaggccgggggtggtggctcacacctgtaatcccagcactttgggaggccgaggcgggcagatcatttgaggtcaggagttcgagaccagcctggccaacatggcaaaaccccatctctact

SEQ ID NO: 239619 - DNA, 375 bp, Homo sapiens
atagaaatgatggtaatcttacagggagggttaatcagatacatgagaaatcacatctattccttgataaagtacaagttactcagaaatcaatcacagactccagtgtcaaatacctagtacacaacaagacgtgctgcagatttgaacagttttgtctgctgagagcattgatttgtgggttctataatacatgcacaatagtaaacaacataaatataagaagtagatatacagtaatgatttactttttctaggaggagagtgactaatttctcagacttcagtgctgctacaaaaacactgctgggatttggtatgttttcagggaactacacagtgagacacacagttaagcacttggagacattgctc

SEQ ID NO: 239620 - DNA, 700 bp, Homo sapiens
  misc_feature (649)..(649): n is a, c, g, or t
gtttgtcacaactctctgctgtatgtgctcatttcatccatccatccatccatcccccttagtcgaattgaaggaatgcagtctttggagataaaccaacatggcttcaaattctgggtttgtcacttattagcaatgggattatatttctttatctgcaaaatggaggcatttatgtaagatacctggcacattgttaagtactcaatagtaattattatattcattatattataaggatatattaatcttaaattccttcattctcagaacatgttctttctctgggaccttgctctaaaactgaaatggtgcattcattatctattgctgtgtaacaaatttccccaaaactaagcagcttaaaacaaaaacatctatgatcttacaccatttttgagggttaggaatctgagtgtgacttagctgggtggttctggcttaggctttttcatgaggctacaatcaagctgttgggcagagccgcagaccctgagtacttgactggggctgacagatccacttccaagctcactcacatggctgatggcaggtgactccgattgcttaccatgtgggcgtctccctaggcattcccaaagcaaagggggagtgaggagactaaggcagacaccgtagtcttctattntcaatttgcacaagcctgtgacattgtgggagaggaccaccaaggatttgt

SEQ ID NO: 239621 - DNA, 147 bp, Homo sapiens
aaaaaaatttttttttaaatatctgcctaacattcaatgatggatatgatttaggtcaagacataaagaagaacgaatcttttaattcatcctttattacatttacggcatgtgaacctgactttagagttttaggcacctttaaca

SEQ ID NO: 239622 - DNA, 387 bp, Homo sapiens
ccattttggccaggctggtcttgaacccctggactcaagtgatctgcttcggcttgccaaagtgctgggattacaggcatgagtcaacgtgcctggccaaagctcatttctttttaaactactcatttatctttcaatgtagacatgaaatctgcactataattttcattttcaggtcaaaatgtaatcatcttaatccctcatattcaaacaattattccatcagcatcagttttatgaattgagagatgttttcccaagtaaaaatgttctggatttctgtaggaatccgtgtggaaatgaaaccatttgccctgtgccacgcagcacaggactgtcccttctcatgttgatgagatgcagagcagccccgttctggaagattcc

SEQ ID NO: 239623 - DNA, 327 bp, Homo sapiens
tcaagaaacacttctttatttatttttattattttttgtttacctctagctgcaaatctcatgatttatttatttttagaaattagtttgttattactggttaatacatgtccaagatcaaaccttcatatagaaccatagggctgtaacggtgaataaggtaagtttcttggcatacctgttcctcagtccccccatcctggagcagcctgctcataggccccttgtgggcctttccaggtggggtcttcccaggcttgcaggagaaccatatgcttttgtcccttctctcaaatgttggcagactgtaaatgtctttgccccctg

SEQ ID NO: 239624 - DNA, 588 bp, Homo sapiens
gatcacgtctctgtgtcctgtgtctcactctatctagtcacctgttgagtgctggctgaatgtaaagcatgatggaaaatatcaggaggtactaagaagccccaaaaggagtttctctgtggtgtcaactagactgagatgttcctcagatgctctgaagctggcagagctcattaggcacaacagtgggaggtagcagactgggtagtgatagaatcagtgaggagaatgtcccatcatccatgctaaaacttggggatgtttctgaagtcaactactgcatttatgcaaataaccaagtacttttctttcaataactgacagttcaatatgtcctagagagttggcctgaaaaaaagaatattggggttctggggctaagaggaacccagagctcagttagctgctggagacagtcacagttttggagaattaggggtaggttattagttacatctgtttattggactagaaaatgttaaacctgggagggctgtcagagctcagtcagtctgacctcctcacatacaggtgaggagtcttcagcccaggaaggtaaggcaacatgcatgtagttacacagcaaat

SEQ ID NO: 239625 - DNA, 512 bp, Homo sapiens
ctcatcttgttctttgccttctcttctttaagactagggaattggttattggataatgctcccaagtctggccaataataactcaagagtaccctgaatcaacatctatggcttttccctaaaccctgatcttagggccatccatttgtattttgaaatgatcaagctatcctttactccagctgaaaacttacttacctgatacttcatcaggtctgctcacaggtgtatcaaagagagacggtacctttggtgaaaccattgtttagctggttttcacttcatccagttaccagccaatcaaaagtttttccaccgatcatattttcataccattgattgtattaacctagtttaaatcaaatctaaaatatgtgtgcttattacaattattgaatggttgcatgtgagggttgttgggttttgtaaaacaggaagcttatttttaaaatttttaaagtggtgaaaagtaggcttctctaaaaattagttttaacagtgtgtttgcaaaa

SEQ ID NO: 239626 - DNA, 235 bp, Homo sapiens
actgagaataatttccttgttggtcaatctgcaatcagacatctgtgtatttttagtatttcaaaataaaaagcaaaaagtaataacaataaaatccatgttatatatataacatgcatgtagtgtagtagatactatatgtaataactatgtatgtgaagtatataatacatttttcttagtattaacaaaattttaattgacaaataaaaattgtatatatttgtggtgcaca

SEQ ID NO: 239627 - DNA, 314 bp, Homo sapiens
agggtgtgtggcatggggaactggcccctaggcccttctcagaattcccagtacagttacgtgaatgttccttctgctcaggtttcctggggatgcctaggctggggcctcaggggctgagtctgggcaagaacccagcccctcctccccccgggagaagcttccagctgtttagattcatccctcaattaaaaaacattgcccccctgtgccaggtttcacccagagccacgtacaagctagcccagtgggtctcagcctttcggatttctcacatcactaacatttcaaaaaaataaaaaaatttaggatct

SEQ ID NO: 239628 - DNA, 1082 bp, Homo sapiens
atagctatcaacagaagactggttaaataacttagagcacatcaatgctatgtaaccacttaaaacactatgctaaatctatatgtgttgctatgaaaagagttctatggtttatcaacaagtgaaaaagtaggatgcaaaacaaaatgtgaactccgatcctatctgtataaattttttaaaaggatacaaatatatatatctagaaggatacacaagtatgttaacagtggtcacatctggggaacaggctgggaagaagaggggtgggactttttctttcatacccttctaaaccatttaaattatttaccatgtgattagttagatggcatgtaattacttttatgaatgaatgaattgttgctctactgtttggcttttttttttcctttttgttgtttctaacaccaacatagactaagatgaagtacagttaacttgggttggccaagacggctaactgaatcaatcctctcatatccctgtttttcattcaaagactatgtccttatctcaaatatttggcagcttgcacataaatatgcctccttcccacccccaaaaaactaactaacacaccctataagtaacatcaacctttccctcaaattttatttgttaaaccttcaaagggtacatgagagaggcaagtcttacctggggtcagccaattaaatctgctttttatctacggtttatcactaactgaacatacagctcaaagtacaaagttaattactacttttgcaaggagaaactgaaaatgctgatgggtgagcagcaggacaattcttgtatttctaatgtcttactctcattgatcatatcagccctcacagaagactatcttgcctaaagttaccattcctcattccagcatccctttatcattttatcctgtcctttctacagcaaaaagaggtattaaaaaaactatctttacctgcagtctcttaattctagcaaattaatatccatttctatatatatgaagattctgctgttttctccttttagctaaccccttccaaatttatatttatagtttctctctacttttataaattatactaggctac

SEQ ID NO: 239629 - DNA, 601 bp, Homo sapiens
  misc_feature (408)..(408): n is a, c, g, or t
  misc_feature (413)..(413): n is a, c, g, or t
aataatagagtgacaccattgttctgttctttgtacatttaaataagtcatggccagaaatctgctgtggcctcattaccttactgtttatatgtgtgatacaaagccgacggtagggagtagagttatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgcatgtttagattagcagttctcagagggtttccttgaccgttagcattagtgtcacctgggaaatgcagattctcagacactcctctcntgtgntcctcccctctccctttctctatctctcactctttatagcttccctcacgccgcacactctgtttctcaccacctcccctcttcacctctcacctgcgcctcctctctactacttctctgtcttctccctcctctcttttctctcttcacactccttatcctgtctcctatccttttcgcaccttccc

SEQ ID NO: 239630 - DNA, 1713 bp, Homo sapiens
gtacagacggggtttctccgtgttggtcgggctgatctcaagctcctgacctcgggtgatccacccgcctccgcctccctgggtgctaggattgcaggcgtgagccaccgcgcctccggcccaatttagtaaccagaaaggaatagatcggcctggcgtggtagctcatgcttgtgatcccagcactgtggacggccgagcgcggcgatcgattgagcctaggacttccagaccggcctgggcaacgtggtgaaacactgtcttttttttttttttttttttttgagtggagtttcgctcgttttgcaggctggagtgcagtggcgtggtctcgactcaccgcggcctccacctcccgggtttaggtggttctcctgcctcagcctcctgagtgtctgggattgcaggcatgagccaccatgccagctaattttggttttatttttttggtacagacggggtttctccgtgttggtcaggctgatctcgagctcctgacctcgagtgatacgcccgcctccgcctccctgggtgctgggattgcaggcgtgagccaccgcgcccccggtccaatttagtaaccagaaaggaatagatctgcctggcgtggtgcctcccccttgtgatcccaggactttggaaggccgagtgtggcagatcgcttgagcctaggagttccagaccgcctgggcaacatggtgaaacccggtctctgttttgagacggagtttcacccttgttgtccaggctggagtgcaatggtgtgatctttgcccaccgcaacctcggcctcccggatttaggtgattctcctgcctgggcctccctagtagctgaggcaagaaaatcgcttgaacccaagaggcagaggtcgcagtgagccgagatcatgccattgcactccagcctgggactgtcccctgacaggcagtgcgacgaggtcaggcccgcgcccgccgagtcctagggccgctgccgccgacggccatggaggacgagcagctcgacagcctggagggctgggcgccggtccggcaaggcctcttcgccgatcccgagaggcaccggctgcgcttcctggtggcgtggaatggcgcggagggcaagttagctgtgacttgtcacgacctcaccgcgcagcagccgcagcggcgcgagggggcccggctggggctggagcccaaacccaaggccgctgtggtgcattggccgggaaacgaacccgggcctcccgcgtggcccccccccctggcatggctttggaatgtacagaatcctcagtgattattggttatctgattattattactataatagaagcctggcttgctgctgcccgtcattgacttactaaatacctgtgaaaggaaagtcagcaaaaaaaaaaaaaaaatcagattccacaaaatgagttggaatatattatgtagaattgaaaggttcactgaagtataagtttagcaataagcacaacaggggtagtccccacaaaattagaagcttcctgaggtgggagcatctagttgcttgctactgatgtccaatgctaagactgagctgagtattcgtggagtgggatgggttgaaatggcccagaatagttgcagcgattgcactgtaattaaaaatgtctaattggagctataggaaggcaagcagagactggcttcttcagcacactcatacaactgggctagctccaacattaaaact

SEQ ID NO: 239631 - DNA, 187 bp, Homo sapiens
ccttatctcctgttcttagaccttggcctctcttcctcagtgtactgaatcagcttttgctataattttggtgactcatattggccctgatcattattggaatcccgtaagtttcatattctgctccaagaaacatttggataaattgagaaaaactaatagcctttcatggtaataacagtctact

SEQ ID NO: 239632 - DNA, 336 bp, Homo sapiens
gacgtccctaaccgccaagggctcatcaagatcctgccttgattcattggatctgtgcaagattagcaaatgtctaccctaattttagacccactcctaaaaactcactcttgggagctatgtttggaatggggaccctcttcctctggtattatgttttcaaaaaacttatccaagaaggaaaattggatcaaacgtttaacatctcatattaaatctggcaatgacaactgcatgtattcttgcttaaataaacggtctatcaattttttgttgttgttgttgttgttttttaaggattgtgggccgggtacagtgactcacgcctgtaatccc

SEQ ID NO: 239633 - DNA, 261 bp, Homo sapiens
gtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagcca

SEQ ID NO: 239634 - DNA, 712 bp, Homo sapiens
ccgacatctcgtattctgtgagcatctctagagggtacacttgcactggtggaacctgcaggctaaaggacaggcccactatatgtttactgtgtatgccaaacttccctcccatctactacctcccactcttgcaagcattggatatactattaatttttagaaatataagaagtgaaaaggtcttcactttaacctgaatggctttaccataggatcaagactaccttttcatgttcattagtcatatgtaaatactcattcaatgcttgtcaggggagaagatcttctctccctgacaaagaaaaaccaaatatgtaggggttatctgccttgcctaagaaatggtgctgtgtggaatttccttgtttaagaagagatacgtgttagaagaattggcttctgattctctttgctgtgtcttgctgtgtaattcaagttggctgcacagcaatttaatgaattagaacaagaaccaaaagattattgaaagtggctgatggccataatctagataattcctactgtgtccccatccatctgccactttaaaatgaaaatagcaaggcaaaagaaagataattggaaggcattatggtgtcttgcaccctcattcagccattctacaaatatctattaggtaccttccatctgtcaggcactgggaatatgggaaagaataaaagtcaaattcctgtccccatggagttgt

SEQ ID NO: 239635 - DNA, 1937 bp, Homo sapiens
aaaaaataagaggaggaagaagaaacagaaaaagaaagaggagaaaggaaaaatatgtaacagagactatatgtgatctgtgaagctttaagtatttactgtctggctcttcacagaaacagtttacagaccccaccaaagtctaaagacccctcaggcacggcctcagtcctcttctgactcacacgctccctcctaaaacaagaaaagctctccaagtctttaccaaggctttgtcgatttaaatatgtgtgtgtgtttgtgtgtgattttttaaaaattgaattataaatagatttgaatcaccagttctcatggttgtggcatttgagatttaccagtggaagaacagtggaatattggtgcgcacataagtcagcgtggccagctacaggcgaaaaatcagtcagcagaattgtaaatggtatttctgttaaccctttgacttggttggaggtactatcacgcaagtatctgctgaacttgtttctctttgcgaagaacgaaatgtgagcaaaaatagatcaaacatgcctgtgaaatacaaatatactttcatctactgaaagcctaaccaaaatttttttaaaaggttctacttaaacaattaactttagaattagatagttatttaaaaaaaataataataatgacttaaccaattgtcctcccttcctgtggatattagctaagatttggtctttatccacaggagatgtatgagggtcatcattccttcaggttatgttttaaaacgctttcaatctccatgctccaaaacatccacttaccgtttcccggtgaattttccaaaacttagctctgatcctacctaccaattcccttgctttgaaattcttagacctatatgacctgccaaattgatctaatcaacattaaggaagaaatgaaaacaaattaccaaacatccctttttgtgttaattaattaatataaaagtcatggggaaatgaccagttgtacagctgtatattattcaacatactgcgctatataattctctgtgtcacaggacagttttcatacttgccttgagtccattggtaaattcagcacactaacaaactgattattcctccaacggtgaaatatttcccctttgctaccaagaagtgatttgacagaacattcaggtgattcatcagaaataaggcttatgaggtcagtttatgtctttaattctcaacctattccaaaatataactgggatcaacatttaatgttcattttcagtggtgcctgtggcttacataggcaggtaactaattttgtcttccccatgatgactctgaccccgagagcacacagaattgtcctgtgtccataggattcatctccagctcataatgcaaaccagttctaaggataaacagtaaagtcaaacatgtcatacttgttaatttcttctctttctttgcaaaaaagttcatatgtaaaaataaataacccaaattctgtaatattatagacatccagacgttaccattaagtgagtggcttgatttataaaaaatgagaacataaaatggataagtagaattttagcgagaaggtaatctcgaagcatatgagctcatcctgcatagtgtggacttgaggactcgctcctgggatccttactgctgtcaaccttggatgttcagggaaggaaacttgtgtgcaaacagtatcctagctaggtcagaggaggttataggaaagtaatattgatataccctcactcagcaggaaacaaacaattagttctgtactttttggaggtttaatcatctgagacttactaagggggcccaccattgacgggagagcaggagaacttgtatgtgatccagggatgcattgaatggttaattaggttacaaaacttattcccaaatggaatgtgttgaattaactctgaatatccctaaaactac

SEQ ID NO: 239636 - DNA, 370 bp, Homo sapiens
tgctgggattacaggtgtgagccaccgcacctggctacttaaatgtgatttatactatgaatatgctttcaaatccattttctgcatataaacttcaaacaaacctacttctaattttttgtgattttcatacctgtagtttacaaatgatgtttaagatagactggctggctgttaaggcagggcctggaggagtggggtgatactaaaatttacaaattcaggaatgtcattttatctgttcaattaacccttatttgattctgcaagattcctaaacacagaaaagaatggctgtaacctgaaatttgggcttatcaagttaaggcttggaagtagaatggccaagtgaataaaaataccaaatcca

SEQ ID NO: 239637 - DNA, 327 bp, Homo sapiens
atatatattagaatggatttcacactgggttttactcccattatgtgatgcataaaaaagtaaacaacaataaaacagttaaattaatgagcttggttggttttcaaaacatgttaggcccaatatgttagagaattaatatagggattttaaaaatgtgttaaactcaacatgttcttactaataacaggggatttctgatatcaaggaccagttaatgtggttaatattttgtattagaaggaaagggaagagatgtgctgggcaaaagaggaaaatatagattttttaaaaataaatagaaatctgagctaatattaataaggg

SEQ ID NO: 239638 - DNA, 355 bp, Homo sapiens
attgatgctctttagcctagattctcaaattgtatgttggtaaggactgtttttcccacatgttgagaatggatacttttgaaaaacataataacattgttgcagtttctcaagaactaccctccatatctgtacttttcttgggctggcaagaaatagttcatggtcagtctttaaagaatattactacagtgctttgataaagaaaattaaattatggtgaggtaaatgacatttaaaataagtgcttttttcctttgaaaagaccaccgtttagttcatcatgtgagtatgagcctaggcacggggatgtgacagtgaacaaatcacaggccttgctcctcagcagttcatt

SEQ ID NO: 239639 - DNA, 527 bp, Homo sapiens
aaagaggctatgattaaaagcaaaaaaaaaaggaaaagaaacaaaatccacatttaatgattccacatggtacattttatcttttccaataccgtcctccaaaatgcagtgggatagagatttttgttgttgttgggtttttttttttcctcctctgaaaatggcttgtttctcattagaaagagtcatttgagaatgatactatcaaaatctgtcagggtaggtcctgcagaatattccagatgttcccctacaatctcttgcaaacaaatgattaaatgtagtactggtagatttttagacaaaaagaaattttaaatagctctcataaaattacattgtttgtaatgataagatgtattttaaaagttccattcttctagaaaccttgaactttccatcgttatttttcagttaatcttccagaatatcctttctgtccctgctctgtgaagttgaacgcttggttcaacttaggcttggtagctaatgtattgccacctgaattgtgcctatttaatactaga

SEQ ID NO: 239640 - DNA, 264 bp, Homo sapiens
cagttttatcttcctttcaaacccttaaaccttttatttcttataaatattattgcactggctaggacctccagtacaatattgaatagaagtggtaaagtagatatctttgccttgttcctgctcttagaagataagtctttaatattttaccattaagtttgatgctgactataggttttttgtgtatgccttttgtcaaatagaagaagttacattctatttctaattatctgagacttattaaaatgaatgggtacttca

SEQ ID NO: 239641 - DNA, 2033 bp, Homo sapiens
agcatcgagtcggccttgttgtataaaattgagttgttggcatgtggttgtggtgagcagaagcagttattatacattacttggtaaaattcatattcatatcttgtcataaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatggaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggagctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaa

SEQ ID NO: 239642 - DNA, 1978 bp, Homo sapiens
agcatcgagtcggccttgttgtataaaattgagttgttggcatgtggttgtggtgagcagaagcagttattatacattacttggtaaaattcatattcatatcttgtcataaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatggaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaa

SEQ ID NO: 239643 - DNA, 466 bp, Homo sapiens
catcgtcatagctgactcttgaggatccacggacggcctgctatgccccagcaatcagagcctccaggcccaggaggatgaaaagaacatggagacgagaggctccaaatggagtagccctctgccagctcacatccctctttcaggggctgcagcttggacatcccaagactggccaggttacagcccacaggaggcgaggagtgctcccctttacctcaggaagtccgatgtccgccccagctgtcttctgccccagggaaagcagtgaaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtaccc

SEQ ID NO: 239644 - DNA, 431 bp, Homo sapiens
catcgtcatagctgactcttgaggatccacggacggcctgctatgccccagcaatcagagcctccaggcccaggaggatgaaaagaacatggagacgagaggctccaaatggagtagccctctgccagctcacatccctctttcaggggctgcagcttggacatcccaagactggccaggttacaggcaaggaggatatatttgcttttgttcattgtgttcctggtggaaacctgggacttgctcaggagaatggggaggataggccaatgagtcagaggcttgggtttgagaacaggtgtggggaagggaaagggaactagtctgatatgcatcattttgcactccaggactatggagtgttagcctctgaaggaggaaatggtattttccatctgtgtagtctccaaggaaaatgtaatgagttaacc

SEQ ID NO: 239645 - DNA, 429 bp, Homo sapiens
aagtgttgggggagggttttagagctgctttttgattaggaaattttaagacaatttttcttggtccaagaattttgcagatagcctacaatattcagatgccaacttattgcacggttttacttccattccttttgtcactagggagacaatttattactcaaactaattatgatggctggtaccaaaggttacttttatgcagattatgttacatgaccgtttagtccataattttatactccaacattccacctccacatttgcaaaattcaggcaaaggagaaggaacaagaaaataaaatttaagttacctgaaatttatttatggttccattcgaccctgcacaggtacttaccaacctatttgcttcattagaagaacactgacacttgccatgcccaggcccttctgattggtataatgtc

SEQ ID NO: 239646 - DNA, 422 bp, Homo sapiens
ggttcaactttctgctcacttctgttttacgtgacctgttacgcagtgaatacttcaaatgaagtgaattattattaattttttaattattttattttattttattattattatactttaagttttagggtacatgtgcacaatgtgcaggttagttacatatgtatacatgtgccatgctggtgtgctgcacccattaactcgtcatttagaagtgaattattaatgagaatgtttggctgaaagatagcttggaagataatctactctaactccttcatttatgaatgaaaattgtttctgtgactatacagcaaattagtggtttaagttggaatcgtctgattcccaacccagttctctttcctttatagcacactgttaactgtatcaataaaactgagtcatgaagacattatggt

SEQ ID NO: 239647 - DNA, 552 bp, Homo sapiens
ctgaactggttagttgcagttaaaggcatgctttgcacctgttaccaggcaggctcctatttcaacagggatgtggaccctgctccccattttaatatcttaacctaacttactaactgttcagtctacttagagatgtttgccacacctagttgaaactgaagccagaaatgcctcatcaccattataaattgaggggagtaggaagtggagggtgcatgtgggccttcaatatgctgtagttgcttagtcagcacagaaaattgcaagggtagtggggtctcagccgcatgttgaaccattccatccctgtactgaggtttctattggaaactgtaattgtagtttaatggctcacttctggcctttcacaaggcatctatcctcatgaataaactgtgtttgtgtgtagggggattgagggccaggttatagtagcagttgaaatgtttagtagggccaactttatggttctatttatgaatgcttccagaccaaccaccccaaaacttttgacctgaggaataaattagttttgaattaaaaaaaaaa

SEQ ID NO: 239648 - DNA, 370 bp, Homo sapiens
tgtgtgtgagcattacgagaaccattaaactggaaataaaattatctagcaatggaaaattgggaaaagaaatcatgaagtatttacattataggatattatacagctattaaaatagatgaggtgtcacccctgaggtatgaactcagaaggatataaaattttataaactccgatttttctttaaagacacacacacacactctgacacatacacataaaaatatattagcatgtcaagagatctcactgtgcatgttatcatacacatcagtctttttgtcttttttaagacatggtttcactctgtcatcccaactggagtgtagcggggtgtgatcacagctcactgcagcctcaacatcccagg

SEQ ID NO: 239649 - DNA, 512 bp, Homo sapiens
cccaaagaaacttgcttttcttgttaacaaaaccatcttcatacccttaacagctgcctgaattgctgggacaaactgttttttgcccaaacaaaataattccccaaattggtaacttgaatgttacgtctggatggctggctggctgttaaaagatcatccataccctctcttctcttccttccccaaacttggtacttctgctggggtctccccaccaacctcagatctgtttaatgggtcagggaacccaattatttctcataacaataagcaacacttgctgtttgctttgtgttagacactgttctaagtgcattacatgcattaacaaacttaactttgacatcaaccaacactgtgaggtcggtagcattccttgttatcttcaagatacagacaggaaaactgaggcatcagaaggtagaattacttgctccaggtcacatgaacagggatggcagagttagagttccaatccagattggctggccccagagcctgtgccctta

SEQ ID NO: 239650 - DNA, 443 bp, Homo sapiens
ctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccaggtgacagagggagacgccctctcacaaaaaa

SEQ ID NO: 239651 - DNA, 351 bp, Homo sapiens
aaatgcatgcacccatagtgaggggtggggcagatttctttccatccctcctctaaaccctgatatctctccagttccctcttttccaagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcacggttatgtggctgagaagctttcaagaacagaaaaggccactaagtatttttaaggagtttgccctgttgcactgtaaattctctccatcttttcaaacttttaataaagtctgtcaaaaacc

SEQ ID NO: 239652 - DNA, 410 bp, Homo sapiens
ttcatttttatcttcctcacttttgcacttaatcaaaaaacactattttatgtgactgctttttctctgagccaaaaaaattaaaatacactcatttctattgtgaatatcaacagtttctttactaactccatcattctctgattggaagttactaagttagagtaagtggaatgatgatttggtattttgtaggcatagtcttaatatattttagtaatattataaactaataagagcaagatacatttctattttgttatgaaatcatttgattatgtagtttcacttaaaatgttttgtgaaatgtttatattttgaacaaaggaatgtatttccatagcaaaaatagctaaaaatggcacagacatgtattatataaaatatattgcagatataacttagatcta

SEQ ID NO: 239653 - DNA, 509 bp, Homo sapiens
cagttcacatttaccattgtcatcactgtgatcatcatcattactgtgaatcgttctcatcaaacagcattcatttggttctctgcttacaaaagatgccgtattatctttctatgtttctcttaaacatgtggaaaataatgcttttggagaaattgggatattgggaggataaacgagcttctgaaggtgttttccattgtgtgccatagatgagctctgaaaagtcaagtatacattgaagttttgtaaatcgaatcaattttaaatgcactagagaactcaaaatttaaaagaaccttgtagtgagtctgtgttgcaaggactccatttgaaacacaggtattcagtcccagattcaatagtttcataaatttgtatttttctaagataggctgttcttaaattgattatgtgttttacactttttcagggaaaagtcattatgaatccaaaatcgtctttgttaatgtgaatgtaataaaatctagttattttcattgccacat

SEQ ID NO: 239654 - DNA, 357 bp, Homo sapiens
taaggaaatcacttaaaaatatattatgaggccagttgtggtagctcctctagccctttgagaggctaaggcaagatggtgaattgaggccaggagtttgagaaaaacctgggcaatagcaagtccccattttctacaaaaataaataaatgaataaaatttgcttggtgaggtggtgtacacctgtagtccaagctactcaggaggctgaagcaagaggatggcttgagctcaggaatttgaggctgcagtgagcaatgattgtgccattgctctccagcttggtcaacccggtttaaaagaaatatatatgtatattaatatagtaaatatagtgaaaaaatatatacatcgtga

SEQ ID NO: 239655 - DNA, 424 bp, Homo sapiens
tcagatgggcttgcttcacacaggatgctcccctcatttgggaataacttctccagggtttggcttggcccttttcctagggaggtgaacatgaggcagggtagtgggacagtgtatggcctgcatgactgcagctggctttgaagccacaactgatgctcatggtcttcttcatctactatccattctagagtaccctcagtctcagccaccatgtctgccgttctcagtgacctggctggtcgagtaacagacctttatccctgaggattgtttctgagcccatggtccccgtgcccttctcagactgtggaaattgcatgtgtccatttaccataaaaattgggcagggaattattaggagacattcaaatggatcacctgggtgccaaatatatccttctctgttcacagtgtgtaagaa

SEQ ID NO: 239656 - DNA, 354 bp, Homo sapiens
aaacaaagaaagtaatatggacattacttttgaagactagcccgtgagctctctttccgtaagatatcatcaacctgcctccctccatcagcttcactacagccattatcatgtctttctgtggtttcttcagtaaacttgtaactggtttccccatttctgttcttggtctcccctacaatccattctcaaaccagcagcctgcatttttaaaaaattatgctggccaagtgtggtggctcacacctgtaatcctcggaggctgaggcaggagaatcgcctgagccccagagtttgagaccgagacgagcataagcaacatagggagatcctgtctccataaaaaaaatcaaa

SEQ ID NO: 239657 - DNA, 546 bp, Homo sapiens
gaaattaccatttgctccgatgcctatagctcagtattaagcagacagcaggtagatgaacatgtacgaggggtctgtgctcacaggctttgtaacatcatcattctttctgggctgtctctcttttccagatgcctatgatttggtatttctcctggccagagagtagcactggaaacattgaacacaaagtattctaacccttattgctcaatgtgtttttccagagcagcccaaaaggttatgctgggtttcatgagctgcagaggatgactgactggtgccacctagaaagacaaacagcagaaactgcagagcttggactgagctcagacaaaaatctctgctgcttgtacccagcttgaatattatggccaacacttgaagaatagaaagcatcacttaaaacattttaattatccccacatgtaacatgggccctaaatgttctgaactgaaaacctcactatgtagttgaaggtcaatgacacaagtttcagatattaaaggtttatcactgtttcctgtcttcctattaaaaaaaat

SEQ ID NO: 239658 - DNA, 682 bp, Homo sapiens
tgctccgatgctgcggccgccaccagactggtgagcttcttgcctcatctcgcaccatttgaggctgtccaggagtaaggatctgaactacccccataaagtaggcagtctccatcctgccaccttggtccttctcaggctccagttctgtggcttctgatctgtgatgtgaggcttcccaagattggagccagcactgtgcacagaagagagcaggattagagaatgggatgcttctgatcctaggtcccttcagtaaggcttccacgactggcaagtctcctctggctgggccagacccccaggggagccaggcaccccgctgtgtgtgagacagaaaggagtgtcttctggcgagtggcacattctgctctgtcaacagcaaccagtgcaatttatgacaggcttcactggagcgtgttccaggatggagtatatttctacttggcctgcttgaggagtttaagcatagtggagacctgggcacaggaaacttacaagtgtggtggaacacaggggatccccatattcccacctttccttcatctccagaatgttatctgtcagctttgcttgtccaggctagttaggagcccctgagtcaatttccggcccaggaatgccatactttatagaatctgtgggacaaggggccctggaaatttctgaagtctgttttgga

SEQ ID NO: 239659 - DNA, 665 bp, Homo sapiens
gattaaaaaataaagggagaaaagttgtggtttgctacctttctagtggaggcatgccttgcatgtggtagatgataattagacatttgttgaactaaatgtgtgattatggctccccaaaacttcatcccagggaaatgatgataatgtgaataagaggctttcctccagtgggatacctagatgataagtagaagcctatatcctgtttttactcgattgagactttatccataccccttggaagttgtttaatttacctacacccgggctctttacctgcatgttgaaaacagtttggaatggacccaaagaaagttgttactaaggcctttcttttttctctcccagccagtcctctggaatgaggtgttcagttggcctagggttattcatttcttgtttccttcagcaaatatttttttgagggtctgttatgtgccaggcactctgctgggatttggaatacagagttgaacaaaagagcgataggacctatattccctgagcttttattgaccagtggactgtgacttttgatgtaattttatttttgagagagggtcttgctctgtcacccaggctggagtgcaatgcagtgagccgagaccacgccattgcactccagcagccagggtgacagtgagagtccgtctcaaaaagaa

SEQ ID NO: 239660 - DNA, 396 bp, Homo sapiens
cattcagttctaagtatgaattttttggcgagtatttattcctcttgattttctaaattcctcagttaacattgttatgccttctgtaaagttaaggcctgtgtgtgtgtatatctctgtatgtaatagagagatagcatggattaggggaaaaaaaagttgtatttgcatttgttgtttctgattcacagagctaggagtgcagtgttcatgtggagtccacagagctggaatatcagtaggcagttgctgtaagcacatgttcaattattaaaatagtcaacattttatgtctgatagccatagcgaggtcatgacattaatttatccaaagtattgtgggcaactgtctagaaaaataaatagcataaaggacacagatgccagagaactaaa

SEQ ID NO: 239661 - DNA, 336 bp, Homo sapiens
catcttcaatgggctagtctactggagtatacttcttccatcacttctagacagttgtggaataaatgcccatccttagatggaaagagggtggtagggttctaattattacacacctttaaaattatatgggagttatcaataagcattacctgtaactagagggtcctgcccggggattgccattctgcctccctttcttttatgagagtttgggtatggtgaggagtccagatggttaagggctgtccaaaggttagcttctctgtctccttcaggaggagggctgtagctgccactgaccagaggcaagatggcttgcctttagcaaccagg

SEQ ID NO: 239662 - DNA, 418 bp, Homo sapiens
atttaccaaaaaaatgctatactttcctctaaaccaatatttggacatataaatattttccaactgggttcagtttttgatatggccaaagataatgatatgttatttcaagactgtaagtcaaaataaaattgatttgaaatggtctgaattaatgagatgccttccatcctgtaagtttcaacattgtcatctcaagtgataagataatgatggaccgtttcttaccaaatattttattaattaactcacgaagcttggcctgttcagtcagtatagacactatgttccggtgccttggatgtgattagcaagatgtgattcctttaaataatgagctcaaaacacatattaaatttagaagtggtaagcttacaggaaaaagaaagatctgctgggagtgaataaaaggaaaaag

SEQ ID NO: 239663 - DNA, 416 bp, Homo sapiens
tgtaattatgactttgtactaagttatgcctccgtatgatgagctcttgtgtctctgaggtattgtcacatgggatttttagctttctggcctggctcagttttcctttggtggtagtaaatggggttattaacatacctagcataggattcctactctaggtgggattctactaataattcatattttgctcccagctgatggaatgtgtgttctcaaatatttcgtagacttctgatttattaaaatacttatttttgtagtagtagtcagctttatttaaaaaggaggtaaaattagccaaatatgatggctcatacctgtaattccagcactttgggagtttgaggcaggaggatcgcttgaggccaggagttcacaagcagcctgggcaacatagacctcatttctacaaa

SEQ ID NO: 239664 - DNA, 217 bp, Homo sapiens
cattaaaatgatgctaaattcattaaaacaatatatgtatagccaggaaaataaaacattagaagaaaatataataaaatattagtaatgtgtctctggggctaagttggtaattggtttcatcttcaaatatttttgtcctttccgaatactctataattataaattgacaaaaaagacatttttaatattacctctttgccttttcagaaccctt

SEQ ID NO: 239665 - DNA, 204 bp, Homo sapiens
aaaaaaaaaaaaaaaaaatattcccaggttgctccttgggatttttgcaggaggccaaaaatgggagcaggcctagcacagtgtctatctcattgcataaaagcttgaattgtttgtttgttctgtctttggtggggacagtgtgcccaagaaaaggaagaacatttcccaaactcagaaaaaagaaagcaaaggcatttggga

SEQ ID NO: 239666 - DNA, 425 bp, Homo sapiens
ttccctaggcttctccttccatcacattcaacaaagatgcgattgaagcattcactgtaatattggctttccctacacttgcacactctgctattctcctagatgactctcagactaccaatgcctccttcactattcttgctctagacagataatcttgtttctaattctctagaaaaatggaaacagagactttccacagattctcacaaccacatctatcccccaccagcatctgcaccacagattctgcctctgtgtacattagcttagataaacatccattttcttttgtcttttcaaggacattcttccagcaatttatctttctctctgctacatcatcaattttctctctatactgaatcattccttacttgggagatacaggcattcagttattttccccatctaaacaaaagtga

SEQ ID NO: 239667 - DNA, 600 bp, Homo sapiens
ctatgtatttggcatacactttgcccttaaagagcttataacaatataaaaataagacaaatactcaaaaaagtttaagataatactacatatgactaaaagaaagatggaatgtgttatgaaagatcagagaagaaagaacttatatccagctgagaaaatccttaaagagtgggcagaatttgctcagttgacgagaggaaataatatttcagccagagtgagagatataagaaaaggctttgcataggaaaggattaggaataacccagttcttgtttgtttacaggtggatggaaagccgatttccagtctttatgataacgccgatgttccacttgggaaagatactgtacaacaatgaaagtagccctttcttttgtctttcaaagaatgtatttttaacaaacagcctctgtgtgatccttttgaccacacaatttgtagagttaacgctgaaattttcattagcaacaatgaaagcacacacaggcacaatattaatatagattaatatcagcctattttggtcagaaaggctcatttaaatgtttaagagacagaagtcccaaattgtagtaatttcttccactagcagga

SEQ ID NO: 239668 - DNA, 540 bp, Homo sapiens
tcaaaaaaaaaaaaaaaaagaagaagaaaaagaaaggtgtttctttattgtcttatcgtctttcctggcatctcttacagctaggtgtacctatgtgactaatgtccaaccaatggaaagtaagtggaagcgttaggtgcgatttcataaagggagagtggtactcttttttgcttcttccacctcatgacagctcaaatgcagacataatggcaagactcaagccgccatattggagtgtggggtaaaagccactcactgaggacagcagaactggatagacgtctcctgagtccttgataattatggaggcaccacgctagccttggacagcctatctctggaatgtgtgtgaagtttgtgtttcataatgttgctgtaattttgggtgctctattactcaagagtgaatctaatcctcgctaaatcagaggtgtcacacgtcgtgccactactcattaatttggggcattagatttactttcaaattgttgttattctaaatagcataacatgaacctctttatgtaaaaaactcaa

SEQ ID NO: 239669 - DNA, 497 bp, Homo sapiens
tgtgaaagtcacctgtgaaaatcccgtaagagacctcacacttaatagtgaaaatctggatgctttcctcataaggtcagaaacaagtcaaaaatgtctgctcttggcttttctattcaacattgtatgtgaggtactagtcagagcagttgggaaagaaagagaattaaaaagcatctagattgtgaaaaacgatgcaaaactatctctacagcacatgttaatgtatatagaaaatcctaagtgatccactaaaaaacgatcagaactaataagtgagttcgtcaaggctgcaggacacatcagtgcacacaaatcagcaggatttctatacacttgcaatgaacaatccaaaaattaagaaatttcatttccaatagcatcaaaaaataattaggaataaatttaagaaaaatatgcaagacgtgtacactgaaaactacaaatgttgttaaaaatttttttaaatgtctaaataaatgaaaaaacagctcaaa

SEQ ID NO: 239670 - DNA, 405 bp, Homo sapiens
tgcagatactgaattgtctgaataaaaacagaaatatgaaattaactgaaattaaatagaagtaaagtggtaggaagaaaacaataaatagtaaaaaatcattgaaaggacttaataaaattgataaaagacttaaagaatttgagaaggctcaaataattttctagattaaataagggaaaaccattatggtttttacagatattaaacagataatgaaaccatattatgaatacttttatatctatatgagatagaaaattcttgaatatgcaaattaccaaattgcaatacaacaaacagaaatctgagtaacctctataaatataaactttgtaaatatggatgaaatgtctgtatgtgctaaagaaattgactttcctacataaactttcctacaaaaac

SEQ ID NO: 239671 - DNA, 439 bp, Homo sapiens
cgcccatgatcagctggttacaaaactcgaggaataagaagtttaatatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgcgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccg

SEQ ID NO: 239672 - DNA, 673 bp, Homo sapiens
ggtggggccccccacagacactgtccacctcctgtacctctggagttcaagactgagccttctcatgttctttatcctgcatatcagcacctgacaaatagaagggtagacaaacaagagtgatgcaggacaggcaagccctaaaattggggcttagcccaggagggttcatggcttcacccagaaagaattccagcaagcagcagtggtggtagccagcaagccgcagtgcacagagcagcagaggtactgctccttgtggagcagggctacccagaggcagtgtgcccagaagagcaacgcaggggcagggctgcactcatatggacatctacttttaattatatgcaaattaaggggtggattatgcagagatttccaggatgagggtagtaacttccaggtcatcaggtcgttgccacgaaaagggatggtaactcctaggttttgccatggcaatggtaaactgacatggcacactggcaggcatgtcatggaaagctgcttctgcccccctacctgttttagctagtccttaatttggttccatgtccgagccccgcctcctacctcaagaggactgaatcaaatgctctaaatcacttggttaattggcccaatgatagtaaataaattctatctccttatgcagaaggaagcccagatctttgac

SEQ ID NO: 239673 - DNA, 415 bp, Homo sapiens
caaaataaggttgggagaggcatacagctaacatatagctattaaaccatattacagaattagtcacaaaataacacagctctaaggagtgacatttgctttggtagtgaacgtggttccttaagtcactgagaaacaatatttattttattgcttttcacactcaggagtagcattttcatttattatgtggaaatttagctgagcttaaaagcctgatggccacaaagacttttataaggtggtacatctgtagagtgaagggggaaagaagatgcattgacagtaatttagttatttagtacagtcagctgaactaacacttaaatgagaattttgaggagtatattacttaagcctaaagataacattttaatggcttcctattgtgccaagtgcacttcttctgaaatct

SEQ ID NO: 239674 - DNA, 492 bp, Homo sapiens
ttaccacccagccgctgcgcaacgcgtgcttcccgcacagcaactgcgcagctccaatcagcctggaaccgctaaacggcttcggtctgagggctaatggaggttaaagagcaccgagtatccgacttacgtgcaccgaacttacagatctctcgccctgttctccctgctctaccctaccgaagccagttcccatcgcgaagtgcaccctcacctcttcccccaagcgacccccctcacacgcattcccttcaaattctcccggcatttgggccgctttgatgatcagatggtagagccctgattacaaatttattcccggccgctctgtccgtctttatctccgctattagggacatctgggagtgattagtgccgcacccgcgcccggccgcgctcgcctatcttgccgcggcggggccggagcctcgctgacgtcagggcagacggctcggagccatcccagccgagttgggtgtaatcggcggccgc

SEQ ID NO: 239675 - DNA, 326 bp, Homo sapiens
gagctggagtctcgctctatcacccaggctggagtgcagtggtgcaatcttggctcactgcaagctctacctcccaggttcacaccattctcctgcttcagcctcccgagtagctgggactacaggtgcctgccaccacacctggctaatttttttgtatttttagtagagacagtgtttcaccatgttagccaggatggtcttgatctcctgatctcatgatctgccttcctcggccccccaaagtgctgggattacaggcacgagctgctgcatccagctgagtgtgtttttaaatttccacatacttgtgtattttccttttt

SEQ ID NO: 239676 - DNA, 412 bp, Homo sapiens
acagacatagcagagctgacttttcagctcagcatcccacgagcctgagatcaaagtttgggctgggctgggctcctgtctggagcttggggtcttccttgaacctcacacagttgttggcagaattcagtttctgtggttgtagggcccaagccatctttctcccactggctgtcaaccaggggtcgcccccagctcctagaggctgcccaaagttccttgccatgtggatccctccacaggtcccagtctctctgaattcttctgtccttgacctctagatctaaatttaaagggctctgatgacgaggtcaggcccacacagttcatatctttgattaactcaaagtcaactgattagttaccttaatcacatctgcaaaatccctcttgccacgtagcctaccataac

SEQ ID NO: 239677 - DNA, 1830 bp, Homo sapiens
  misc_feature (1768)..(1768): n is a, c, g, or t
taaactatggccaaacagaaagctcagcaggccatgtcatggagatagaccatgtagacataggccaggctggtagcttcaccttacctggccttagtttcttcacccataaaataggtcatatcacgcctgctgtagtcacttctgaagggttcatctgtatggacactgatttaatgactgtaaagttgtaggtaaaatgtcagctcattagtacgactgacactttgtgtgtcccaagcatattcctggccctgggggaatgcaaggttgttatagcttaaagtaggacttcaatgagctgacattccaggtgcctgggagggctgctgcagtggggtctgaggagggctggggatgagtagagagggggcacttaagagagggaagtgggctggggagagtagaagggaaagctgaccttgaaagctgcagttaggtaggcattggcattccttccacagtattttttcaggcactgctctaaactctggggatgcaaaagtgagcaaagcagacatctctgccctcctagaatttacattctagggggaaaggagacggataataaaccagctaaaaaataaatctttgttcagatggtgataagggctagagagaaaaataaatcaggaaagatggatgggacctgaagctcaccaaatttgagtctccctgcctctcccaaatatatattgaatgaattcaaatttaagttcagggcctaggaaggggagcattcaggaacactttttttttttttttttgagatgaagtcttcttctgtcacctaggctggagtgtagtgacatgatctcggttcactgcaacctctgcctcccgggttcaagcgatcctcctgcctcagcctcccaagtagctggaattacaggcgtgaggcactgcatggcctctggggcagttttaaataaagtgagaaggcatcagtgcagtggagacttagaggtgagagggagccatggctccctgggggaagccccctgggggaagagtgttccaggcaggggaacagcaagcagaaaaggtcctggggcaggtgtgatcgggaacagcaaagaagccagcacgggccgggcacagtggagcgcacctgtaatcccagctactcaggaggccaaggcaggaggattgcttgagcctaggagtttgatatcagcctgggcaacatatcaagacctcatctctattaacaaattaaaagaaaaaagaggctaggcgtcgtggctcatgcctgtaatcccagcactttgggaggcctaggcaagtggatcacctgaggtcgggagttcgagatcagcctggccaacatggtgaaaccccatctctactaaaaatacaaaaattagctgggcatggtggtgggacgtctgtaatcccagctacttgggagactgaggcacgagaatggcttgaaccccagaggcggaggttgcagtgagccgagatcatgctactgcatgccagcctgggtgacaaagcgagactccgtctcaaaaaaaaaagaaaaaagaaagaaaaaagaagctagggctgggcgcggtggctcatgcctgtaatcccagcgctttgggaggccgaggtgggcagatcacaaggtcaggagttcaagaccagcctggccaacatggtgaaaccccatctctactaaaaatacaaaaattagctgggcgtggtggtgggaagcctgtaatcccagctacttgggaggctgaggcataagaatcgcctgaacccgggaggcagaggntgcagtgagctgagatcgcgccactgccctccagcctgggcgacagaatgagactccatctc

SEQ ID NO: 239678 - DNA, 415 bp, Homo sapiens
agtgggcttttggggtggggggtgggggtctgtggttttttgttttgtaagtgggaagaggtgtgattcctgtatttaggtaatgagtagcagttcttctctccctggtatatttatccttcttcctccttttgattatttacatcacatagcgttaattgctgaaatgaaaggatatgggtctgtgtaattgaaacatttgcttttatttgcagtaatcatttgctacttgtgatcccatttgagatatttaatgctaatctgtgctttgccttggctttctgctttgtgttgttctgtcttgcttttatgttttttgttgtcttgcaatccctcatttcttcgtttgttttgtgtttttttttctccctcatgcttgtcgttgtctgcacttggctttgattgcaaaaaaaaa

SEQ ID NO: 239679 - DNA, 327 bp, Homo sapiens
aaccctggaatctatcctccccaaccccaactcaccgggcccggggacccttgtgacttccttctatccctctatatcttctccctctgcaggcccagcctggggccggagccctgccttctcccacagagtccactgagcggccatctctggattcctggagtccttgatcttgtcgtcactgcttttagcattgaggtcctcaccttgggttttttctcaagcaccactgggaaactgtgttctagagagtaagaaatgtctaggacagccttgttatgagaagcatgtttctgtaggcaaaagtgacccttttcaaatggagca

SEQ ID NO: 239680 - DNA, 833 bp, Homo sapiens
aagtgcttatatgattacctataaactatcatagttaaatgactaaataccctgcataaggtaaaatgattattttattcctatagattgaaattgcccaactttttattagagaataatagattagagggcatgttggctcatacctgtaagcccaatgctttgggaggctgaagcgggaggatcccttgaggccaggagttgaagatcagcttgggcaacatagcaagaccacatctctacaaaaaaatttaaaataaaatgtttatccaagcatagtggcactcactcacctgtagtactagctgctgaggaagctgaggcctggagttcaaactgcacaacgctgcacttcaacctatgtgacaaagtgagatcctatctctaaaataattaattcagtttttataattagggaacatttaaattcagattataagtaaaaaatggaataaacagtcctgttacctgatatggtttggatctccatccctacccaaatcttatgttgaaatgtaatccccaatgctggaggtggggcctggtgggagatgattggatcatggtggtggtttctcatggtttaacaccatcgtcccctggtgctgtcgccgtgatgatgaattctcacgagatctggttggtttaaaagtgtgtggcacctcccccttctctcttgctcctgctcctaccatgtgagatgccttggtccccctttgccttccgccatgattcagagttctctgaggcctccccagaagcagatgctgccatgctttctgtacagcctgcagaaccgtaagccaattaaacctcttttcttatacattacc

SEQ ID NO: 239681 - DNA, 636 bp, Homo sapiens
atgaatgaaaaaaattacatctttagaaaaagagttattagaaaaaagccttggcagcgtcggggggaagtgacagcacagaagagaccagagaatagcttcctggaggagaccctgcactttaaccatgctgtctggatgggtacagtgccctcttctgcaaagagttcacttctatgctttttctgtggttccatttcatagaaagatttggggcgatgtttcttttcccttaactttttattttaaaaacttgcaaacacagaaaagttgataaaatcatacagtgaacatctgtattctattcaactggattcactagttcacattttgtcatatttgtgttctcttttccacatatggaagattgtatatttgccctttttccccctgaatcatttcaaagtaagttgccagtatcatagcatttcactgttaagtacttttgcagatatctcctaagaaccaggatattctcctatataatcacaataccattaatccacccaaaacatttaacatcagtacactaatgatacctactgtatagattataatcagcttccttgcagtaatctgtttagaagacttgcatcctgtcactgtccactgattaaattttgaactcttaacttg

SEQ ID NO: 239682 - DNA, 647 bp, Homo sapiens
acctactcaggaataactaaaactctttcttttatccagtatatagaaatgagattttgcatttccgaattaggacagcctagatacagatgacatatgtataaagggtagaatttggaattctgtaattgctagaccaagacgacattgtttccatgcatttcctttgcatagcactgaggagggttgtctatggtgctcaaccccctgcttgccaagaaagcattgctttattatagaatgatggcatattacaacccaaagtgaaagactgtcctcattggtgtgtgttgtataaattgtttgcctaaggcctttatctacacaaaaagcaaacaatttgcttggttagttttatatgcctctttgaagtggttaacttggaatgaataaactgctagcaagttaaatcagtacctccactagataaatacttgtttgataacggcaaaatcacatctctactcatcatcctttaacctgctgttaagtgtactaccatgggattagcggtggagttcatggatccatggggaccatgagctcccagtattccccgtacaggaacaatactgggactgcaaaatggccagtgggtgactgccagattacttcttttaaggaggtttttaaaaacacattatccc

SEQ ID NO: 239683 - DNA, 342 bp, Homo sapiens
ggcaagggggaagcttgccacttcagtttcaatcaaaagaaaagctttgtcttataattttcaaacttcattttgctattttttgtttctcttttgctcactggtagattttttggtaacccatacccactgttaaagtgagaagcagaaaaaagaaactgtggatctgatgatttttttaaaaaactgctttcttctccaatgagaatcttatttttgaaaaaaaaaatgactaacatctccccataggagatacattcaagaaaggagaaataagtttaagagatctattgtacaacatggtgactaaagttaataatagtgtcatgaattcctggggta

SEQ ID NO: 239684 - DNA, 431 bp, Homo sapiens
gagcagaaagactgtcttatttagttttactcaatgcttaccaagctgaatttctaaaagcctagagagatgaacaattcagtacaattccttgaataatatacaggagggaaagtaaaagtgtattcggggaatggcaagttgtagagtttagctgaagcattcatggagaagagcaatgggaaacaaatctggaaaaatagccaggaacaagttttggaaaagagcatgtatgatagtttaaagagtgggttttatctaatgggaaatagaaatagatagaaggcagggctttgaaaagactacgaggaggtaggaatggattagagaagagataagctagttatagagaagtatagtgaaattatatttcaaaggtccatggcttgaggttataagggcttaattttaatttgtggtactgttaaaaa

SEQ ID NO: 239685 - DNA, 1478 bp, Homo sapiens
taacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaatatagcatcatttgctaaatagaggagatagatcttgaactgttattttttatataattaaaactgctattaaatgtgttgtcagtatttaacatttagttactgtctcattaatatttaattttgaggatgtacttgcatactgttgaagttgagtgctgttttgctgttaatgctgctgctttgccaatgaagaatgaaataaatttatctgaatgtatcaataactttaaaatggaatgctgcacttttaaaatatggtagattattgacatttgcaagaagaatgtattgaggtctttggaaatgcccaaattctttgccacctataattaaaaattgtctgaattttctcctcagtataaaggagtgaatgccctacttagtgtaattgtatcaagtgaagtcaaacatcaacaaaagaacagtaaagtctcattgcaaagcagatactgggcctcaagggtgggcttaggcttaaactagattatctgctttcatatactaatgttttcatttcaaaatcatgtgtccccaaaatattgcaacttactgaatattttagatctcttgggttacttaaatatgtgtgaaaaaatcaacattgcatctgcaaatcccagtgtttactgtatatgcaattgatttatcctgtttgtgcttaatataagtgttcctgagatgttaacatttcaatattctctgattcctattaacatatagatatataaaattaaatgtttttggttaaaatatattaat

SEQ ID NO: 239686 - DNA, 387 bp, Homo sapiens
atcacctgtggacttgctggaattgcagaatctcagaccttactccagacctactgaagtcggtatcggcattttcacaagaccctcaggtgattcgaaatatacattatatttatttttaaatttctttctttctctctttctctctctctctctctctctctctttctgaaagagtctgggtgacagagtgaaactccatctcaaaacaacaacaacaaaaaccaaaaaacaacaaaaaaataagtaaaggaaataaattcctttacctacccagtcacccaagcaggtcccagagtgccctttccttttccctcctcctcccgcctaccttggcaagctgtgttccttccaaattctaaataaatcaccaaatgaatgaagaca

SEQ ID NO: 239687 - DNA, 451 bp, Homo sapiens
cctgtatatatgtatttatttttgggaaattttctctaaggaagattttttttctctcccttatttatttggtcatctgtttctatcattctggattcgtgaataattattaatttgttaattatacataatcccacatcttttttttggagctattgcttactttctggtacaaggtagtataggcttatcttgtattctccctgcaccagccttacttttagccattttaataaggagcccgggtactttttattgaaaaatacatttagaaaccatggtctgagcactgagtgcccttttagttactgaggtagcactgattctgtacctcctaaacagaaagctagaaaatatatgtatgcatagtaatgtttggatctatttaattatttttacatacacatgtatgtagctatgtgtccattaaagtaaacatgaatgtacagtg

SEQ ID NO: 239688 - DNA, 728 bp, Homo sapiens
gtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagccacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcatgttgtagttcaattgccaatgtaatagtgttgggagatggtacttttaagaggtaattaggttgctaagatggattaacatctttctcttgacactgagactgggttctcctgggaatggttagttcccaagagagtgagttgttataaaacaatgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagtta

SEQ ID NO: 239689 - DNA, 264 bp, Homo sapiens
ggggttgagatggtcagttttatattcattcctgaaaactgaagattacttttgccaaggactgttgataggaacttaactggaggctttaaaaattaaagaagaaaaacaaaacactgttaggaattttgttacagaataaatgttaatgttttttaaatgttaaaaatgagtcaaagtccaaactcttcctctctattttactttatgtaaatcaaatgaaagggaatggtttttattaaataaacttttttttaaattaga

SEQ ID NO: 239690 - DNA, 378 bp, Homo sapiens
aaggaaggtggtttctgggtaaaaatcatatgaaggagcatttagtttcattttcagtgtttttcttctgtagcttttcataaggaatggttaaataattgtaagttttactgtgtatagtgtattcacaccacagacacacacagatcatttgagttcatctacttaaaattcttttagaaaccaagtcacagcgaagttaatgtcacagtctaagttaacatagcttgtttgtacagagttgggactgagaaaatatcttgtttcaatgcattgccagaatcctgtagcattttgtaagcagattaatttcttcaaataaatattttaattggctctctgcttgcttgtttttttttaacagaaatatatctacct

SEQ ID NO: 239691 - DNA, 520 bp, Homo sapiens
gccgacagaagcggatgtgatgttaaatctgtgagtctctaaggagaatatattggctgctcttaggaaagcattggctttacttgtactcttgaattacagactttctacaaggttttcatttatttgaaattgccaatatatcaatttcaggtttttttttaataatgaaactgaaattataattttatagtaagggaaaatgctagctggtttctgttagaaaatgattttttggcgggacatggtggctcacatctgtaatctcagcactttgggaggccgaggcaggctgatcacaaggtcaggagatcgaaaccatcctggccaacatggtgaaaccccgtctctactaaaaaatacaaaaattagccaggcgtggtggtaggggcctgtaatcccagctacttgggaggctgaggcaggagaatcgcttgaacctgggagatggaggtggcagtgtgctgagattgcgccactgcactccagcctggtgacagagaaaggctccatctcaaaa

SEQ ID NO: 239692 - DNA, 460 bp, Homo sapiens
gccctgggaacacatatactctctgtgcaaggctgtgaagggtcatatgcctttgttcaatagctatggaaagtatgttgtgaaactttactggatggtaagtccattttcgtgtgcataaaaactcatgagtctttcatattgaaatatacttgtcctggcatggtggctcatgcctgtaatcgcagcactttgggaggcaaaggccaaggcagtggatcacctgagatcaggagttcgcaaccagcctgggcaacatggtgaaatgctgttgctactaaaaagacaaaaaattagctgggtacggtggtgggtgcctgtaatcccacctactccggaggctgatgtgggagaattgcttgaacccgggaggcagaggttgagtgagttaaggtctcaccattgcactccagcctgggcaacaagagcaaaactccaaaaaaaaaaaaagaaagaaaga

SEQ ID NO: 239693 - DNA, 441 bp, Homo sapiens
atgttgcccaggctggtctccaactcctgggctcaaacgatcctcctgctttggcttcccaaagtgctgggattataggcatgagcccctgtgcctggtccatctttattttaatgaatcggcttaagcatttatggggttggggggacaaggtcaaaatctgcagggcaggacggcaggctggagacctaggttacagtggatgttgcagctcaagcctagagtccttctgccagaggccctccaggccttcgactgattggacgaggcccacccatacgttggagggtgatctgctttactcaaagtctactgattttggcctggcagagtgactcacacctgtaatcccagcattttatggggctgaggcaaaaggattgctaaagcccaggagttcaagaccagcctgggcaacacagtaagactccatctctacta

SEQ ID NO: 239694 - DNA, 269 bp, Homo sapiens
cgagtttcagggggaaaaaaagaaaactgccttctccaccgctgcttcacagcaggaggcccgggtcacagtactggcattctggcactggtggctgcacttctgggctgaaattagacagcatgctttttaaattgcagctgcttctgactaagctgcatgagggtaagtcatcttgcctcaaagagaagagaaaattgccccctttgacccactggattctttaggcaaccagagactttgcagaggtatggggatgtttttccatg

SEQ ID NO: 239695 - DNA, 781 bp, Homo sapiens
aggtttggataagatcttgacatagattatctcatttaatcttctcagtaatcctatgagattaggtggtggtattcccatttttcagataaagaaaataaggctcagaaaaataaggtaacttggccaggcacagtggctcatgcctgtaatcccagcactttgggaggctgaagggtgtggatcacttgaggtcaggagttctagaccagcctggccaacatggtgaaacccgtctctacaaaaaatacaaaaattagccaggtatgttgtcacacacctgtaatcccagctactcgggaggctaaggcacgagaatcgcttgaatccgggaggcggaggttgtagtaagctgagattgtgccactgcactccagcatgggcgacagagcgagacttcatctcaaaaaaaaaaaaaaattaagttaacttgcctaaagagatacagccagtaagaggcaaagtcactgtttaaactcagacttcctacagatttctcagctctgtcccttactcgctgtctctgccaatattgccctggtttagacttcattgactttcacctaaactattacccaagcctccctctaccttctttctctgatccaacccccttaaatctgttcctatatccctgccagagtgatctgcctaaaaatcaaatctcactttttactttttatgattctgaatttctgaagctttgaaagttctgtgttaacttttgtaatgtaacaagtgtttttatagtcagagtacacatcgcaactggttcctcccc

SEQ ID NO: 239696 - DNA, 269 bp, Homo sapiens
agaggatcttcaaagcaggccgagagaattaaaaaaataatggaattagagaagccacgcggagagcaggacggcggcttcggcagctcaggatccacccccttaaatctgttcctatatccctgccagagtgatctgcctaaaaatcaaatctcactttttactttttatgattctgaatttctgaagctttgaaagttctgtgttaacttttgtaatgtaacaagtgtttttatagtcagagtacacatcgcaactggttcctcccc

SEQ ID NO: 239697 - DNA, 501 bp, Homo sapiens
ctattatcagacgttaataccccaccctcaataattgacagaacaagtaggcagaaaatcaataagaataataaagtagacttcagcaattttatcaatcaacttgacccgattgacatttacaggacattgcatcttacaatagcagaaaatttttcttgagaaaatggagaaacaactcaattttgtttcttgagaaataacttgagaaaaatttttagctgttcaaacaaaaatcatagtacgggatttataatatatgtaaaagtaaagtgggttaagagtttttcgcaagtacacatggaacatttatagagatggactacattatagaccatttaaaaagtctcaaattcaaaacatttgtcacataaagtatgttgtctggccacaacggaattaaattagaaatcaatagcagaaactagaaaagagaaaaactcaaagtaagcagaagaaaaggaataataaaggtcaaagtgggacttaatgaaattttta

SEQ ID NO: 239698 - DNA, 401 bp, Homo sapiens
cagagtgttgatgtactaggcatgtatcttaacattgtgccttacatcatgtaagtgtccagtcagttgcaatatttctcttcaaattcatagatgtctttcagtattcaagttcttaaaagtgttgtgggccaggcccacgcttgttatcccagcactttaggaggccaaggcgggcgaatcacgaggtcaagagatcgagaccatcctggccaacatggtgaaaccccgtttctactaaaaatacaaaaattagctgggtgtggtggtgcatgcctgtagtcccagctactcgggaggccgaggcaggagaatcgcttgaacccgggaggcagaggttgcagtgaaccgagattgcaccactgcactccagcctgggtgagaaagtgagactgcgtctc

SEQ ID NO: 239699 - DNA, 435 bp, Homo sapiens
ttctgttgagggaggcttattgtaaacacatgaaaatataatgtaattatatggtttggagttgtgtccccaccaaatctcatgttgaattgtaatccccagtgttggaggtggggcatggtgggaggtgattggatcatggggttggatttctcatgaatggtttagcaccatcccccctgtactgtccttgtgatagtgagttctcactatcatcattttaaacgatgagatcccatcgtttaaaagtgtgtggtacctccccaccctctattttgttcctgctgccatcatgtgagacacctcacttctcctttgccttccaccgtgattggaagattcctgagacctccgcagaagctgagtagatgccagcatcatgcttcctgtacaacctgttggaaccgtgagccaattaaacctcttttttaatat

SEQ ID NO: 239700 - DNA, 432 bp, Homo sapiens
gctgtttaaggaaatacaaatgagtggaagaaaaggaaagctttttctgggaattaaagagtaaatcaggttttgttttattttgctttgttttaagagttctatacaatataaatagaaaatgggtgagtccccatagtcacttgtttggctctaaatcttatccattctattattactcctgagaaagctttgtagttgtcatgttactcatgttttaatgactgagaagagttttttcattggtacttttaaaaaatttaaataaatacaaattgatttttgtgtttggtaaactatgttttctagggtggtgtttttaaatgtagtttaatttttaactctgttttaatttgtattctcaaccactagttagcagaaaataaaatatctgtaagtcagataataaaaaacttaaatgaactgtaaaaa

SEQ ID NO: 239701 - DNA, 229 bp, Homo sapiens
caaagctagtcaatggtgataaaaacagaaaagtttttatctctgggatagaaattgattggaaaggagcatgaggacactttcttgagtgatggaaattttttttataatcatttcagttactgttgcactggtgtatgcaattgtcaaaatgtaccaggatgtttttgtattaatacttgtgttttactctcaattataccttaataaaaagtgttactaaaaatta

SEQ ID NO: 239702 - DNA, 504 bp, Homo sapiens
ggaagaatggttaaaagaagtggcaaaatgaattactccacaaacaaggaaaaccatgaatacaagagtatttgttaaaagcaaacacaaaagccaaacacatgacaaacagtatctgtaatattaaattaaatggtgaataaatataaaataatcaagtaaaacaaaaaagtagacaatgttgataaaatacttgcagtgcattagaaacagagccaagccacggtatggtgaggaccgattttgcttttctgtttaataatgggcctgtgaaaattccagagaaagtcttgcattagcatgaagatgcaaagcagcccctccttcctgcagtccatatactcagccctcaagacaggcagaagggaaactcctaggcacccaagcccagggactgatgagaagtgggagacctctgggcaggagacaggaggagtggttcttcctctccaaggggtcctgggctctgggacccagcgagggatggaagccagtcagcccggc

SEQ ID NO: 239703 - DNA, 313 bp, Homo sapiens
ctgcaattttgcatttgggcctgagagaagaattaatttcctagataccgtttctctcctttagggaggaccaaaagccctgcatagtggtttcttgcagcaacaacaaaatgcctttttaaatgtgcaacggaggtgtatgtaattgctaatccacagccacaccgttatctctacctgtgaccaaataacaataaaataattgactttgtagcatatatgttaccgaaaatggggacattattaaaataaattcagctttctttcccccaatgaactctctttaaccattaaagagatttgttatgagtct

SEQ ID NO: 239704 - DNA, 369 bp, Homo sapiens
gttgcagtgagctgagattgtgccactgcactccagcctgagcaacagagcaagactccacctcaaaaaaaaaagaaccaataatgtttcaaataaaagtcataaaaacgttatcttcaagaccaggtgctgtggctcatgcctgtaatcccagcactttgggaggctgaggcgagctgatcacttgaggacaggaatttgagaccagcctggccaacatggtgaaaccctgtctctactaaaaatacaaaaattagccagcatggtggtgggcacctgtaatccctgctactccagaggctgaggttgcagtgagctgagattgtgccactgcactccagcctgagcaacagagcaagactccacctc

SEQ ID NO: 239705 - DNA, 432 bp, Homo sapiens
gcttgaagtatcctttcatggtagagagagagtggcagcagctggccagtgaattccatagtttgcaatttagatgtctttggtgatggcactgggtgttccggtgaactttctgagcagactgagtaggaggcacaaggactatccgtacatcatctgctgtgatttctctgaagtttatatcaagtcttccagcgtcagcttttggggctttggggaaatggcaggttttagttctttgtcatgccaactcagggggtaggagaaaactggaaatgttagcttggagcgtcgtagccagatattggaggaaaggagaggaactgagaacccgcaagcgtgcgccgtagttttccacgggagcatcatttctctgtaccgttgcttctctcttgattctcagttacaaaataagtctggtttcattagaaa

SEQ ID NO: 239706 - DNA, 528 bp, Homo sapiens
ttaaagacagtctcgctctgtctccaggctggagtgcactggtgcgatgttggctccctgcaacctctgcctcctgggttcaagtgattcttctgcttcagcctcctgagtagctgggactataggcatgtgccaccacgcccagctaatttttgtattttaatacaaaaataataatacaaaacaataataaaacatgtagcctaccacacacatagaacacccataggcacacatagaacacacacacaaatacataggcacatctacacatgcacatacacatggctaccacacgtgaacacctgcacacagacatgcatgccccacgtgtgtgtacacaggcacgcccagcctgcatgcaaatggacacatatgtacacatgtgaacacccccacaaatgtgaacacattcacctgcacacatacatgcacacatgtctgcattcatacatgaatatgcacatgcacactgacatccacatgtgtgcacacatgtacacccttatccccttctgtttcataatg

SEQ ID NO: 239707 - DNA, 546 bp, Homo sapiens
aaatttagacagctttgagatgtgttgtacgccatctcccagatgtccccgacaagtctcagtcccagttgccaacaatggtaacttgctcatgagcgtatcggcttccttcccttctgtgcctcacttcactatttttcctctgtgcttcctgggttcacctccctaataaatttcttgcactcaaatctttatctctgggtctgtttcttggggaatgtaaactaagacaaaggcattttacaatcttttcccacctggttctttccattaagcatcctgaacctcctaccatgaactcatctttcattggccaaaggcataatgctctgatattttatatccttctaacagcctttccctctgctggaatgcctttctatgcctgtacaactggctactctgctttcaagacttgggtcaaatgcctctctgaagcaagttgtcttcccagcctaggtcagatacacattcttctgtgttcccatgcaaggtccatatatttctattgtggtggactatttccaaagatggtcacaataatct

SEQ ID NO: 239708 - DNA, 568 bp, Homo sapiens
agacatttgggatgccacattccagaaaactgtcataataaatattcaaatttataatgtctatgatgtgactggctccccctagagttgtgcagtgtacagcctgcccaaccatatgggagagtcctgtcttggtcagtttccatctcattgcatctctttgcattaagaacttcccccttgtggggggcactactctcagttgcaaccttaaattgcagtattgattattgtctctttaccctcccatggtgtatatagagactctgtctggctttatctatgtttggatccccaggacctagagtagtgctttgttcatacaaatcatttagtcaatgcttgaaaagcttttgcttctacactgctctcaaagtctccctcaaagagctctttctctgtgtgtctttcctgacctccctatgctccctggacccaggatgttccaattgtaacacatatcacaaagtatggccattgcctgttttctttcccctattttattttaacccacccatcccctaacacaccagtaaactctaagctcctttagaggagggggcatgcc

SEQ ID NO: 239709 - DNA, 514 bp, Homo sapiens
agacatttgggatgccacattccagaaaactgtcataataaatattcaaatttataatgtctatgatgtgactggctccccctagagttgtgcagtgtacagcctgcccaaccatatgggagagtcctgtcttggtcagtttccatctcattgcatctctttgcattaagaacttcccccttgtggggggcactactctcagttgcaaccttaaattgcagtattgattattgtctctttaccctcccatggtgtatatagagactctgtctggctttatctatgtttggatccccaggacctagagtagtgctttgttcatacaaatcatttagtcaatgcttgtgtgtgtctttcctgacctccctatgctccctggacccaggatgttccaattgtaacacatatcacaaagtatggccattgcctgttttctttcccctattttattttaacccacccatcccctaacacaccagtaaactctaagctcctttagaggagggggcatgcc

SEQ ID NO: 239710 - DNA, 93 bp, Homo sapiens
tcttgctcttcccctttcctgaactccctttccttagctctttgcatgatttatttcagattatactagagactgcagattttaattcctttt

SEQ ID NO: 239711 - DNA, 651 bp, Homo sapiens
cagaaagggaacctgaaagcccactcccccatcagaaggcattacagggttccctgggacccctgcaggtgcttgggaaacaggcagataaggcacttaggagacattgtgggtcaggagtgaccctatgggtcaggctttgaggatggaagcagccagcccttggcatagtgttctcagacagactcagcccaggagcgggtcgtgaaatcaatttggtggggtgtgacctgcattttaaataggaaattagaatcacatcacccttggtaagggtaagttttggtttgtgtgtgctaggtcatgatgtcaaaagtacttctgactgttggtcacattaaaaaaactgaggcagggtgcgatggctaactcttgtaatcccagagctctggaaggctgaggctgaaggatggtttgagctcaggagtttgagaccagcctgggcaacatggtgatacctcctctctacaaaagataaaaacaaaattagccaggcaaggtggcagtggtgcttgcctgtggtcccagctactcagaaggctgaggtgtaagaatcacttgaacccgggaggcggaggttgcagtgagctgagatggcaccactgcactccagcctggaagacagaatgagacttggtcccctcccccacc

SEQ ID NO: 239712 - DNA, 506 bp, Homo sapiens
gtgattatgaggaaaaatggggaatgtctgagtgggtgaaggaaaaaaaaagtgcaagatattactagaaaaacctgactgcacacacaatcctatcccctacgcaggagaaagaccgagtgctagcacccggggtgtgaaagcctgcaccaagggacccaggaaccaggcgtgcctccatttctcactcgatttgtttacaatgaacggacggcgccggagtccctccgccctcagctcaggcccggttcccaccgcccgacgctggctggccgaggcaggggcgcggcgggggatttcgggcagggcggtgaagcagggcctgctctacagggggcttttcttcgccgcggtttcttcccctgtcgctgcccggcccccacctcctctctcctcccgcgcgcgctctgcccgccgcccacgcgcggaagcccgcggccggggagggggcgccgtctcccggcatgctcggcggcggtgccggtcacgtgacgggaaggcggccg

SEQ ID NO: 239713 - DNA, 273 bp, Homo sapiens
gattggaaaatggtttaaccaaaaagagaaaagaaaaaaaaaagccaaggaagtaaaacaccttatttaccaaatccagtgacaaatttctgtctcactgtttcattattttaacttcacctaaaccatagttttaagtaggtggagggatgagaaaaatcttagttcagcaccttgtagaccttcaatatgtgtgttttaaatgatttactgaaattatagcacatggtttgaggatgtttatttcatgtgaacccatattttaggcattag

SEQ ID NO: 239714 - DNA, 482 bp, Homo sapiens
tatgttctagtaacccattgtaagtcgaaaatactgtgagtcaaaaatgcatttactaaccctgctaaacccactgtgaagctgaaaaatcataaggcaaacattgtaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggagaagacctcatcaaaaactgtcctaattaagactatccagaacagaacagacccgggggctgatctgtggtaatttccaggagaagttctcaggccatcaggcttcggataaagaaaagagaggaggcagagatagtgggtgatggagtgagagaccttgtggaaatgtgaggaaagagag

SEQ ID NO: 239715 - DNA, 410 bp, Homo sapiens
gcgccccagccccgctcaggccgcgcccctgccacctctggccacacgggctgagacgtctggctcctgcacagcgcacttcccgctgcccttctccactggctgctcaggccctgcctcgccagcacggcatccgcgggggatccctacctgtcctttagggcttgcctcataggtcaaacgtcacctcccagggaggtatggcctgccccctggccaggtgggccccttccacgctcgcctgcaacaccacccacccaccttgataactgcttgtaaaggttgtactgctttcccccttgagactgcaaaccttcaagggcaggaaatgggtctgttttcctggcaaaataatgaagttggcttaaggttttgctgaataaaatgagtgacagacaaaagtagccaaa

SEQ ID NO: 239716 - DNA, 598 bp, Homo sapiens
tccccaaacctaaaagtaaaactttctaccactggggcttcagatacttttaatactacttatttgaatttcattatttttattatagtttattattgtcttcatagctgagtactcttaaaattactgtttattataagtgaatgtcttacagaacaaactcaaagtcaatgcttcttttgcatgtgaataatcaagctatttttttgtcatcattactttagtaagtaacattattttatatgaagaatagagtgtatatacataaacccatgtgccagctgccattgcactgcctcacattttcctttagatgtttgagcatagttttaatgactgtttgaaatctctgtctcctagttccaaatatgggtcatcttggagttggtcttcattggtgccttttctcttcagtatgagtcataattttcctgtttctctatatgcctagtaaattagaattttattctagatgatgaataatgtgtggcagagattctggattctgttacattccatcaaagagtattgatattttgtatatacatttacaaatgtacatgtacacaataataaaaataatttttttctcagacct

SEQ ID NO: 239717 - DNA, 581 bp, Homo sapiens
taatagttgtcattacaactttaacatattcttatgtttctggccagtatatcctgaacaagcccagaatgctgaaatccgatcacccctctctgttacttaggtttgctttcagttctaccttgtctgtaatcccacccctttagaaaacattccatcattgtttcatgttgttttacttttacaaacatatttatcaacttcacatctgcctcttcaatctcactccttccttcttggttcaattttcttctttctgaatggcaggcgattcctttgttcagtgagggtctatgattaacaaactcagaccctgagtttactagcatgaatctttatatattttaattatcattatctaataaacatatgtaagtagttaaaaatttaaatagtgctaaaagtagtagtctcctgttcctcacttccccagacataacaatttccaactgttttttcttcctgagctattccgtatggtatttaactccaagtttctaaatagtatgcttataatactctcttaattcattaatttacaatactattaactgtatattatagtagcagactgagcgctc

SEQ ID NO: 239718 - DNA, 445 bp, Homo sapiens
gtcaggatcagatattttaaagaagcatcttaacagtccttcatgccttataagttaaaattcctctcacaggaacgtaagcagagaaatcttattttctgagacaggcttcttccctctcgctgaactctaaatactgtattcccctttcactcaaaggccccagacgatgccattctcattataacataacttatggaaagctcagatctattgttggaaaaaatgcaaagtgtgtgtgttcatgcacacacgtgtttgagaaaagcctttccatttctgaaatcccaagagtcatttttatgcaagattatctgttaggaaaaaacccacttttttggtcatggtacattataatcatttctagaaaggagagcgtctaatttttgccatttttggcatgcagagatgactgacttcatagaaaccacactatcctgcttcc

SEQ ID NO: 239719 - DNA, 1603 bp, Homo sapiens
  misc_feature (152)..(152): n is a, c, g, or t
aaagacggagtttcactcttgttgcccaggctggagtgcaatggcgggatctcggctcactgcaacctcagcctccctggttcgagcgattctcctgcctcagcctcctgagtagctaggatcacaggcgcccaccacactcggctaatttntttgtatttttagtagagacaggagcttggattctcagtctcctctccctgaaaatgatcctctccaccccaactcatactgtggctttggccttatctcgtttgcagatacctcttccctggaaacatggtttttctcccccttcagggatttaggtgtgatctcccctaacccaggcagtccttgatctcccgcctccatctccctgtcttttgcatagacaaaaggctccagccctccagcagcccccgcttgctcccaagactcttgttgtcctgcttcaccgtccccacagtaaccaggccctgctgccgtcaatggaggcgagggggcgggagacagcagtgacgtcaaagcggaagaagggggcggggcgaagctgcctcggaatgtggggcagggaggctggagagactggagaggcagcggtttgggaggcggccagcccgagagggcggcggccagcgcacttgggaacatcatgttctcttggctggtggcccaggacatgcacccagcctgggcgcctcccccaacaaaacgacagccgtcctgtcccaaagccagggattcctggagagaggattagtaggaagggggccccctccccacacctccccccaccacgcctggctctcttttcaggactcccatctgcccgctcctcagcttgttcctgcagctctggcttttcctctctcccaaactgtacacatctgctggcctggtaccaaagacccagggcggagaagttggaggtcctgtctctgggagagaacacgacgcacctttgctaccttccagaagccccttcagagcctgaatctcttattatgacagcgggcggggggaaagggagaggggcgcggacagggaggagaaggggcctaggatgaaaaaatcaaactgggacagagcaagtggcccagtctagggcctggatcctgggagagggctagaagggaggaatgagggaatttggactgctgcctgaagaccaaaagagccaggaagagagaaatgggacgccatcaaaacttgcagaaaaacttgagaatatgagactagttcccagccacagcattcacataaatctctcaccataacccaggcattatgctaagcactttatattatcttatttcatccccagaacaaccccgtgagataggtattattatccccattccatgggggataactaaggcacggaagttactaaacttgtccagtgcctcataacatggtctcaagctcttaacaaatggagcccaggattcaaaaatctgaactctaataatggcttgtcattctggtttcttacccttgaggaacctgtgaggtgttaaccaacctgtaagctgcattccagcactggcaaacctggcctctcaaatatccagccaattctaagtttggtgccaggaacacagactccatccaacccctt

SEQ ID NO: 239720 - DNA, 1508 bp, Homo sapiens
  misc_feature (152)..(152): n is a, c, g, or t
aaagacggagtttcactcttgttgcccaggctggagtgcaatggcgggatctcggctcactgcaacctcagcctccctggttcgagcgattctcctgcctcagcctcctgagtagctaggatcacaggcgcccaccacactcggctaatttntttgtatttttagtagagacaggagcttggattctcagtctcctctccctgaaaatgatcctctccaccccaactcatactgtggctttggccttatctcgtttgcagatacctcttccctggaaacatggtttttctcccccttcagggatttaggtgtgatctcccctaacccaggcagtccttgatctcccgcctccatctccctgtcttttgcatagacaaaaggctccagccctccagcagcccccgcttgctcccaagactcttgttgtcctgcttcaccgtccccacagtaaccaggccctgctgccgtcaatggaggcgagggggcgggagacagcagtgacgtcaaagcggaagaagggggcggggcgaagctgcctcggaatgtggggcagggaggctggagagactggagaggcagcggtttgggaggcggccagcccgagagggcggcggccagcgcacttgggaacatcatgttctcttggctggtggcccaggacatgcacccagcctgggcgcctcccccaacaaaacgacagccgtcctgtcccaaagccagggattcctggagagaggattagtaggaagggggccccctccccacacctccccccaccacgcctggctctcttttcaggactcccatctgcccgctcctcagcttgttcctgcagctctggcttttcctctctcccaaactgtacacatctgctggcctggtaccaaagacccagggcggagaagttggaggtcctgtctctgggagagaacacgacgcacctttgctaccttccagaagccccttcagagcctgaatctcttattatgacagcgggcggggggaaagggagaggggcgcggacagggaggagaaggggcctaggatgaaaaaatcaaactgggacagagcaagtggcccagtctagggcctggatcctgggagagggctagaagggaggaatgagggaatttggactgctgcctgaagaccaaaagagccaggaagagagaaatgggacgccatcaaaacttgcagaaaaacttgagaatatgagactagttcccagccacagcattcacataaatctctcaccataacccaggcattatgctaagcactttatgaaaaaaacaaaaaaaacaaaaaaaaaaaacaaaaccaaaacaaaaaacaacaaacccaaaaaaaaagaaaaaaacacacaaggggagcccgcgaagacgcaccaacgcgcgacacaaagcacaccacgaaaagagaagagccagacacgcgggcagcagcccaaagcacggggggggcgggaactcacaacagcagacgggaggacaccacggaccccgcag

SEQ ID NO: 239721 - DNA, 467 bp, Homo sapiens
gaaaaagaacaaattggaagacttacacaacgtgattttcagacttactataaagctccagtaatcatgataatgtagtactgatgtaaggatagacatatagatcaatgaaacaaaaaaagaaagtttaataaaacatccacacttacacaatcaattgattttaaaaaaattttttaggcttttattttttgtaagagatggggtctccctatgttgcccaggctagagtgcagtggctattcacacgtgcaatcatagtgcattacagcctgggctcaaaccatcctcctgcctcaggctcccaagtagctaagactgcaggcatgcatatagtcaattgatttttgaaggaaatactaatacaattcaatgggaaaaggaaaatgtcttctgcaaatgatgccagataactgtttacctgtatggggaaaaactgtgaactttaactcttaccttataccaca

SEQ ID NO: 239722 - DNA, 590 bp, Homo sapiens
ggtgttaattacaattcattcaacaaatatttcttgagcctgtgtgccaggcaccattccaaggtctgttagcagcctcattctctagaggcagagtatataacaataggacttgttgtagcctcaggccaagatgaattatgaaaaaaatattaaacttggtcttttggcatggaatgaattttgatacaatactggtcaagttctgtgacttccataattgcagagtgggtctgcagttgaattgaacaagattttgcctgaagtagaagtatcattgccatgattttatttcagttttgttttcctcaaaatagaatttgctgaacttttagaaggaaaaaatgtttcttctatagacctcatcaagcttgttaaataaaattattacctgcttgctctgaggttccaaactattcagatacccctaatgatcatctccccatgaattgtgaaactggtttggctctgatatatgattattgacatttgtgtagcattgtacacagactgattttatgtggcataaaagatttcacaaagactttaaaattatgtcattttacttgatgggtgtgtgttcaattaaa

SEQ ID NO: 239723 - DNA, 1194 bp, Homo sapiens
  misc_feature (831)..(832): n is a, c, g, or t
  misc_feature (864)..(864): n is a, c, g, or t
  misc_feature (872)..(872): n is a, c, g, or t
  misc_feature (874)..(874): n is a, c, g, or t
  misc_feature (880)..(881): n is a, c, g, or t
  misc_feature (883)..(883): n is a, c, g, or t
  misc_feature (1046)..(1046): n is a, c, g, or t
ctctgattggctgggacggctgtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttggctgcgagaatgtcagatattctgggatgtcgctaagagtcctatttgccccaggtaaattcaacttttaggctggcctgttnngtggactgggctggtctcgttagaactctgtnccacagtngnttgganntntcacgttggttaaggttcccaaagtggacaatatactattgcatgtggttaaacccaaatccagaaagggtttaaaccacatagaagtggtgctaagtgaggatttcttacaaggcacttcccgatgtgtatacgtgagaaatcactgaagggatgctgcganttaagttatgtggagaggcgaacatataatcaggcagatgacatgtgtagggaaagacataaaatgtctcttgcgacgaggacagttgtgtcagacagagaactccaacgcagggtaatatagccgggttgaatgagtgtggtgagta

SEQ ID NO: 239724 - DNA, 1075 bp, Homo sapiens
  misc_feature (712)..(713): n is a, c, g, or t
  misc_feature (745)..(745): n is a, c, g, or t
  misc_feature (753)..(753): n is a, c, g, or t
  misc_feature (755)..(755): n is a, c, g, or t
  misc_feature (761)..(762): n is a, c, g, or t
  misc_feature (764)..(764): n is a, c, g, or t
  misc_feature (927)..(927): n is a, c, g, or t
ctctgattggctgggacggctgtgggtggggagaagccgggaggactgggtgcgcctgcagggatcggaagccggttggggtgtgagaggttttctcgctctaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttggctgcgagaatgtcagatattctgggatgtcgctaagagtcctatttgccccaggtaaattcaacttttaggctggcctgttnngtggactgggctggtctcgttagaactctgtnccacagtngnttgganntntcacgttggttaaggttcccaaagtggacaatatactattgcatgtggttaaacccaaatccagaaagggtttaaaccacatagaagtggtgctaagtgaggatttcttacaaggcacttcccgatgtgtatacgtgagaaatcactgaagggatgctgcganttaagttatgtggagaggcgaacatataatcaggcagatgacatgtgtagggaaagacataaaatgtctcttgcgacgaggacagttgtgtcagacagagaactccaacgcagggtaatatagccgggttgaatgagtgtggtgagta

SEQ ID NO: 239725 - DNA, 1219 bp, Homo sapiens
  misc_feature (856)..(857): n is a, c, g, or t
  misc_feature (889)..(889): n is a, c, g, or t
  misc_feature (897)..(897): n is a, c, g, or t
  misc_feature (899)..(899): n is a, c, g, or t
  misc_feature (905)..(906): n is a, c, g, or t
  misc_feature (908)..(908): n is a, c, g, or t
  misc_feature (1071)..(1071): n is a, c, g, or t
ctctgattggctgggacggctgtgggtggggagaagccgggaggactgggtgcgcctgcagggatcggaagccggttggggtgtgagaggttttctcgctctaggaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttggctgcgagaatgtcagatattctgggatgtcgctaagagtcctatttgccccaggtaaattcaacttttaggctggcctgttnngtggactgggctggtctcgttagaactctgtnccacagtngnttgganntntcacgttggttaaggttcccaaagtggacaatatactattgcatgtggttaaacccaaatccagaaagggtttaaaccacatagaagtggtgctaagtgaggatttcttacaaggcacttcccgatgtgtatacgtgagaaatcactgaagggatgctgcganttaagttatgtggagaggcgaacatataatcaggcagatgacatgtgtagggaaagacataaaatgtctcttgcgacgaggacagttgtgtcagacagagaactccaacgcagggtaatatagccgggttgaatgagtgtggtgagta

SEQ ID NO: 239726 - DNA, 610 bp, Homo sapiens
aactgagacattcagaaaaatacaacaacaaataatgcagatgcagaaaaagaagagaaaggatcataaggtataaacttatatttaagaagctgagtgaactccaaagaggataaaaacattggaatttataccaatatacattaaaataaaactactttaaaaaaagaaaaaaataccttgaaagcaactagacaaaaactatgcttttcctcgaggggatcaacaattcaaatgatgctgagtttttcatctataaccatgtggcacggttttcaagtgttcaaagaactgtcaactccaaatttgatatccagtgacacgatcttttacaagtaaggggatcaatacagacattctcagagaaagggataccaagggaatttgtctccagtagacctatgcctaaagattaactaaaggaattcttcaaattaaaataaaacagataaaagaaagagcttgagactttaggatcctgaaaaaatagaaaaatagaatggataaacagaggagtcaatataacaggatatctttttcctcataagttttttcaattatgttcgatatttgaagcaagtgagtttaatatggagctcaatgtatgcag

SEQ ID NO: 239727 - DNA, 529 bp, Homo sapiens
cgccactgcagtgagactgtctgaaaaaaaaaagaaaaaaattaagagagatttaagaaaatcagggaaaatgttaatgttcatcttggaagtcggtaaatgggtattggtatttattttaatcacacatatacacatattttgttttaaaatgtttatgattaaattataaaaagttactaattaggctgaaaactttttatgaagttaaaagtagatcagccctatgacctatcagttgtactcccagtaaaaataagaacattgataacaaaatactgataacacagcagcatgaatgaatctctaaaaatgttgttaggttattttgttaacaatatattagtcacaaataagtacatatgtatatgtgattctatttatatgaagttcaagaataggcagaactaatctgtgctgataaaaactagaaagtagttgccttagggtatagggaactgactgaaaaagggtacaagggaactttcggagtgatggaaatggtctatatcttgtaacagaaaaaaga

SEQ ID NO: 239728 - DNA, 500 bp, Homo sapiens
cggccgccgacgccccggtccccgccgagctccccgccgccgccaaggaccggcccccatagcggctccgggccctcggatggcgtgacggcttgtggggcctgcggggtgcgctgcccccggacctgcggggggaggcggctgagctggcggcgctcgcgggcccagtgtttcttgcgcagttgatgatctttataatcagcctcgtcagctccatcttctgtggacatctgggcaaggtcgagccggacgctgtcacgctcgccgtcacggttggacgggggagtgcttccaggagtggggctcctacatccacctggttattcccagtatgttcatggtgtgcactgagcagtggacctttgagatcggaaacttccttgcaggactgattgatgtgatggagctcggcactcagggcatcatctgtgagctggcgtcagtggcctacatgatgtgcaccatgggaagggaggaaccaggcagcacaagtgagagag

SEQ ID NO: 239729 - DNA, 407 bp, Homo sapiens
ctgataagtatacaaaaggaagtgaggagcatggtatgtattttctctaagaaaatgttgatcatcttagagaagatttacatcaacatgaagagaccgatggtagaaatacagaattaaatgcacttcaggtgaaggttcagatgagtggaaaaaaacttgttattggaaactggaggaatggagatctttttcatatcatggcaggcagctcagctgaattgtatcatgcagtaaatgtaaagttactcactattttattttttgaaattaataagtattttataagaagctactttgagacaatgtaagtactgcatattgcttttccttaaatgttcatcagtaattttagcagcccccgatgtttccttgctggaataaaattattgtgatgatgactgtca

SEQ ID NO: 239730 - DNA, 505 bp, Homo sapiens
caagagacaacagtcaatctacaatccaaagtatgcctactatgaaactctctcccacctggagagtttcagccattttacaacctagttctgcccacaaaaggcaccagctccactgcccacagcagtggaggcaccaaatcaagctatgcagattcccatctgcattttcctctctgcatgccattcatgccaagtccccctttaaaagtgcctgcttccggccgggggcagtggctcacgcctgtaatcacagcactttgggaggccaaagcaggcagatcacctgacgtcaggagtttgagaccagcctgactaatatggtgaaaccccatctctactaaaaatacaataattagctgggcgtggtagtgggcacctatagtcccagctactcgggaggcggagacaggagaactgcttgaacccgggcagcggagggtgccgtgagccgagatcgtgccattgcactccagcctgggtgacaaaagcgagactccatctc

SEQ ID NO: 239731 - DNA, 1874 bp, Homo sapiens
  misc_feature (332)..(332): n is a, c, g, or t
  misc_feature (660)..(660): n is a, c, g, or t
gaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcntaattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattncctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaaccccagtattctggtaattttgacaatgatctatatgaaatttatttgatt

SEQ ID NO: 239732 - DNA, 506 bp, Homo sapiens
agcggacgggcttcagcttcttagcctgggaaatgtgagggctagtgcagcgctgagcccagacccctcacacagcgctaccggcaacttgcttaacctagaggtggggggtgacgtccctgtcggccccgtcacctggggccccagcacctctccttggctttgcagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgca

SEQ ID NO: 239733 - DNA, 773 bp, Homo sapiens
agcggacgggcttcagcttcttagcctgggaaatgtgagggctagtgcagcgctgagcccagacccctcacacagcgctaccggcaacttgcttaacctagaggtggggggtgacgtccctgtcggccccgtcacctggggccccagcacctctccttggctttgcagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcctcacgcgcctgtatgtccgcgcgtgcgtgtccgcgcatgcaggtgtgccagagcgtgagcgcgcgcaggcgagcgctcagggcgggggtgcgcgcggggccgagggtgggtgccgtgcacgcgcgcgggtccggaggcgcgcccgaattccccgcaggggcgccggggcgtgcgtgagcgcacagcatgtccgagcccgcctgcgtgtggcgtgcacctgagcgcgcgcagggccgcgcggctcggcgtccccgtgcaccacg

SEQ ID NO: 239734 - DNA, 524 bp, Homo sapiens
ggccaagagccgacctaccatccccatgttgagctttccagcgtttctggggcatcctgtctggttgccggggatggatggcccagggttggagtggtggtcaggggaggacaactggggtgggctggctgacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcaaaaaaacaaacaacaaaaagaaaacacaaaaaaacaaagacacaaagaggggggc

SEQ ID NO: 239735 - DNA, 435 bp, Homo sapiens
agcgcttatatgcttgacactgagaattcaaaggtgaaacaagatggttctgtccttggtgttcatattcaatatttgtggaacaaatgagtgaaacatagaaggttattatttgctaagtctatgtatgtactattacctttaatattcacaacagccctttgagacagctgtgagaaattaggattatcagccgggcacagtggctcatgtcagtaatcccaacactttgggaagccaaggcaggtggatcacctgaggtcaggagtttgagaccagcctggtcaacatggtgaaacccagtctcaaatattagttgagcatggtggtacatgcctgtaatcccagctactcaggagaccgaggcaggagaattgctggaacccgggaggcagaggttgcagtgagctgagactgtgccattgcactccagcc

SEQ ID NO: 239736 - DNA, 398 bp, Homo sapiens
gctccccagggccgggggaccatgagttcacctctgtcatcagtgtcagcatgacaaaccccactggtgccgctcacagcaggatcccacatcccaggccagccccctctgccatgccacctacctcacagccagaggtgggaacagcaactctggggagaactgagggtgctgtggccaccgggtccctgaggctcacggaggagagtgaggcgaggagaaccatggagctgggccctgccttgggaaccaagcactcgccctttgcagctgcagagccgtcctgatgggcaggcgggggcggggtcgctgtgtagctgtgcagagagcgctccgaatgggggtctgtcaccagctcccaagctcgtgggttctcccaagattcttgtggcacatga

SEQ ID NO: 239737 - DNA, 312 bp, Homo sapiens
caggagaagggtgagtggacgagcggcagactaatcaggaaaagacctctcaggcaaaagagaaggtcgtagggtttggagatcggaggaacagtttggagtccttgtcctaccacatactggctcaatgaccttgggtgagtcgtgagccttctcaatgtcagaatttcctgacaagatcacgtgttgtggaaatgaacagaaatgccacattaaaagaacattgatcgttgttacctgaaaaaaaatctcacttcttcattacttctgtgttactcatcttgagtttagcagattcattacttcattaaa

SEQ ID NO: 239738 - DNA, 581 bp, Homo sapiens
tgacgctggcaggctctcaataggccagtgacagaaacactggtacaaagcccctcgctcagtttggctgggagaaaagcagccgaaagagtcagcatgagtgtgaggaagaaagaagaaaagaaggtgccttagaaagaagacaaagggcaactccagtctaagagtctcaaccaccgcatagaaaaatactttttggggcaacaaaatgggttgggagaaagaagtatttgacaggagtggaaggcgaggggcagctcttctgtgtcctaggcacatctccctaccctggagaacctgtcctgcttgtggcctgggaagagacttcaaatggcgccaccaacaacctgaatcaataattacctaaggcggcgtcctacacaggacaaagaaaggcagcgtttccgagagtccctgggataaggggttgcttctcccagctgcgcatctacatttttaatgttgtgatttactccgagggaagctttccacaagtaactaaaatcctaggatcccagagctgccttcttctctggtcaccagctaaagtaggggtcaaataaatatttccagatttttct

SEQ ID NO: 239739 - DNA, 656 bp, Homo sapiens
agagatggggtcttgctttgttgcccaggctggacttgaactcctcagctcaagcagtcctcccacctcagtctctcaagtagctgacactaatgttaacacctttcataaccacattatagggaattaaccttaatagtattaactatttagagaccttcttcagatttctccacttgaatcactaatgtccttttctgttccagaatcaagttttcatatcaccttagtatcctcccatctaggataattcctcagtttttctttgtctttcataaccttgatgaatactatttagttattgtatagaatgtgttcgatttgggtttgtctgatgttttcttctgataaattcaggttatatgtatttggcaagaataccacaaaagcagcattgtatcttctcagagcatcataccgggagatatgtgatgtcaatatgtattgttattcgtgatcttgtctttgatcacatagttaaggtacggtttcttccctacgaagttattactttctctctttcatggggatatactttgaggctatgcaaatattttttttctcagaatattaaccccagtaattttaggatctattgatgattcttgcctacaattaatactgtggtgtttgtcaactggtaatttctattttca

SEQ ID NO: 239740 - DNA, 345 bp, Homo sapiens
agcaataaccataaaaatgggcaaccagtagcccgtggggctgttctgcctatggagtggtggagatataggggtgaacaaaacaacatgttgcttgcagctgatgctgcagaggaagaaatagtcattaatgaagtcatcacatgatgaactgcaaattacagctaagtgctataaagtgggagtgcctgatgttgtgacagcaataataatagggggaattttggtgtgagttggctgaagatggagaaactgagcctcagagtggttaacaacttgcccaaggtcatacagctgggaaggagtgtacctgaaattaaaatcaaattgtctgattccttcata

SEQ ID NO: 239741 - DNA, 508 bp, Homo sapiens
gtgtctcagtttcttttacctgttaaataaggatgaaaatagtaccttcttagaaagttgcgaagataaaatgagttactataagacacactcacaatagctgctggctcagaatgttgagtattccagaacctgaaaaggtcacatggagctaaggaagtgagccatgtaacacgagagggaaaagcatttcaggcagagggaacatcagtgcaaacgccctggtgcagggatgagagggatcagtctgactgccacgtgggaacagggaggactgcggcttggaccaggatgatggaagtcattgagtccaacaggaaattgtggaactcctgagggctcagccgcccctggtctcttctccctgaggtctcagcttatgtagctttcccaggaaagcatgtgcaaccccagatgagattagagctgtctctctccacaagctcacaccaccttggatttctttttcatggtgtcatcacaattagaatgtattgtttatatcaag

SEQ ID NO: 239742 - DNA, 502 bp, Homo sapiens
tcgggtctgtcacgacgcctgaggaaaatcctccgtgacaggaatggggaggctggtgacactggggaggggccctttggccaccgcttccatcagagtctaggcaacttgaccggcatttcacccttccgctttacctccccaagagagcctgagatctgcccttggttagaaagaagaggctcgtttcgtcctagtttctgtggcactggccaccgagcagtttgcgactgtttcagtttttctggagtctttaatcagcccatattttagttgggctttggagatctgctgacttgtaagaataccaggaaaaaggctctcattgaaaatttatccacatctacactcgaaaaatataaatgggcatggattagagatccactttaatttgcatatatcatcagcaattcattgtgcatggttggcatgacttgttagatgctctccttggccgtggtggagaacgcgcgtttattttctattaaaacttcctgttaca

SEQ ID NO: 239743 - DNA, 590 bp, Homo sapiens
ctgcctgaaggtcaggcttaggtggcctggtcccagagttgctgtttctactaggacccgacctggtaaaaatagaagatacagggtagtgaggcagatttgaaaagaatgcagcatgtgcaaattcttactagctgtaatataaatgataaattaaaacatgcatttagtggaatgcactcccataaactattctagattgcatatttgtatacatccatctagtatattttttctgtgttaaataggtacatatttatccttttattccataaaggtaccacacatatacacttctggtagttttctttcttcattttctaactattttgtgagtatgttaaatatttattgcaccttcatttttaatgaatttatctcccagtgcgtagctatagcaatgcttttagataagtaaccttgcacattttcattattttcaatatttcactgttacataaaataagggtgaccatcaaggttgattttgacttgagaaccaaaagttctcactggaggcaccaggaaaaatatattatataccatattatatagaggtattactcttagtttttgcttatttaaatacc

SEQ ID NO: 239744 - DNA, 771 bp, Homo sapiens
aagcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcaggtgacaaaacacgacagccttcttcaagcccctccagtattatccgacgcacttcctccctggatactcttgctgcaccgtatcttgctggacactggcctcgggatagccatgggcaagctgcaccttgcatgagggacaaagctacacagacagagagtgcatgggctgaagaatactctgaaaagaagaaagggtctcacaagcgctcagcatcttggggcagtacagatcaacttaaggaggtcagaaaaatggttctaagatagtgggtgtggaaatatgatccttttgttggctatttccttgatattatgggcagcaaggatttgtcgttttccattgatttcttttttctttttggcttctgaaataacaaaaacaattattgtgttgatttaataaagatttcaatagggatatttatatatcacttacctgattatgtatgtttgtctttttttagga

SEQ ID NO: 239745 - DNA, 743 bp, Homo sapiens
tagacataatatagaagttaatattacaagctctggagtctcaggtttatttcttggctttgccgcttgtaacaccttaggcaacttacatgtgttaagtcagataaagcatatgaaagcacagtgcctagcacataagagcacaagaatgttagctattattagtgtgcctggtgcgtgctaataataactgacattattagctattatatgttagttaactatggtaactctagttattatatatagttaactttgttccataaatgctttatttgtagtataattataattatgtaaaaatactaattttttattagcaataaaaatgaagtatgccaaaatattaattgtaattaataccagttaagtaactggtgccaggagaattttgagtaatttgtgttaattatttttaatgtctaatttttttgtaatggaaatatgttttataatagaaaaatatggtagacattgttgtgaaatgatttttgttaaatacacctcccctcttttttcattacagacagagagtgcatgggctgaagaatactctgaaaagaagaaagggtctcacaagcgctcagcatcttggggcagtacagatcaacttaaggaggtcagaaaaatggttctaagatagtgggtgtggaaatatgatccttttgttggctatttccttgatattatgggcagcaaggatttgtcgttttccattgatttcttttttctttttggcttct

SEQ ID NO: 239746 - DNA, 239 bp, Homo sapiens
tgtatttcagtttgggaaatttctattaacatatcttcaagctcacccattcatttctcagagtgtcttagtctgaggggctcactaaaggtaatcttcatgtctgttacaatggttttcaattgctaggatttccttttgattccttcttacagtttgcatctctctgcttacattacccatctgttcttgcatgttgtctactttttccaagatgcttctccttctgtgggcttccc

SEQ ID NO: 239747 - DNA, 307 bp, Homo sapiens
ggcccttgggacataattagttctaaatgaagtcataagggtgggcccccattatgggattagtgcccttgtaagaagaggaagagacaccggagctcttcctactctccaccatgtgaggatacagcaagaacatagccatctacaagccaggaagaggatcctcaccaaaaattgaatatgctggcaccttgatcttaaactgctgagcctctgaaaatgtgtgaaataaatgtctattgtttaaacctccccatatgtggtcatttagtatagcaacctgagctaaagcagcagtgtttaatcc

SEQ ID NO: 239748 - DNA, 240 bp, Homo sapiens
attctccttcagagggaatgaagaaaaatattaaggcaagcatggagcagtgggaggtgcttggctgaaggccttcctgaggttctcctaagctcttcaatagcccagcttgtggactctccatccctgagtacttggcccaagacacaaactctggcatgctgtattgctccatgtgagctggggaacaaatacatgaaatatgcacggaataaaaggatagagattgttggctgacca

SEQ ID NO: 239749 - DNA, 350 bp, Homo sapiens
tggctttcccagtgctgaggactggggtcggccgctggggttgggtccgagagggtgtacctggaaggaagcaagaggggagcttccttccctcctcttccactgagacctgtgtgaggcgtcaccagggggagccaaagggccccaggtcagccactctgggcccctgacgactgccatcctactggttggaccagcttccccaccgaggcacagacgtggaggtgggcaggacggagtaggcagttggattcactctcaagaccctgtcaaatagccaaagatttggcttaaatcctcctttggcttattgttcctttttcctggagcaataagaatgatcagttaaa

SEQ ID NO: 239750 - DNA, 359 bp, Homo sapiens
aggaaataatcatatcttcagaagattctagggacttatttgtgattaaagacaaaagctccagagaccctaaggttatttacatgtcaaagtcccataggactaagtcccaaagtcccgatctcaaaaggtcattgctctctccactgccagcaaaccatcattgctttggggaaatcaaagtgccttcatcaggaaatgttgagggataatatgtgatgggacttgattgtcttgttagattggcagcttgcctttacctgggctgaacccagcatgcagaagggaaaagcactcacaaaagagaggtcctgagatttcttcatatcttgcagttagaagaaaacagttcagggtcc

SEQ ID NO: 239751 - DNA, 1391 bp, Homo sapiens
tcaacagatctaattgccctaagatgaagctgtgcctcctttttggtagaagcactgtttgaagaagttggtctttgaagagcctcggtgatattgtcagaggctttaggttcctgtcagaggcagctgtgctggagcttgaagagctgaaagtgtccccttggccatgggcccattcactgggggccagtgtggcactgtgggcttcccaacatggtcttccaagcttctggcctcttttgcatcctttgtgccaacaccagtctgtggatgagatcaatgtggctcagagtgtggtttccagagtacggtcctcaaactgttactggtctgggatgaggcaagaactgaaattgagtcagaaattttcaaagcaatcaaacactgcttcctcctttttattgtactccacaaaaccattagtctacaatagattggaaattttaaaagaattaaaatcaagtctggttctcctcactgagctcattggggaatccctggcctagggatttccctcttctcccgcccccaggcctcggaaaatgagctggtgtcagctgctgcccagaaggttacccagcgtgttctctctctcagggtccttcccttaaattctcaagtttgacatggaatagaagaatgtcgggcgtttcaaaaaaggattttgagatgctgcaaagctcactggatttagagtcaagagatgtgggctctagcgccagatttactacagacaggctgcctgaccttgggcaagtcacttatactttcttggcttcaccataatgggctgaactgaatgttctctaaggtgcctctcagccctaacataatatgattcttttcatgagaagagcaggacttgatccccccatcacttgggggcatccccaaggagccccctgttcttcctctgcaggcagccaaggctaattaggaatctgagagaatgagccaggaaaggggcagtacaggacatacattctcttcattgaaggtggtaccccctccccactgcacgatcctcaggaagaattcctttattgaaaccattattgaatagggtagatttaggcacgggaaatgtaaacagcaaatcagccactaaaagtgcgttaatgtcacgcctgtaatcccagcactttgggaagctgaggtgggcggatcatgagatcaagagatcgagaccatcctggccaacgtggttaaaccccaactccactgaaaataaaaaaaattagctgagcgtggtggtgtgtgcctgtagtcccagctactcgggaggctgaggcaggagaatcatttgaacccgggaggcggaggttgcagtgggccgaggttgtgccactgcactccagcctggccacagagtgagactctgtctcaaaaaa

SEQ ID NO: 239752 - DNA, 262 bp, Homo sapiens
ctgaagctgctgatatagctggggatcaccttctcattgcccttcagtgggaattcttcttcttcccaggccaattttagtgcgagtgtgtgtgtgaatgtgtgtgcacatgcctgcacacatgcatgcatgtgagactaagcattttgaaagggagtgatttttttcacaagctcaggaagagaactccctcagcctctctgccaacttgattatagtattttgtacaccttggaagcataaagaatttagccacatgact

SEQ ID NO: 239753 - DNA, 376 bp, Homo sapiens
tatctctatctttaataatgttcataattgtattgtttgtttgccagacgtctctgcaagggcagaataaaaggcacaggaaatacagaattgccctttttatttgatttaaaaactacttctgctcatgaagatatttctggctaaattctctttcccttttgctcctttgttttaattactttttaaattgtgaaattattttaaactcacatagaagacgcaacaagagtacagagcgttcccatgtacccttcaccagcttccccagtgataacatcttacataaccatagtgcaattaccaaaatcagaaatctgacactgtagaatattatttactaaactatagatcttattcacatttcaccctgaac

SEQ ID NO: 239754 - DNA, 528 bp, Homo sapiens
tacgtgtacgggaccaggcgttagtctcacttagggcgctggtgaagattcattcagtagctagtgttcttttatcatggaggagtttggagtttttcaaacgttatttgtggctttatgcataacttactttgactttatcagtcaatgcatcgcagtatgggaatgatttagccctctgtggaaatgcagtggctttttagaacaattaagcaggttattttaagagagaacaacatgttttccaaaacaataacttggtggaaacaaatagcaagagtgtttggcagacgttttttggatgtgctacaggctttcctcccttgttgcttatttttattgacaaacatccctaatgtgtgtcatgtctttctctgtctctccccttccctctctttttttctcaaattatgtaacttttgaggacagttacttctgtgataaactcttcaagtaagaccgttataagatagatttggaaattaaagccccagttgcatttcagtaactcatttcagttatttcgtc

SEQ ID NO: 239755 - DNA, 371 bp, Homo sapiens
agcgctccgcgagttcagcagaccccagcccaggctggaggattaccccggcctgtgcctcatactccgagcagggaaggttggcacaaggtagtcccgggagctgagcaggaaactgaggcaacgtgcgtgctgctcccagcttagcccctgaaatgagcggcgtacgggcctgatgctgactggggaggaggggcggctgcgggaaggaagacaggacagtccctccgtttcttctttatcccccaaatcttcagtgcctcccatccccgcagcgaaaggctcaggcgcgctctgatcctttaattcccgagactagatcttggtcgctgtgaattgaattttacgccccccttcccgcgccattcggt

SEQ ID NO: 239756 - DNA, 495 bp, Homo sapiens
agatctaagaatccattgccaaatccaaggtaatgaacatttactcctatgctttcttctaagagctttatggttttatattttattttatttgacccatttttagttaatttttacatatagtctgaggtgaggggtccaactacattctttcccatgtggaaaagttgtctctgtaccatctgttgaaaagacaattctttccacactggatggactttcactcttgctaaaactcagttcgctatgtatatgtgggtttatttctggactttcaattctattccattggtctgtgtgtctattcttatgccagtaccaactgctttgattgctatagatttataataaattttaaaatccagaagggtgaatcctccacctttttttttcttctacattgtttgctgtaagaacatttagattgctagccataagaactgtaatttgcaacacagttattacctaggcttcactaacttattccccaataga

SEQ ID NO: 239757 - DNA, 330 bp, Homo sapiens
cattttctttagttttacttaaatggatattatttcaagatcttcattaagcaagtaatttagtaaaaaacttacagaatccataaaaagaaagcaaatctcaaatttgtagttaagagtaataagtgttaagattagggaaggaaaaactgtttcagaactggtttgaatgaaaacatagctgatgttgccaaaaaatggctttttgtgagttgagtccatttccatcatgactctaatatcattaagattgaatcattcatttcctcactattatatctagacagattggaaatttaccagaaatggaaattattaaaagtctgactg

SEQ ID NO: 239758 - DNA, 2381 bp, Homo sapiens
  misc_feature (922)..(922): n is a, c, g, or t
  misc_feature (2021)..(2021): n is a, c, g, or t
  misc_feature (2061)..(2061): n is a, c, g, or t
cgatgaattcagccgaatcccaagaaccatatcgagccctgctgctacccaagccagtgtccccgacgacagcagttcccggaggtgcagcgcgcctggggcgagcccgaaggagaggcatcctgacagccgccagcgggagagaggtggaggccccaagaagccgtggaaatgcggggactgcgggaaggccttcagctactgttccgcgttcatcttacaccagagaatccacaccggggagaagccatttgcgtgccccgagtgcggcaaggccttcagccagagcgtgcacctgaccctgcaccagcgcacgcacacgggcgagaagccctacgcctgccacgagtgcggcaaggccttcagccagggctcgtacctggcgtcccactggcgcacgcacacgggcgagaagccgcaccgctgcgccgactgcggcaaggccttcacgcgcgtcacgcacctgacccagcaccggcgcgtgcacacgggcgagcggccctacgcgtgcgcccagtgcgccaaggcgttccgcaaccgctcgtccctgatagagcaccagcgcatccacaccggtgagaagccctacgagtgctccgcgtgcgccaaggccttccgcttctcctcagcgctcatccgccaccagcgcatccacacggaggagaagccctaccgctgcggccagtgcgccaaggccttcgcgcagatcgcgcacctgacccagcaccggcgcgtgcacacgggcgagaagccctacacgtgccaggactgcggcgcgctcttcagccagagcgcctctctggccgagcaccggcgcatccacacaggcgagaagccctacgcgtgcggccagtgcgccaaggccttcacccaggtgtcgcacctgacgcagcaccagcgcacgcacaccggagagcggccntacccctgccacgactgcggcaagcgcttcagcaaccgctcccacctcctccagcaccgcctcgtgcacaccggtgagcggccctacaggtgcctgcaatgcggggccgccttcagccacgtgtcctcgcttatagagcaccagaagatccacaccggagagcggccctacaagtgcggcgagtgcggcaaagctttcagccagggctcctcgctcgccctgcaccagcgcacgcacacgggcgagcggccctacacctgccccgagtgcggcaaggccttcagcaaccgctcctacctgatccagcaccacatcgtgcacaccggggagaagccctacgagtgcagcggctgcgggaaggccttcagcttctcctccgcgctcatccgacaccagaggacgcatgcagacagttcgggacgcctttgcccagctcccacgcctgactcaacacctgggctctcacagggaggagaaacctgtcaacaggggtgccctggcagaaacccgcgtggaccagcagaagattaagagctgagggcctcctttccaacctcacaatgctatgggggagatactgtgttatccccgacgcttcctgtgaggaaaccgaggctcagagaagcttgttaacttgcctgagggcacacagtggggaagacacagggctaagactgtacctcacatctgccagactcccctgcggtcttcctggtgcaaaattataaatggggcacgggcaagtagacctgcagaaacacctatggctggcctttaatttctttctttttttctttgagacagtgtctctctctgtcacccaggctagagtgcagtggagcgatctcggctcactgaaacttctgcctcccgggtacaagtgattctcctgcctcaacctcccgagtagttaaaattacaggagtctggctaatttttttttttttttttttctgagacggagtcttgctctgtcgcccaggctggagtgcagtgatgcaatctcggctcactgcaacctccgcctcccgggttcaagtgattcccctacctcagcctcccgagtagctgggactacaggcgcccggccaccacaccnggactagtttttttgtattttagtagaggcggggtttcancatgttggctaggatggtctcgatctcctgacttcgttatccacccgcctcggcctcccaaagtgctgggattacaggcatgagccaccgcgcccagcctaatttttgtatttttagtagaggcagggtttcaccatgttggccaggctgtctcgaactcctaacatcaggcgatctgcctgccttggcatcccaaagtgctgggactacaggcctgagctacggtgcctggccagctggccttttcattgttgattttattgagtaagcccttgctcagtaaatttaattgaattaaagtgaataaaaggtttggtttc

SEQ ID NO: 239759 - DNA, 556 bp, Homo sapiens
tccagctccttttatcacagtttcaggcccatagtgtctctgccaaccaccgctgtgcaaacgttcccacccctgtcagctcatccagtatgtccagcatcccactcggctgactcacaatattgactttctccttagctataccatctcctcctctctagcaacctcttcttttaagaacagcatgtaaactggctttatccttggcctagttaatggcagactcagcttatgtcgacttccattgtcagggggttttcctcctgtggacatcacgtacctgcccactccaagaacttctattgtactctttcagcccaagactccggattgtaaccaaaatgtctttgagtttgccccacgatttttaaatcagtttatatggtataattcctgtttcttttgtggattttgttttgaaggcggttgtccttcactggctgaatcatgtgactttattcctttgtaaaaatcttcccaaagaaagggtacctattccctgttccttttcccctgagacctcaggggattccacagatgcccttggcccttcctt

SEQ ID NO: 239760 - DNA, 2058 bp, Homo sapiens
  misc_feature (236)..(236): n is a, c, g, or t
  misc_feature (1397)..(1397): n is a, c, g, or t
  misc_feature (1803)..(1803): n is a, c, g, or t
tttaaaaatccagttatatggagaaacaagatcaatttattgtcaaaagacagaattattcctcttttgcatcaaccaggcttgacataactgtaatctcatggaaatgtctgctactgtaatcaagaatttgcatgtagaaggaatgcatcacagaatatatgacatcttgctatgtctactgtactaaagaattaaagaggtttgaaaataaatactgaaacaaatcagaaagnaacctcaattttattaaactaaaatatcatagctaggaacatctcaaattgagaataaagtttatataatatttcagagtcatatgaatgtcataaaataataaaaatgtaccatataattatttaaaaagcacaagtctataaattggaaacaatgaccagctaagagatgacaggtaggctgaaactcaacctatttccaaaccactaaagaagacataaatcaacttaaagggaaaattacatttgtaggtttataaacatatttttaaaaaccactcctataaagcaaaagatataaaaagaaaacttgagaaatgataaaaggataaaggataaaaaattaacaaagctatatgttaggccactttggttcatgcaattttcttttgtttctctctaaaatggtatatcaatttttatttttcacaaacttctttcaattaagaaagaaaatacatttgcacaggaaaaagcagtttttcatcaactttttctagtcagtgaacaaaaggctgagaagaaatcttttttttaaaaaatggttacattatagtataatgtatagattatataaatcatgcattatcttacagacatatataagaatgtatagggataaaatgtataaaatagaagaaccaaatgcttgcaacagaaaataaaagtgtaaagtttagttctttttctgtactataaaaaaaccagccatcctgaaggcctgtgccattcttaggccactttcaggcagattctgaaaagctggaaagtaaacacaggtgttttaaaactagagctgctgtcacggacaaccacaaacacccttaactctgatgtggcaacgcctctttcccgccctctgttttttaaagcaatacccgaaaagaaaatgtcaaatgtttcacctttcaacacctcagaataagtaagagcttaaagtgttgttctgtaatctctagcaaatagatcactttttcactacttttaaatgtagccaattaaatattaattacataagataaaaagtggaatttctttaaaaatttccaccaccccaaccttacacaccctccctcttccaccatattttacagcagtttctttagttcttaaagcaaaatcttttgtttgaccacatttagattatttcttctatcgtanagtttttacagaaaatatctgattttttcttggaaagtttaacgtacaactcagaaaaatgcagagctttaactgaaatatgtaattctcttttagaaaactgtatcctaataggtacctaagtaggagtagaaatcatttacagagaaaaatagaagacagaaagtaaaataattcccaaactgctacaaaacatggaactcaggttttggaatcaattcatatatggaatcaattttcaaacactgaaatatcaatctattacttataattgtataaaattgcccttaaaaaacagggataaaattcattaggaattgataagttacaacctaactagtaaatataagaactaaagaaaaattaattctttatatttcaccatatacatcaagaaacaggtacngttaagggaatggccaagtaagtatcaatcagttcccaaattaatcttggaggttattttgagaggtttagtcctaccctcagaatttcacaaataattcctttgtgcaatccatgtaagaaatgttctctgaaatcacacttgtttgtatatttgataattttttttaaaaaactggtagtttctttgtgctgtaagctttaaataaagagatgtctgcctttttaaataataaaataaaaattaatgaatagg

SEQ ID NO: 239761 - DNA, 444 bp, Homo sapiens
ctcttcttttcaggaggtgtctttgcagtagattctggagaaacaatgatcaggctctctggcagaacatctaaactgcctgttggatttctgtcttccttggcaacattatattttaactgtttccctgtagagtaaccagaaacttttgtttctctaaagtagtgctatgtgatggaaatagactaacttttttggaagaggtatttttaaaagtagatgtaaacaggtgaaattaattttaataatatatttcattcaccacagtatattcaaaatattattgcagcatgcaatcagtataagaatttataaatgaactatttccttttttgttgtaagtctttaaaacaaatttgctgtgtatttcacacttatagcacatattaattcagactagctacatttgaagagttcagtagttaccatattggatagttacca

SEQ ID NO: 239762 - DNA, 652 bp, Homo sapiens
gttcagaagccgaataaataaaaggtttagtttggagtaaatgtaatgtgtcacatttcccagtgttgtagtgcttgtcacttcttaggtgctctataaatgtttggttaaaagaaatgtagttaagttgaaagtctgagattaaaatgttttttttcttcctttcgtttcctttttttttttaagtagtctgtttaaaaaaatgaaagtatgttggaaactttagccttaaaagtttcttggtaatactagccaaatgcaaattttttggtatctttttagaaatactaattttaagtgctcagcattacattctactgcattttttaaaaaggtgcttttaacgttaaaaggaaaaagttactaaaataaatttctaacttcatacaagtacttcctgttattataagtatagcaaatctcagagaatttgctagtaattattagtactaaaaacttagcttatttcttacaactttatttcttatgtgatcagaatctatttaatgttgagtgtattaggcctaaattttgtttctttttctgtgtgttcccaatttctttcgttcttttttatttttctttttgatatagagtctcactatttcaccctggctggcacgatctgtaactgctgcctcctgggctcaaa

SEQ ID NO: 239763 - DNA, 379 bp, Homo sapiens
gcactataccaatctgaatgtaaatccaggatcataaaaacctatttggatccaacagctgaacagaagagttctaaacccacagatgatgtcatttgtttattttctttaattaatatacacttgtatatttattattttaaaatgaacccagggacctttcttccaaatcaggggtaagagtttccttcccagaacctacctggggaaacctggagagatgtatttaactcagaaaatattggttagccatgccaactgagaaaaaaacattagtcagctgtaacaacattgtcactgcaatgaaggcaaagaggaatttgaggtcattgtttaagagtgtggctgactgcaatacttgctactagaaaattaaaat

SEQ ID NO: 239764 - DNA, 508 bp, Homo sapiens
agattcactagcttctagttagggaagtaaggaatgcctaccagcatactgtatcatgatagctccctctctccttttcaaattatgggttaaaaaacatataaagctgaccactgtaaccatttttaagtgtacagtttgttaagtatattcacattgttgtgaaacagatttccagaactttttcatcttgcaaatttgaaactctgtatccattaaataagaattccctcggccgggcctggtggctcacgattgtaatcccagcacttcgggaggccgaggcaggcggatcacgaggttaggagattgagaccacagtgaaaccccgtctctactaaaaatacaaaaaattatccaggcgtggtggcgggcacctgtagtcccagctgctcagagaggctgaggctggagaatggcatgaacctgggaggcggagcttgcagtgagccgagatcacgctgctgcactccagcctaggcgacagagcaagactccatctcaaaaa

SEQ ID NO: 239765 - DNA, 166 bp, Homo sapiens
aggtatttttccctaatagcttttgcaacttgatagttaattgttaaaataatcactaaaatagccatcctacctatgactccataaagaaaatccatttgtataaaggaagattaagtgaataaataaataacttagcttaatagtaaattcacagctaatatca

SEQ ID NO: 239766 - DNA, 744 bp, Homo sapiens
  misc_feature (217)..(217): n is a, c, g, or t
  misc_feature (712)..(712): n is a, c, g, or t
cttggcacacagagaagactgccccaaagtctgcccccagcacctctggaagtcagcagagtcacagcaagtcagcagctatttttcctgagtagctcttctttcccaggatgggaaggttcctagcacttagcagtttccacatgccctggggatagggacttgctatggagcctccccttacaaaaggcaaaggtctggatggagcatgtggcanggaggccatagggtttaagttctgccaatatggggtggggcagccagaaaggcctagagaccctgacccagctgagaagggcccctggtcaccactcgaattcactagggcagagtgactggcatggtccatgtggctccaacaatccctgcatgccagggaatgagcgatccaaaagtggggactgaaaccagccccaggaagcagctacatcttaaacagacttttcattatgaaaagagttcaaattgctgggcgcggtggctcacgcctgtaatcctagcactttgggaggccgaggcaggcggatcacctgaggacaggagttcgagaccagcctgaccaacatggagaaactccatctctactaaaactacaaaactggccgggcatggttgctatttgggaggctgaggcaggagaatcacttgcaggagaatcacttgaatccaggaggcagaggttgcggtgagccaagatcacgccattgcactncaacctaggcaacaagagtgaaactccgtctc

SEQ ID NO: 239767 - DNA, 394 bp, Homo sapiens
tttagtcccagctactcaggaggctgaggcaggaggatcacttgagcccaggaagttgaggctgtagcaagctgtgatcacgccactgcataatttaaaaaaaatttttttaagaactaccacaagtcaataaaagacaaataacccaaaagaaaaatgtgcaaaagacttgaatatcacagctaataaactcatgaaaaggtgctcctattgttaaccagagaaatgcaaactaaaaccacaatgagataccactatattcctactacattaggaatttttaatttaattatttaaattttaaaattttaaatttagaagttgacaacagcaagtgttagagaagatctgaagaaatgggaactcacctatactgctggtgagtaccttaaac

SEQ ID NO: 239768 - DNA, 592 bp, Homo sapiens
ccccgcccatgtcctgctgattggtccattttacagagtgctgattggtccatttttacagaatgctgattggtgcatttataatcctctagctagatacagagcgctgattggtgcatttactatcctctggctagacagaaaagttctccaagtccccacctgacccagaagcccagttggcttcacctctcactgctactttctgtcaaccagagtcaaataattttttccaaccaaccaggcaactcacaaaatcagtgggtccccggggtataattttcaggcatcaggcttccagaggtcagaattctggccacccatgatattcttcctccagtgaggagccctccagacctgctccatagcgacggcaggacctgcctcccagcagagcagagatgagctagtcaggagcaggagaaatgatcttcagactctggggcccagcattccccaggtttcctgcaggtctcaaaatctatcttgaacaaacttgcttacatcatttatttttaaataaaaaagaaccactattgggagaaggtagtgcttgattttttcttcttggcagagttcattccatagcctg

SEQ ID NO: 239769 - DNA, 863 bp, Homo sapiens
cttctataggaaagcactttatttttcccctgtacactctccatttctttctgcctggaatgcaattgtcactattggcaaaacagtagctatcttgtgaccgtgagagagaaaatatggaaaggaaatccaaccagctcaggatgagaggaggaaaacacacagtgagactcggtccctgaggcctcttggagcagctgcaaaagttctggcctgccctcctagagactcctttcgtgagaaaaatgaacctcgtctgttttaggccagtcttggggagggcttcggctacttaacacactgtcctggctagtaagcaagagttgacagtttctactgtggtttgtctcactttttatctaggcagtaaaatgatcaatcttcaagagggtgacgccacagacatccccttccatccgcttctgtgccgatcagctgtggcatgagggctacagccccgacgcaggtgtaaacatccgtgtggctctgacactcctacacgagaatgcttcttggatttgccgtaaaacagactaaaagaacgacagttggctccttccggtgggttctcactctggctgacttcaagaattaagccggggatcttctcgtgaggagccctccagacctgctccatagcgacggcaggacctgcctcccagcagagcagagatgagctagtcaggagcaggagaaatgatcttcagactctggggcccagcattccccaggtttcctgcaggtctcaaaatctatcttgaacaaacttgcttacatcatttatttttaaataaaaaagaaccactattgggagaaggtagtgcttgattttttcttcttggcagagttcattccatagcctg

SEQ ID NO: 239770 - DNA, 1902 bp, Homo sapiens
  misc_feature (1308)..(1308): n is a, c, g, or t
gtttaagaaaggagcaggctggtccggctggaaaacagctacaatagcagcaagggttaagcagtggcagagtttagagagacagcacactccaaaagacaaggcagagtgagccgctagaaaaagaatgagccagcagccctgagagttctgtgttgaggtttttcttacatcagactctttaagtttgtgcttctgtcttaagtctctgcctttgtctttgtctggtttcccacttctgccttaagtctctgcctttcccccacctagttcccattccaggtttgtgggattctcccttactgtcatttgttacagaggtacaggctcagtgttggatatgaatccttcctaatcgtgctcattacaatcaccccagggaggtctcatagtggttaaatatgtacttactgcacctgcatgcctcttaggaatttcacctttgccctctttccttccctatcggcatgtagctagctaccttctgacagcttaactgcacagtgagcaattactgggcatcttaagggatgtccgagagtgttccttcctgcatacgtattttgcctcctctctgctcatatctagcatgcatgttttgggtggtctctggggtgtgagattttccagaccttcttttctcaggggcttccccctcctgttcatgtctagctatctgcctgtcctaacatttgcgctagtcttgccttccttcctttctcctttcttcccttccttctttcttcccagttgagctcctgtaatctctcaggagagtgcaaattaatttcattatgagaatttacatctttatttcaatgctgggaatatgaattgggaaaaagctctcattttgaactttcattttgtttcacattctttagaaaaggaggataaagcaggatttggaggcagaaccttagcttttcctttggtttttttaagtgctcccaggtattctccctctctaaaattatcagtgtccgtttttagacacaataggagaaagtggcttttaataaccagtgtctgacttcttagggcaggaagctgggtagattaattgaaacattctaaaactaaataaagttggtatcgggggtccagctgagcacacacaggtgttacatgcaagaccccctagtttgttgccgtatcagaaagtgattgtaccttcagctgaaagcatgagattgtccttagaactagagatagatcccatttgtatttgtttttcctgtttgaaagttacacttgaaatgtacgtagatgttatttgtctacagtaattttcttgtaaccatatcnttaaatctttgtcagatttgtattttctgctttcagtcagcaacacaatatttattcatttcagtactcacatatctcaagttcaactcaatatttcatttattgaagctaaataaaatggctacataatttaccagttattaatgtattctgattgtgccagccttcagtgtgaacctctggaaactaaataagatgtgtgacctatgttcttctatgttgtcttacagctgctgtagtaatagtagttaagatgtattaatgtaagaagtagaatattattacatacttagatgtcagtaatgtctaaatacttcatgagtcttgctatatttaataattgaaaatgccatagtggatattttgacacagatgtacagaatctcagaaaaggctagacttgggcaggactggggtatgggcctagaaattggacaggtgtggtgtgaaattgcaacccttgtacacactggccacaggacctcagggaagatgtcttatctgtgtaataagaatattacttaccttatggatattgtaatgataaagtcaatgaatatatgacaagtccttggaatataataaatactaaat

SEQ ID NO: 239771 - DNA, 503 bp, Homo sapiens
tggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttaga

SEQ ID NO: 239772 - DNA, 454 bp, Homo sapiens
cgtaggaaagtgagagtaccacagaactgtgaaatatacataccatctgcaaggagcttataatattgtaaacaaggtgagacttgtttacattgaataactagggaacaatgttatgagagaatatatagaaagtataattcaagtatctaaagatgtgattaaggcatgtggaaatgaagttattgcttcaattaaatgtattatctctggaggacggcttgagttcaggagtttgagaccaggctgggcaacatggtgagaccccatctctaggaaaaaaaaaattagccaggtatggtggcatgtgcctctagtcccagctactcgggaggctgaggcaggaggattgcttaaggccaggagtttgaggctgcagcggggcataatcatgccattgtgctctagcctgggtgacagagctagaccctgtctcaaaataaaataaaataaa

SEQ ID NO: 239773 - DNA, 461 bp, Homo sapiens
caacagagttagaatcatccccttaggggtgatggggaagcaggcatattcttcttcagggctggaaaaatgtccttctgagctagacttcttcaggccaactgagactaatctatcagattaaacttactaaacattccaacaaaatcaaacctactatacttcccatgcctatacatacagggaaatataaaatgcctcccccagggacaatgcctaattcattccatactaagcacccaaatccaggtcttatcattttgttcttcaagcaaaaagaaaacaaatgcaaagctggagctccccatagtctgcatggagacataagaggaaaactggggccaggcacagtggctgacacctgcaataccagcacttggagaggttgagatggtagaattgcttgagccaaggagtttgaaaccagcctgagcagcacggcaagaccccatcttaacaaa

SEQ ID NO: 239774 - DNA, 1535 bp, Homo sapiens
acggtaatggtcttctctccttagtcctgatattgacaataaacatcaataggagaaatcaagaaaaatgaaaagcaaaagatgtctactatatacttaactacacttttcatccctattgattattgtaaataaggttaaaaaaaaaaagaggcgccaaatgtgaacaaaaccatgattgttattagtagagaacccagtctgtaaaatattttctggacaggagggaacacagggactatgccctacccactggctaccaactaaatgaggagagaccgtttcacattaccagaatccaggagcacactcagaagtaaaaggtgatattctgataatcagctgcagccatattactgaaatttgcttagttgtgatagtggctgttgttatggactgaagtgtgttcctccaatatcaatatgttgaagcccttatctccagtaccccaggatatggatatatttggagataagggctttacagaggtaatttagagtaaatgaagccattggcatgggccctaatacaatcttctgccagggtaaaagatgtaaaattctagtcccagtttcatctttatgtgactttgggtcaatctatgggagctgaaatcaatgccacaatttattgttagaaaagtcatgagaagtggactggaaatatctgaaaatctctgactgatgaaaagacagcttgtgttatcaaaaatccatctcgttaattaggtttagtgttcagttgaaaccaccttcaaaaaattttaaaactctgtctacaaaacagcatattcttatcttagctagtgagtccgtgtagataaggtgttttcaagcctcttctgtgatatactagccaagcaatggatggatcctcattcatgactaaagagacatttttggcaaagtgatctgagatgagctggtaaagttaggccgggggaccatgggatcctaacttcattattcaggaaattctgaaaaacaccaaccacagtgcaccccaagagttcatcacaacactctgagtttcctcaaatccagcacttttttttgttactgggtattggctgttgttatggggtgaattgtgttctccaaaaatgtgtatgttgaagccctaacctccagtactgcagaatgtggatatattaggagataagggctttaaagaggtaatttagagtaaatgaagccattggcatgagccctaatacaatctgaatagtgtcctaataagaagagaaaatttggggctggcaccatggctcatgcctgtaatgccagcacttcagaaggctgaggcgggtgaatcacttgagcccaggagttccagaccagcctgggcaacatggtgaaaccccgtctctacaaaaaatacaaaaatcacccaggatgacggcacacgcctgtattcccagctactcaggaggctgaggtaggagaatcacctgagcttggggaggttgaggctgcagtgagccaagatcatgccactgcactccagcctgggcacagggagtgagaccctctctc

SEQ ID NO: 239775 - DNA, 2627 bp, Homo sapiens
  misc_feature (1706)..(1706): n is a, c, g, or t
gttaatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccntttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttatgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaaggtaaaatttgtgaagaacatcgatttatttaaccaactacattttcttttctgtttaaaacaaa

SEQ ID NO: 239776 - DNA, 2610 bp, Homo sapiens
  misc_feature (1689)..(1689): n is a, c, g, or t
taaaccaatacgatctcgacacgtaacttatacacataactctctctacatagagaagcaccagctggtttataacttcagaagaaataatggaaagccaagaatttattgttctatatactcatcaaaagatgaagaagtcaaaagtgtggcaagatggaattctgaagatcactcacttaggaaacaaacggacaaccaaacgcaacttttactactgatgaccaaacggacgcatgtcttggacgagtctgtatcttaaactgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccntttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttatgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaaggtaaaatttgtgaagaacatcgatttatttaaccaactacattttcttttctgtttaaaacaaa

SEQ ID NO: 239777 - DNA, 2783 bp, Homo sapiens
  misc_feature (1862)..(1862): n is a, c, g, or t
gttaatgacgtcacgttgtttcgcgggagaaattcgaaagtggattttgtgcaatttgacaggtgaggtgaagtgtttctcgggatttcctaggaatgacttgagcgatttggggcgaagggacgaaagactctgctccttaagaagagaaccgggaaggatgctgtttggaaccaggattggggtggtcgcagtcacagctactcggactgcttgtagtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccntttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttatgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaaggtaaaatttgtgaagaacatcgatttatttaaccaactacattttcttttctgtttaaaacaaa

SEQ ID NO: 239778 - DNA, 851 bp, Homo sapiens
ctatgattttgctttacccccgaataaatctaaaggtataaacatgaatttacatattcctcatattcaaaaccagattgctgaaaacagtaatctattttcagaagatgctcaacctcagccttttattttgggaagtgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagttctcttcctcgggaagtaaagaagagactgcttttcaagctgttattcctaaacaaatagagagaaaaacctgtgaccctaaggtaaaatttgtgaagaacatcgatttatttaaccaactacattttcttttctgtttaaaacaaa

SEQ ID NO: 239779 - DNA, 2740 bp, Homo sapiens
  misc_feature (1706)..(1706): n is a, c, g, or t
  misc_feature (2727)..(2727): n is a, c, g, or t
gttaatgacgtcacgttgtttcgcgggagaaattcgaaagtggattttgtgcaatttgacaggtggtataaatagttgaatatttcctattttctggacccagctggtttataacttcagaagaaataatggaaagccaagaatttattgttctatatactcatcaaaagatgaagaagtcaaaagtgtggcaagatggaattctgaagatcactcacttaggaaacaaagcaattttatatgatgacaaaggagcatgtttggagagtctgtttcttaaatgccttgaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaattatttttgctcacctgtcaattctggaaataagctttcagactctttactgaccaatgagcctgtgaaaagagatagtttggcatctcactattcaggagtttcacaaaacatcagaagcaaagcacagatattagctcttctgaagtccgaatcatctagttcatgtgaggaactaaattctgagatgacagagcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccntttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttatgacttagacaaaaatgatgaacatgttttaccctcaacttctagtagtgacaacagtgtccaactattaaataccaatcagaatcactatgaatgtattgcacttgataaatcaaatacccacatttccaattctttgttttacccactgggaaaaaagcatcttatttccaaagacacagaagcacatatatctgaacctgaagatttgggaaagattagaagtccaccccctgaccatgttgaggttgaaactgccagagaaggcaaacaatactggaatcctagaaattcttcagaactttctggattagtaaataccatttctattttaaagtcgctatgtgaacacagtactgctttagacagcttggaaatattgaaaaagaaaaatactgtctttcagcaaggaactcaacagacgtatgagccagatagccctcctgaagtgaggaaaccatttattacagtagtttcaccaaagtctcctcatctgcacaaggattctcaacagatactaaaagaagatgaagttgaactaagtgaaccacttcagtctgtgcagacgggttcttgctctgtcacccagactagagtgcagtggcacagtcacagctcactgcagccttgacctccagcgctcgggccatcctcctgcttcagcctccaaaatacaaaaattacccgggcctggtggcacatgtctgtaatcccagctacttgggaagctaaggcaagagaatcgcttgaacctgggaggtggaggttgtagtgagtcaagatcatgccactgcattctagcctgggcaacanacgagactgtctc

SEQ ID NO: 239780 - DNA, 174 bp, Homo sapiens
taattttgtatctactaaccaacctctccccacccttccaagcccccgttacacactgttctactatttcccatgagctcaaaaaatgttttattcccacatatgaatgagaacatgcaatatttatctgtgcctgactttaaattttgataaaatcttatgataaagtacaat

SEQ ID NO: 239781 - DNA, 461 bp, Homo sapiens
gttcatgtgaggacttggccagttagaactggtaaattgaacattcctcactcagtacacttgtcaagttacaggcccattctaagtcatgctgcattaaataaacaatgctttaaaaaatgtccatctccatagacctcttatctaaaaatcacctatttcatatcaggtgaatgccatgcattttgtagaggctagagaataacttagcggtaggggagatggcataggagtcaatgcctctctggtgggctactttaaaaaaaatacaactttctccataacttttatgtccctatattttgtgttgtggtatttgtgagaggtactttgcatttataccttcaggagacttggttcagcatctagttaattatctacatgtaggtgcttaatatatgccatgccaccctttttgtctccctgtatcatattctatgctaataaaattattttcagca

SEQ ID NO: 239782 - DNA, 348 bp, Homo sapiens
aaaaaattgagccagaataaaattccagatgagtcctgaacagaagacaatgagaaacatatatagtatacatttcccttcctccaccctgcaatatatgtgtttatatatattttatatataaatgcctttgtgcttaatttatcaagaggtgatacactctagaaatgtaagcataaccaaaagtgattcattttgtagaaaacagtaacacttttcataacgatgccaccatctaaatattcatcaagagttcatcactaaaatccaccctttggagcaacatgtacaaaacagtattctgggaaagacacattacaacaaggaccacaggcaggacagatattc

SEQ ID NO: 239783 - DNA, 526 bp, Homo sapiens
gatattggaaagatagctaatctaccctgtgtggaaaagaatgaactttgcacaaagagaagttaggcctttgcttctgagagtattttaagcctttgtaatgtcctgcctgataagatggggttacctggcagcctaagaccatgccagatagtctatgctaacaatgtgattatggtggggctttaggccttgcaatatcaacccaacctctggaaggctggaagctaaggtggtcaatgggtggtcaaccatatctactggtagtcaaccatatctatgtaaccaagccccagttaaaaactctggacaccaaggcccaagtgagtttccctggctggcaatactctgtgcgtattgcccaaacatcattgctgggaggaattagcactgtctagagttccactgtgataggacaactagaagcttgcacttgcaactctcctggaccctgccccatcatgcctcttccctttgctgattttcatttcttacttttcactgtaataaaccataactgcgagta

SEQ ID NO: 239784 - DNA, 856 bp, Homo sapiens
ctttttgaaacataagtcagatcatatcattcccatactcctcctcaacagaaaaccctccaatggcttcagcatcaaggcccacattcacttctctgaccctctctcttacctgttttgctccatttcatcataattttctccttgtacttccttgaatacatcaaggcccttctatctcaggatgtttgcacttgctatttccttttctcaaaggctcatccctagatacttgcatgactggcttcctaatttcttgtaagcttttgctcagaagttactttaccaactgtcattgaggtcttccctgaacatcttaggtaagataacaagctcccctccttttctttcctcacttcttggtattccttatctcataactttttttttttttgagacggagtctcgcgtctcgctctgttgtccaggctggagtgcagtggtgcaatctcggctcactgcaacctccacctcctgggttcaagcgattctcctgcttcagcctcccgagtagctgggactacaggcaagtgccaccatacccagctaattttttgtatttttagtagagacggggtttcactgtgttaggatggtctcgatctcctgaccttgtgatccacccacctcggcctcccaaagtgctgggattataggtgtgagccagtgcgcccggcctctcataactttcttaattattctccatataccatctgaatactaatgtatttatttgtttatttctgaatgagactgatatccataaaaatgatctttccttgtatactctaactccctgctttctgggcgcttggcttctcaattaaaggctaatttaccagcttctcttgcatct

SEQ ID NO: 239785 - DNA, 522 bp, Homo sapiens
gaagcccagctgaaggttacttctaccccaaggccatgtcagcagaaagtggccaacaggacttgggcctgaaaaagctcagactgaattttaggagtgacatctgaaactgctggtttctcacaaggaataaaagctgtctgggaagctggagaggcagtgtgctgtctggagcagggacttgcaaatgggaacagtgaagagagacagcatctccttcctctgaagattctgttcagaatggataaaggttcagcatcctccctggatggggcagcttagcagacccagaggaaagcactgggaggaatgagaaagtagcgactagacaaaaatgaaaactctttaagaagcattgctgaagttacaggggaaaaagattaagacaactgaggttaagggcctgactccagatcacacagcaagggagatggcaaaatcaagatttcaacccaggaaacctgcctcccatgcctatgttaatcactacacccttcccacaataaataatcaaataagcta

SEQ ID NO: 239786 - DNA, 351 bp, Homo sapiens
ctactaaaaatacaaaaattagcctggcatggtggtgtgtgcttatagttctagctactcgggaggctgaggcaggagaatcacttgaaccggggaggcagaggttgcagtgagctgagattgtgtcactgcactccagcctgggtgacagagtgaaactctgtctcaaaaaaaaaaagattcaaattacttgggtgaggtggtaagtgcctatagtcctagacactcaggaggctgaggaatgaggattgcttgagtctaggaggttgacactgcagtaagctaggatcacatcactgtactctagtttgggcaacagaatgaggccctgtctctaaaaatatttttaag

SEQ ID NO: 239787 - DNA, 527 bp, Homo sapiens
ctgaatctgcccctagtaattactaataaggctagtaggagcattcttgttcaccttctgtgcatgcgctggactctaatttgaacctaggattagcactgcggcatcagaggctatgggggctgttcagctttcaaagataaagcagaaatgttttcaaagtggttgtaccaatctatactgccaccagtaccgaccacaattctctctaaatcctcgttattttcacacttcttactttttgctagtctacccagaataaataccatgtttttgtcttaatttgcattccgtaattactgataaggctgagcactttgaaatatgttattcattcatgttttctcttcctcttctaaggatgtgtgtgtgtgtgtacatatataaatgtatatataatgtatatatgtatatataatgaaacattcttttgttaattgtatgtgttgcagatatcttctccctgtttatagtgtgttttcaaataaaaaaattttttgacttattttgaaaaaatcaaccttaaa

SEQ ID NO: 239788 - DNA, 1178 bp, Homo sapiens
ctggctagaagtacagttttacatctcatgttaagtccagtgaatttttctcctttaagaagaagggaaaacatttcaaaattgggtctaacttatttagtctttctgtctctgcttctttcttgtaattgtgccaatagaatactccaatttttggtatttaaaaaactaatctttgtttccatactttttagtaaaaactgctttggatattttgaatatttttacttctaaaacatgggcttcatttaaatgatatatttaaaatatttctacaaaacatcttatttaaatatattaatccaaaatccgacacttcttcatcatggtcctggggaaggcatggagacaaaattcaatagtgctaagaatccaagtggagtcactggccataatacttcacttagctatttacataaactccagtgtcatgcaagtacaaccaatggactaactacagctggtcccaattgtacaacccaatctcagtgaactgggaagactcagcactgaccccagaccctccatcactgtagaaatacttacacagctacaagtgaaacctcttcactgatagccccttcgaaagggtgcattgttgccagactacagtctccctgcccactttccaaggaataggcaatgcacatatgggccagctgtaatgagttcattagttgtgcgtgcattacaaaggaggactcagagtctctcctccctgaatgtgaattgcaagtgccattgccctcagggatggatctgaacctggaaagccaccacacagaatgcatctggagcgaatgcactgtctgcaagctttgatacaatcatgcaatcaactaacttaatcccttgattttctaagttttcttaaaataatctaaaattccttgctgaaattctaatccagctctatggagcaagacttctttggtgcttaagaacagtctgatgggctggaagcaggttatttgaggtaacctcaatgtagataacaacattaaaaccttagttctccctagaattttgaactcttaaaatgatccctactacaactgttcagttaagtatgaaatttatgtgttgagagatatctaataaaagtatgtcttttcttcataatgatagtcacttatactataacattaaatatgcattctgaaaaaacaaaataaacc

SEQ ID NO: 239789 - DNA, 614 bp, Homo sapiens
tgcccactttccaaggaataggcaatgcacatatgggccagctgtaatgagttcattagttgtgcgtgcattacaaaggaggactcagagtctctcctccctgaatgtgaattgcaagtgccattgccctcagggatggatctgaacctggaaagccaccacacagaatgcatctggagcgaatgcactgtctgcaagctgaggctctgaggaacagacaactaataaattgatcaaaggcacttccattttctttgatacaatcatgcaatcaactaacttaatcccttgattttctaagttttcttaaaataatctaaaattccttgctgaaattctaatccagctctatggagcaagacttctttggtgcttaagaacagtctgatgggctggaagcaggttatttgaggtaacctcaatgtagataacaacattaaaaccttagttctccctagaattttgaactcttaaaatgatccctactacaactgttcagttaagtatgaaatttatgtgttgagagatatctaataaaagtatgtcttttcttcataatgatagtcacttatactataacattaaatatgcattctgaaaaaacaaaataaacc

SEQ ID NO: 239790 - DNA, 449 bp, Homo sapiens
ccaagtcaggacacggcaagaagatggccatctgtgaaccagaaagagagccctcagcagaactcaaccatgctggcacccggatcctggacttcccagcctccagactgtgagaaataagtctctgttgttcatgccaccctgtctatgggattgtgttacagcagcccaaacggactaagatgatggcactgatgtcgagtctgtgtgcagcatacccatattgtcctgtgttacagattatattttccaaagatggctgcaacaatatcttgcagcatcccacgtgtgctctccttacagggtaacgctgccatccctcccattaaaggggactcgaagtccactctcctcgaagacggagggcctctgtgacttccttgaccaagagagttggttgaaagtgatgctatgtgatttatgaggtcataaaaatacatatttctatc

SEQ ID NO: 239791 - DNA, 380 bp, Homo sapiens
gaaatgttccaggtctgtgaaatgtcaaatctgacaacagcttgacaaaaattaatcaagagaacaacttgacttaatggagagtgcacagtgttttttggctcagaacagtggctctccaagtgtggtactctaaaccaatagcatcagcactaactgggaacttgttagaatgcaaattctcaggctctatctcaggtctactgaactagacactggggggtacagcccagcaatccgtatttttaaaaagcccagccaggcatggtggctcacacctgtaatttccaacactttgagagaccaaggtgggacgattgcttgagcccaggagttctagagcagcctgggcaacacagggggaccctgtctctacaaaa

SEQ ID NO: 239792 - DNA, 509 bp, Homo sapiens
ggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaaca

SEQ ID NO: 239793 - DNA, 195 bp, Homo sapiens
gaatggcttcacagtatttgagtaaaaagagaagagtgttgggctcctgacagaagcttggagatttagaggaagagggggaatcaaaagaggaagatggtaagggagtaaagtagtggagagagggaggagtaagacccaggaaagcttattgttccagagaccaaaggaggaaggagtttaaggaggcaagga

SEQ ID NO: 239794 - DNA, 499 bp, Homo sapiens
tcaacagataattcaaataagtatatatgtgaacaataaatattagaaaacacagaaaccacaagaactaatgagatgcaaatattttaaaatcctgagaatttataataattggaaacaacaagatacaaaagatgaggacgtgattgcacatttggaacagacaatatgtgtgtgtttgtgtgtgcgcgtgtgtgtgtgaatgtgttcatgtgcacctcacaggagcacatctggagagtatgcaccatcctagggacagtagaccccttggaatcaaagggtgggagttggaccagtgagagtgcagattaatttcaatttatgaatgtactcatatattgtttaaaattcagtatttgggaatacaaatattttgataaaaatttgaacacaagatagttttgaactgattgtcaaagataatatgcacatattttcattaatttgaaaaagaattcattgtgttatattatgaaagaaataaaaaatttaattg

SEQ ID NO: 239795 - DNA, 972 bp, Homo sapiens
atcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagtcattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaa

SEQ ID NO: 239796 - DNA, 541 bp, Homo sapiens
tacagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagtcattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaa

SEQ ID NO: 239797 - DNA, 734 bp, Homo sapiens
cagcatggcgcctggcacctagggaacaccagcagccaccgccacagcacccatccaccacgacaccaattacccgggcatagaagagccacaggagttagaacccacacttcggctcacagtccccaccctgctgccacaggagttagaacctacacttgggctcgcagacccccccgctgccactggtggttatgagacctttgggtgtcaccaccacattggaaatgagtttttttttaacctgtaaaactaggctgattttgaattccagggctagtcctgagaattaagtgagagaatacatgtaaagtcgtgtaactggagaagttatatgcacttgctgggtatgactacaggactggcatttacggattgtttatagaggtctgggcattgggttatggtttgggatttgactgtcacttgacagccacggccgctgtgaatgacagaaatgaggttcttgacccttccttaccggtcagctgtatgcagtgtggtggtattgtcctagatgttttgcataacagacctgtcatcatacagatgaggaaactgaggctcagaaaggctaagccgcttaaccagaagtcacatagctactaagaccaagttaggttttgaatctagacttctgactcctaagctcaccagatcttaacctacttggaacccactgcttggtagtgaattataataaaatattaactgtgtttctaaccaaatcagtg

SEQ ID NO: 239798 - DNA, 929 bp, Homo sapiens
ttaagatgggagagatgaagagtgttgtttctccttggtgacatccccaagcaacctcagatatgctcttccttggggcctctggttttgttgctaaattgtccttgttgagacagttgggggggtgtatatttcaggctgcatgccaaccaacacactgcccagggacgggatgggaaatgaaccacacacatctagttctcctggtcactgttgtactgctccatcctgaacaagagagtgtggaagagtgggtctacaggtaagccattataaccaaactaccctcacagtttagcctcacaagggatcctttatgctaagaagaatgcccagctgatggggattaacaagaaaagcagaggggaggggggtcgctggaagcccaagagaaggaaattttttaaaaaatacaagtttcctgtcctacacaagcagtatgaattttgttatcccaacgggagtcctgatggtaaaatctagtttcaaagtaggatggggaaatggatcaagccttaccatggcaaagctgggtgggacctcctaggcgtctgtgggaccttgggctctccggatactgtgtcttggtttggggactattttcattctgtctcaagcctaggtttgtagatgcccttggccatgatacttactagctgtgtgattcagtacagaggacaagccccactttattcggagttaacctatggtgcagtggccttagaaaaacttaagagtaaaaagctaccataaaaaatgctggttatatgtatgaccagacggtcaactcctccttcttctctctctttgctataacagcacctgttggcttctaagtgcacagagttctcacaacaatgtgccaaaaccgccacccttcccatcctggcacccacctccccccaccccaggagacctgcatatcagat

SEQ ID NO: 239799 - DNA, 398 bp, Homo sapiens
gaaaggcagacattacatgttctcacttatttgtgggatctaaaaatctaaacaattgaactcatgaacatagtaagtactagggggctgggggggggggagacagggcacgggtaatgggtacaaaaataggcagaaggaatgaataagacatactatttgacagcacaacagggggactctagtcaataattgtacatttaaaaataactaaaagaatctaattggattgtaacacaaaggaaacatgcttaaagggatggataaccactctccatgatgtgattagttcatgctgcatgcctgtatcaaaacatctcatgcaccccataaatatatatgtttattatatactcacaaaaatgcttgaaaataaaaataaaggaactactgaaggt

SEQ ID NO: 239800 - DNA, 312 bp, Homo sapiens
aacaagtgacagtgtttgacagaccttatatctcctttctatcacaccaaaatctctgtagtgagctcaggcaatgttttgacctgctggtgtgctgatgcacttcaggataaaaagaattggtccacattgtagcaataacttccaggaagaaacgagtggttgtggagctgataagtggtagcaggttgactccaaagcctagcgtcttaacctctatcatacaccgtttctcaatcaaaatggaagaaccattttaaacacattaaaccctagtggctttaaataaacacatggccaatgagttatcaa

SEQ ID NO: 239801 - DNA, 387 bp, Homo sapiens
ccacccacctaccccaccacttcaaacccgcctctctactttgtcacctgagtgaattgcaattctatcctgctgattgatcaagccaaacaccaatgagcaattcttgactctctcccgtaatctattaatacatgagatccattggcaatttctatcagttttaccttcaaaatttatccaaaatctgaacacttctcactttctgcactgccaccatcctggtgagcccaccatcccgccattgacattgccccctctcatctcaatgcaagaggtgggtttgaatggaggttcaaactcgcattagacctgtggtcctcacacatttggtctcagaatactttcttcccttagaagtgagcgactggagacccctaaaagctc

SEQ ID NO: 239802 - DNA, 382 bp, Homo sapiens
agcaatcctcccattttagccttccaagtagctgggattacaggcatgcaccaacacagccaattaaaaaaaaaattatagaagtgcagtcttgctacgttgcctaggctggtctctaacttctggccccaagcaatcctcctgtctcggcctcccaaagtgctgggattacaggtgtgagccatggtgcctagcctccccatcttgataaattagcaaatatggtccaacagaaattacacatgatttcaaataaataaaacttattatataagacctaattaattagtgaaggggtgattatcctcattgcttcaacatttagcagtagaatttggcctgttcttaaacctgcaaagaataaatggtgtttcacagtgga

SEQ ID NO: 239803 - DNA, 384 bp, Homo sapiens
gcatgtgttattcttttggctcattgaaactaaaggttccagagcaggcctttgtgggtctctggataggtcacaggcctctgctgtccagtgcctcttgcaccattctctactctgtaccacacagcccatttcaaacccccaaaccttttctgcctccgaaagagtttgtgggcatggtctttgacctaccactttgttgtcctaagaatctcttctgcatggacatttacctcatttaaatagactgattttgatccttgctctaaaattccctctgtatctgagatatgggcacttccctatttgatatgatatatgtccattagcataaggggaatcagctatgagatcctgagtataaaacaccagggatcggcttgg

SEQ ID NO: 239804 - DNA, 540 bp, Homo sapiens
ctgattcagtaggtccggggtgggtcccaaggatgtgcatttctagcaagttcccaggtcacatgatattcctcttctgaggaccacacctggagaactaggaaggtaagctgagtgaaagtaaagtcagtctatgcttctgctccctttcttcctgtttatgaggttataagaagtttgtgtctgattctcctctatgtccttccacaatgctaactcacccaacaagaatactagaagaacatcatttgctgtgtaaatgataaatagtctgtgagcatcagaagtgtttttaaataaatcaggcaatgaatcccatcaggctttgaatgagttctaaggagtttgccactattttcagtaggaaaatagacatccttcaaagaaaatgtatcctcaaattcagttgtgctactcattctaacagcatttttaaagcctttgcagttattcctctttattatttttaatgaagtcaagtcataaagtttgtggaacagggaaaaaaccttgagtctgttaggatagggtaatcagatt

SEQ ID NO: 239805 - DNA, 694 bp, Homo sapiens
cagaagcctgcagggccagacaggtaacttaatggaggggatggggccggatgtgcagttaatgagttggaggatccatgtccagtctaagaggcagccccctgttagtgccagctgagtcatgaagaactgtgaatcagtcagacttgatttttcaagcaaagggagatacccagatttttgtgtaagctcctccaaagttttttctttctttctttctttttttttaatgttggacaaccagtgaaaagcaaaacaaaactacagaccaaaacaaacgttgctgcctgctaccagtttgcaatttcttatgcattccatgaaactgactagttgacagtcttttcagattgacagtccatgaacaggaatttgctaatatttctaagactcagaccttggcagaaagatcggaaagcaaggtagaatttggagaccgggttttataattgtaagatctcacttttgtgaattgctgattagaattcacaaaagttagatccatggtgcagtgcctcttctctcatctctaagtttaggaagccctcagcaccttttgaactgtgtaacctgacaagaaagatgtctggggaattagcaagttctatttttgtttggtccagtgaaaattctggacaggccacaaacacattctagggagtctagaatagactcccttgagctcttttaattc

SEQ ID NO: 239806 - DNA, 599 bp, Homo sapiens
ttcaagaccagcctggccaacatggtggaaccctgtctctattaaaaatacaaaaattagctggatatggtggcaggtgcctgtaatcccaactactcgggaggctgaggcaggagaagcacttgaacctgggaggcagaggttgcacgtgagaccgagatcgtgtcactgcaactccacacctgggtgtcacagtgagaatctgtttccaaaaaagaaaaaaaaaaaaagagaatcccaggaaaaataaagagacccaaatgttaggtgttggaattaattatatgacaccctacaggtgtcagcctctgcatccctctctctttcaaactccatgcagagtatcttatgtattgagacttttaaaaaataaataaataagatccttatatgacagagatataatctaaaatcccttgaggacgtattctttgccattatttacaaaggtgactcttttttcttgatataaaatgtaaggctgggtgtggtggctcatgcctgtagtcgcagcattttgggaaggcaaggtgggaagatcacttgagcttgggtttgagaccagtccaggcaacatagagagatcccgtctctatggg

SEQ ID NO: 239807 - DNA, 654 bp, Homo sapiens
gacacaccaacaaaaagattagaaaacaaataggatgaactgttaaaatgacagtaatatacagcagctataaagcaaagtatggatgtcattaagtcacagaaatatgttttgaagttaatcaggagctaaaattataagctgcatagcaaggtcctgttagaaaggaaacagacaaaaggagaatgctggcaaagtgagatggagtctgagccgccaggcatccgagcctgattgaggccatggaggtgggtcatggcaccttgcccaagcacttctgctctaatgacatgagtacatgaagttctttgtgaaaaatagggccgattgtatttaacttaataacttgaattatattctttgtgtataacttttcagagaaggcagttttgctttggggactgaaaagcccgagttgtagtttcaatgtcaatttatttcatcaacactagaaactaatatattaactaaaataaagatgccaaaaaatgtatttcacgttacaatgtatctttagcactttcttaggaatgagtagattcatgacacaagattatctgatctagtaatatattctattcctatatttaatgtgttttagaggcaactaccatttaaggataataaagttgtttcttttggctccttaaaaaa

SEQ ID NO: 239808 - DNA, 427 bp, Homo sapiens
tcaggttttgtactcattgtggggaagtgaaaccaagaagtagttgtctccagtggttgaagtctcctattttcaagcgttccctgtcgtggatttggcacttgcagctcattcaaggcaaagtttcaagaatttaaaagtgtaggccgggcttagtggctcacgcctgtaatcccagcactttgggaggctgaggcgggtagatcacctgaggtcaggagtttgagaccagcctgaccaacaaggtgaaaccccgtccctactaaaaatacaaaaattagctgggcgtggtggtggacacctgtagtcccagctcctcgggaggcttagacaggagaattgcttgaacccaggaggcggaggttgcggtgagccaagatcacgccactgcactccagcctgggcgacagagcaaatactccgtctc

SEQ ID NO: 239809 - DNA, 317 bp, Homo sapiens
tacttcagtcttgtgaccagtaattttaagggaaagccaataataatgtttttaaaaagcctcacgccacccctggcggcatctcctcggtgtactttgctgttcagatccgcctgccttctgtgccagcctaacagcgcccggcctcagcccccattgtccctggagctggcgaggtgtccggttgcggagccggcggcgtctctggaaatgcatcctgcatccccgcatggataacagctgcagctatgtcagaattgcacaaagaggggagagtgtcattgtgtgccttttgacacatacattaagaccaaaaa

SEQ ID NO: 239810 - DNA, 475 bp, Homo sapiens
catgcccaccttactttcttattcattgcatttataccagggcaattgattccaatgaagggcattcactggtaactccatgaaagcgtcttattcttcttgcagtgtgggcttattcttccctggactagagtttctcaattccactgctactttcccagatctgttatgcccagaagatggagggctgccttccagaagagtggccacctcccaaagctactgcctatcaagtgatgatttaagaggtgccctgaatgaagtataattctgtagtgggctccatgtgccttttgtgggttcgagttccatgtcgtgcaaaagtgaaaacattcagcatttgtatagcaatgaagatgactctggagaaatcacactgtgttttccttttcctgcaaatgtctttctctgtttttacctccctgtaactgcaatacacagttctcgttacctaaataaactgagatatggtctg

SEQ ID NO: 239811 - DNA, 283 bp, Homo sapiens
gccaccatgcccagcctataaggtcttttattaaggcaggcttacaaccaaagtgatcctaaaaaaatttttaaagcctctaccaaaaagagggaggctcagcctgagagaagactcaccagggcagaagaggcgagccgtgaaagtggagagctcaaagggctcctgtaagtgctgcatactggtaccaagaattgccagctctgtccaaaactgatcctacttcaggtcctgcttccagacgctatttatgtcaccctaaataacagagaggctctctcta

SEQ ID NO: 239812 - DNA, 646 bp, Homo sapiens
gaaatggagttttgctctcgttgcccaggctggagtgcagtggtgcgatctcggctcagtgcaaccactgcctccggggttcaagtgatccgcccgcctcagcctcccaaggtgctgtgattacaggcgtgagccactgtgcccggcctgatttaatactttttaatggtatcatagctactttatgacatttttcttattactgttacgcaaattctgaatgaaacttttctaaaaagctgcacaacgggcccttctaaataataatgctaccttaattgttagtgtgcagctcaacagatccgaagtttccccatcaccctatagaaactgagcactattttttacatcccttttcaaaacaatagatgaggtaagaatttgaaaattcatagtttgttttcaatatgaataaaatttgtcccgtttttaagttgtattttcgtaatgaaaatcttagctatatcattttcttttttctctccttgttccaaactttcaggtttgtgtttaatgtctaagaaaggaaatactagaactttcaatttagttaaaaaacagtaacatcttaagtgtgataaaccaaacagaaatgtctctatgtttggcaaagtcacattccccagagatttactaaacagcaaca

SEQ ID NO: 239813 - DNA, 736 bp, Homo sapiens
atgtttatgtagttaaaattttaatatttgccaatcacaaaattctaaagaagtctgattgggctgctgcgttggatgtaaatgtgaaatcaccgtcatctgtttatttttgttcttttacttttctaattcaaagtaacaaagtgcacatgcattgtttttaccagaacatttttgaaatgaaattttgtgagaaattactgagaatgaggattttttcttttgaaatttcctaagatatatgataaacaattcttggtaattgattgctatatgtagaaccctaaattgtttcactgaattacaccagtgtgggttttataaaaaagtaaaggtagttttgcttctgcttttgaattctagtaaattatgttatgactaaagagtgacttgtcactaaaattgtcaacatgcattattgaatgttgtgtgctgttcatatggataaaaatgtcatgatctggatagatgtgtgggcacgttggactatgaagtaacctggccgttgttgtttcagaatcttagattgtcatatttatgtatttaactgttagtccttcagagagtttgataagtaacgtgaagggatagataccacaaatttgtagtagtttaacaagtttgtattagtttagctatatagggttttgtttttttgttgttgtcatatattgtttgttggaataaaaaatgttttatttaggtatgaattacttggaataaagtttaccaattt

SEQ ID NO: 239814 - DNA, 306 bp, Homo sapiens
atattttaacatttttatcatttcagctgttctcatgggtacagagtaatatcacattggttgtggttttaatttgaattttcttaatgactaattgaatttaaaatttttttgggctgtttggatattctcttgtgaaatatctgtgcatgatttttgttcatttttcttttgggaagtctcccttttgatttgtagttttctgtgcactttggatataatttttttttcagatacatgtattatgactatcctctcactctgtggtttgccttttcaattccttaataatacatttgataaaca

SEQ ID NO: 239815 - DNA, 436 bp, Homo sapiens
tactgtatacatggtgctttgccagacactgattgtccaaaggggagtcactgtgattcccagctccgaggtggactatatgtataggcacgaagagttagctcttcagacttctcatcactctccaaaggccttggattggtaggttgctttgtagcttccaaagcacttctatatatgttcagtctaagtgaaaggaagagcccagcacggtgagtgtgggaggaaatgtgaagagtgccctgagcatcaccaccacggatgagtcttgcctgaatcaattactgggatgagtgtcaaatggttttccaattccatcattccttctatgtctatttagttggcatcctactgcaagggagagctctcccttctcccccatgtagcgatctacttgtttatatttgtataaacccagattcttattttattccat

SEQ ID NO: 239816 - DNA, 477 bp, Homo sapiens
gagagagagagacaaagaggcagacagagataatcacttatttgtttattccacaaaaactgaacttcgtctatgtgaagcaaccctcttcctcattctaatctctaatcctttatctgcttagggctaaaacaccaaatcacttatgttaatactgaaaataaagaaaaagtaaatgggttctactaaacatatcactattataaataaatgtaaatgaatttaagtgtctgttaaaaggagctttatatatacttattcatatatacaacagattactcagccttagaaaggaaattctgatacatgctacaatatggatatactttaaggacatcatgcttcagtgaaataaactagtcacaaaattcataaatggtggttgctgggggctgagaagggggaactggggttgtgtaatgggtatagagcgtcagttctgcatggtaaagagttctggaggatggttgtacaaca

SEQ ID NO: 239817 - DNA, 497 bp, Homo sapiens
cagtgagttgggataaatgaaacgtggatctaccatagacgtctgtccgtcttactggataagcgagcacctttaccggggaagttagatggctggagtcagctggcaaatacagaagcaggaaacattacactgaagctcagaaaataatatccccaaatgaaggcatcagaaataaaagttcttctctgaccttctttctctcaagacattgtattatgaaaaatttccagcatacagaaaagttgaagaacacccacatgcctgctactcagattctacaataaacatttgctatatttgttttacctacatatctagtcatccatccatccattcatattatttttaatgcacgtcttattttttaatgcactgtcaactacagacatcagtactcttcacctccaaacatttcagcaacatatcattaacgatagtcaaaaatttgtttagagttccttttgttttaaataaaatttataaagaatgaaatg

SEQ ID NO: 239818 - DNA, 432 bp, Homo sapiens
atcttcacaaaagtttttcagcaaagaccatgacgactcctcattttcttgtgaaaatggttgcatgggatgctagaagtgaaacttgcttttgcaactgaaatgtgtatcatactatttgtcttcggtagccaggacactgagtagatgtaacgttgcagagaattttgcatgaagcctttttattgctattttttagaaatcattttggagttttgagaggctaggcagcaatctataaaggttgcttattaaatgacttcctcatcatcctaagaaataatcataaaagagtttaaaaattccttttggccaggcgcggtggctcacgcctgtaatcccaacactttgggaggccaaggcgggcagatcatgaggtcaggagatcgagatcatcctggctaacatggtgaaaccccgtctctactaaaa

SEQ ID NO: 239819 - DNA, 343 bp, Homo sapiens
gcttcaagttggggttcccatgaccccctctctgggttcagttaatttgctggagtggctcacagaactcaaagaaacacttaattatatgtactgttttgtcatgaaggatattacgaaggatatgaatgaagacatgtatagggcgaggtatgggggaaggggcatgaagcttcatgcacccccttgggtgcaccaccctccaggaacctctacatgtgcaggtatccaggagctctctgatccctgtcattttgggtttttatggaggcttcattgcataggcatgattgacaactgtgtagaaatgtgattggacaaaaaaaatttgatttaaacccgg

SEQ ID NO: 239820 - DNA, 2363 bp, Homo sapiens
  misc_feature (663)..(663): n is a, c, g, or t
  misc_feature (930)..(930): n is a, c, g, or t
aatgagaaggaaccggaaaaacaattctggtaatataagaaaacaagcttctttaacacgcagaaaagatcacactagctcaccagcaatggatccaaacaaagaatacatctctgaattgccagaaaaagaattaagaaagtcaattattaagctactcaagaaggcaccagagaaaggtaaatatcaacttaaagaaatgttttgttttttgtttttttgagatggagtctcgctctattgcccaggctggagtgcagtggcgcgatctgggctcactgcaagctcggcctcctaggttcatgccattctcttgcctcagcctcccgagtagctgggactacaggtgcccaccaccacacctggctaattttttgtattttttagtagagacagggtttcaccctgttagccaggatggtctctatcccctgacctcgtgatccactggcctcgacctcccaaagtgctgggattacaggcatgagccaccacgtttggcctaaagaaatgttttaaatgatacagtgtatgaatgaaaaaatctccagaagaatagatggcataaatttaaaacaatcacaacttctggaaatgaaagacacatttagagaaatgcaaaatacacgggaaaaactcaacaataaaatggaacaagtaganagaacttcagaacttgaagacaaggcttttgaattaacccaatcaaacagagataaagaaaaaataattttaaaatataaacaaaccctccaagaagtttgggattgtgttaaatgaacaaacttaggaataattggtgttcttgaggaggaagagaaagctaaacgtttggaaagcatattggagggaataattgaaggaaacttccctggccttgctagagatccagacatccaaatacaagaagctcaaagaacacctgggaanttcatctcaaaaagatcattgcctaggcacatagttctcaggttatctaaagagaagatgaagaaaagttcttaagagctgtgaggcaaaagcatcaggtaacctatttaaaaacaccttttagattaacaacagatttctcagcagaaaccctaaagcctgtaagtgattggggtcctatttttagcctctttaaacaaagcagttgtcaggcaataattttatatccagcaaaactaagctttataaatgaaggaaaggtacagtctttttcagacaaataaatactgagagaattcaccactatcaagccagtattacaagagctgttaaaaggagctctaatcttgaaacaaaacctcaaagtacaccaaaatagaaccttcttagagcataaatcttacagaacctataaaacaatagcacaatgaaaaaaaaacctagcacaatgaatagaatagtattctatcacatctcaatactgacactgaatttaagtggcctaaatgctccactcaatagatacagaacagcagaatggataagaattcatcaaccaagtatttgttttccttgagagactgacctaacacatgaggactcaaataatcttaaggtaaaagcatggaaaacaaacattccatgcaaatggaaaccgaaagtaagcaggagtagctattcttatatccgaaaaaaaagacataaaacaacaattaaaaaagacaaagagggacattatataatgataaaaggattaaaccaacaggaaaatatcacaattggaaatatatatgcacctaacactggagctccaaaatttataaaacaatgaacactaaacctaagaaacaagatgggcagcaatgcagtaatagtgagggacttcaaaactccactcagagcactagccaggtcatcaccacagaaagtcagcaaagaaacaatggacttaaactataccctacaataaatggacttaacagatatttacagaacattctacctaacaactgcagaatataccttctattcatcagcacatggaacattcgccaagacagactacatgataggccacaaaagaagtctcaacaaatttttaaaaatcgaaattatatcaagtactctctcagaccactggaataacataggaaatcaacactgagaataaccctcaaaaccacgcaaatacacggaaattaaataacttgcttctgaatgattgttgggtcaagaataaaatcaagaaggaaatgaaaaaaattgactgaatgataatagtaaaaaacaaaacaaaacaaaacaaaacaagaaacctatcaaaacttccgagatacagtaaaagcagtgctgtgaggaaagtttatggcattaaatgcctatatcaaaagtctgaaagagcatgaatagacaatctatggtcacacctcaag

SEQ ID NO: 239821 - DNA, 348 bp, Homo sapiens
caaagaaaagataggtaaattggacttcatcaaaattagaaacttttgtgctgccaacaataccatcaagacagtgaaaagataacccacaggatgggagaaaatgtttacgaatcatttatctgataaggttctggtacctagaaatataaaggactggtacctagaaatgtataaaggactcttacaactcaataacaaagagataaataaccagattaagcaacggggctgggtgcagtggctcacgcctataatctgagcactttgggaggccaaggcaggaggatcacttgagctcaggagtttgaggccagcctgggcaacatattgagactccatctctac

SEQ ID NO: 239822 - DNA, 856 bp, Homo sapiens
tctccttcctacaagaggatgtcgccttctggatccacctcaagcctactcagggagctgctcagcttcctcaagggcctggagtagatggtttccatcttctcttttgccacctgtggagagtttttaagagcaaacagaaattcaagtgaattgtcctcctacagttactgacgaaactattacagctacttctgattatccattcaggttaaatcaggcatcatttcagtcacctccaggtattaatgtgtatgatataaattggaaagtcaagtcctcctaggagatgactgtgcttctgcacaattccattacatttgcagtctctgtcttcctgtactgcattgctgtcgtgctttatgttggttacaggaacctatatcagggtagtcataaacttcccatgattggctttgtcattactcttgttgccatcttttgcgattggtgagcacttcaaaagctcgcttgggcaaaacctcttgcagatattaaaataactactggtcaaaatattgttcaggaacttctgcttgtaagaaatcataataatgtgttattttggctctgtgaccagcatgggattcctaaatgtatctgtgatctttgtctttctgaatatgatactttggaggggaaatgcttggcgtgtgtacaagtatgaggagaccaacttacacaacccatcaaatacttatgctcctcatagccaaggaggtattccacctcctgctggaatgtaattaaagggagaaacacactgtatgaaatatatgtctatatcatgacttgttgccaacatcttgaggcacattatttgtttccaataaaagtaatgttttttttttttaag

SEQ ID NO: 239823 - DNA, 332 bp, Homo sapiens
gagttcatattgtcaccaccttttggaagtcttctgtgattgcccctagccaaaaacagcatttccttcctttgacctcctctagcacagagagcagcggctaagagcttgggactcagtttctctacctgtaagatgagaaagtgaggactaagtgagatgatccatgtaaagctttagcacagtcctggcacacagtaggcactcaataagtgtcagctattcattatggtgctgtggtctctcccctgccccacagctccttcaggctatggcacacagtaggtgcccactgaatactcacccaggtgaccagcaggtggccccacacc

SEQ ID NO: 239824 - DNA, 207 bp, Homo sapiens
caaggtgtctaggtgaaacagcattttcaggaaaaactgctgaggcatttgtttataaacatctttccgggggaaaagaaaaagtttttctttctttcttggtagaactcaagttttttcatgagcgtgacatagtcatgaaagattgggaaacaatattaaacactattgtgtagaactaccaagtaataaatgactttgttctta

SEQ ID NO: 239825 - DNA, 309 bp, Homo sapiens
tatagttaccctatttatttggatgtgagtatttggaaagatttaaaaactatgctgctgccaccatcactaaaatattttctgtttcttttaatacatcgctttccaagggggaaagttttttgattcttcagagttgtgtttctcttttactatagagttaaaaaatacagtggcttgcttgttgaactctgcatctcccttccacacttatataaccttttcttgtatataaacattaactttgcataggccctgtgatttttgtcctgtctcccttccttcctctcttaaaacaaaacaaaagct

SEQ ID NO: 239826 - DNA, 479 bp, Homo sapiens
tgagccaagatcacaccactgcactctagcctgggcgatagagcgagactccatctcaaaaaaaagaaagagtttaattgatgtgaggccagccatgctacatggaagagttattactcaaatcagtctctcctcgcatctgggggctagattttttcaaaaatagtttggaggaaggggtggaggtggctaggcaatgggtgcttgctgccgattggtctgggtgcaatcacaggggtgtgggactcatcctcctgcatgccgagtggcttctgggcgggtccaggaggagccatcacgttggacttgcaaaaaacctgaaaagatatctcaaaaagccaatcttaggttctgcaatagagatgcaggagtaattggagaagttgcagatcttgtgacctctggaatgatggctggcaccttaccagaattcagactcctcacctcctcctagcctggtagggtctctcattagctta

SEQ ID NO: 239827 - DNA, 825 bp, Homo sapiens
gaagtaacatcttcctgttcccagaataccatgttttcctacctctatacctttgtacatgctgtttcttctgtatctaacatctttcttctctttctctacttggaaacattttattccttcatgaagacatcagatatcacctcttaatctccctagggaggtttttcctagagctctcaaacattccctctcataatcataggtacagagctcctttataacatttatcacatgggaaaagggattatcatatattttttattctctaacctataatggtctatggacttcttgggggcagagacctctaaatttgttcatggtacatttttttttttttttcagaaagcacttatagtaattctaattcaccccacctaagacagagatggacatatcataggctctgcataaatatttacttaaaccaaataaccttataatctactgtgtcattagtagacataccaactcactagagaagggagatcacataaaatctggaagataatttgcttgctgggtttcaccatctctgttatttgttcagttatcaaaggaacagaaattgaaaacagacacaaaaaagctatgcaacccacaaatctactatgaaaatgtgtattccatattgatgagctgtttcttaactaaacgaagtgaataggtatagatctgcataatataataagcttattatctcttggtcaactggtttgttgtaggatcccaggcaaattaatcactctcttcttttgtattactccagaaccatcaaataacatagtgcattctacaaaggcagttttaaggaataaacaa

SEQ ID NO: 239828 - DNA, 555 bp, Homo sapiens
cagggctcttgtgtggatatggagtaggccgtagaattcttggcacatagtaggtgctcagcgtatcaatcatagccattattgttatttcaaatttcagccaaaaataatcacttgagctcttagtaggtgacagttggattaaggacattgggactgtatctggttcaatcagggatgacttcctgggggaggaggggcttgagctacttaaatatatgtgggaagtggggcagcattgagttagagagagggctgtgtgcagaggccagggagggattatgcctgtgtgcctattattagtaatgatattacttatttccatattatagacaaagagggagagtccaagtaacttgtccacagacacatagctagtaagtgtagggtgttcacatggaagggatgggcagaggaagagaaatgggaaaatgcaggaaactgggatagttctgtgggaggagaagggagaaaaagaatgggctttgtaatcagaaaggctcctgaagagagggatgtgggggatttaacaggccagccattgccctttactta

SEQ ID NO: 239829 - DNA, 825 bp, Homo sapiens
acaaacatctttcaagaacaaaaagcaagcatgtttggtccattcatgaatccttgtacactgattgttcgggttctttcagttcccatccacttagaaataacaaacatgtttcattttgagcctatcctacagggccgcaaatccggagcctgcagtttgttctcttggcctggggccaggttgcagatgtttgagtcccttggatccctgagtggctgcgtctcccagtctggtgctgactcatggtgcagccagcatgcagcctgcccatcggccaggtccctgcaggtttctgagtctcagatggtggatggcctattcagagttcacagatctgcacctaatagactttcctctttgtccctctttctacccctaaagtacatgtgaggggaaaccctctgcatggtgcctagcacgcagtgaacactcagcgttcgctgtcagtggtgtgttattattattcattaccattaggatccttgcacaaactcatcgcagttgcctatttattttttccaggaagattactcggaactgcttaggcacatcacaccagggcggactgatggagagcaggaagatggggtattcatctgtcccctcttccacatgctccttaaagacaagaatcatctgattagtctccgtgttccagcaaccccctgggacccagcaaccggtaattaggcaaggaataagcttattgtatgtttcacagtttttcaaagatgatttgggagaatcaaatcataccatcatcattccaccaatcaggactcggcactctgacagtgcactttgatgtttaaaaaaaacaaa

SEQ ID NO: 239830 - DNA, 514 bp, Homo sapiens
cacatagtttttctcctgagtccattgggcaggattgggccggattgggccaatcacagagggatggaggggttcccagagatgggtctgctctggcccacactgcagctcacccctgtccactctgtgcgggggccactggggaactagacgaacagcattcaggtcactgtggctcacagacccgtcgccccactccgctcgtccccagcagcatggagggagggagagctcccgtgcgctaattggctgagctatttggaccaattgctaatcaaaggctccaaagccctgggtgctgtggtgctgggctctgaagctgaggttcacaaggtatgggggacctcagtctgagcatcaggttggctctcattctcaggaggggacctgggccaccttcccaacccccacatctctgttgcctcctattatccccgtaacctttcagtctccattgccaaatgggggggttcaagaccagcctggacaacatagtgagaccctgtctttaaaa

SEQ ID NO: 239831 - DNA, 368 bp, Homo sapiens
atgcccttcagcagaagggatagttaggccagcccattgtcccaatattcactgaattaagaggaaaaagaaaaggtaatgaacattatgagaaaagattagggaaacagaaaacagacccaaaagacccagtgtatgtgtaacagaaatttcaaaaatagaggctgaaacaacacagatggaagagaaaaaataaatagaacaaaaatttgcagaccaaaataaattcttgagtctttagtttgaagtacagtgctgtaagaattaaagaagaatcatacctggaaacatcctgaaaaatattcttaagtttgtctttgaatacagacaaaaggacataaatatcttttagtaagaagttgcagagg

SEQ ID NO: 239832 - DNA, 628 bp, Homo sapiens
tgccctatgtaaatcagaagctgccttctcaagctcgtctataaacccctgccccaccccgggcatttcaccacagaaccggaagacccactcgggagcccctctctctctgtaggagagagagcttttttcttttctctttgttttgcctatcaaacctctgctcttaaatgcattccttgtgtgcatctgcgtcctcaatttccttggcataaggcaatgaaaaacagcaccgcttcaatatttggtaaatgaatgaatttaatttaggtgagtttgacacctactaaaaagttcggtacaacttgtcacttgcaacatggtgtccaagacacagataagagatacgtcagagaataaagagaattagatagcaataactgggagatgtctatggaacctgattgttctgacctcttcttcaactggttttcttcctcactgtttgaaatattgtttaaattaaataattaacactatattaagagccaagaatagcactcagaggctatatttagcttctggctacctggttatgccgtgcagtgaaatgaggcaagaagtttttgacaatttaattaacatctttctagattttcaatttttaaaatatgaagccccatgaagg

SEQ ID NO: 239833 - DNA, 433 bp, Homo sapiens
caagtcacggtatttgccttgaattttatcaaaagacaaagaacatgtctccaaagtaggttgagcaggaagagggaggaataaatcaagttgtcctttgttgtacctaagtccccaaagtatacgtattatatgctatatttcacatatatcacatatgatatatgtgttctattttatgacccatattataaattagaaaactaaataccatcaaaattaaatcacttgcaagtgttcacatagcaggaaacggggaaaaccagattaaaaatcatcctggcttcagaatccatattattaactgatatactatatactgtatctcttttgctttggtatttatatatacatatgcatatatatacatgtgtagatacttgtatatatattatttgtaatcttttaataaaaagtacagttattatagaga

SEQ ID NO: 239834 - DNA, 468 bp, Homo sapiens
caggctgtcatcctctttaaaatcttcatgtttcctttcttacatgatgttggtaaataacttaaacacccagcaggcaatcctttatggaactcaaaataaatgttggaaattttactggcttatagaatccaaacactcgatctcatgcaactgcctttgcctctgtgaagctttagcagctgtggctaagtcacacaatctttctaagcctaggtttctcatctgtaaaatgggtataataatattcactttatacatgtaaatgagatacctgtaaagagcctggctcagagaaggccgtcagtaaagttggctataggccaggcatgagggctcacacctctaatcctaagtggaggcctaggcagggggatcacttgagcccaggaattcaattacatgagctatgatcatgccactgcattccagcctgggcactggatgacacagtgagaccctgtttct

SEQ ID NO: 239835 - DNA, 1717 bp, Homo sapiens
  misc_feature (739)..(739): n is a, c, g, or t
ttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagatgattctcaatcttcccccaaagcatggtttggtgccagccccttcacctccttccagagcccaagatcantgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccatgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgac

SEQ ID NO: 239836 - DNA, 392 bp, Homo sapiens
gaattctttttttgggaaaatcctgttgaattgtgtggcttgtgaatctggctctagaactgttaatgttataagaattgaaagaggactatttaaaaataccaagacatcttttaaaattcctatttttagaacagctacttgtcattaaaataaatcattccatttctatttgtccaggttactgctttcacagcagggccagggctatggtgaagtgtgggaggtgcccagtccccttcactgcagtcatggctctgtttcatgccacatgtgttattttataagtggttaagccccacataggcatgcaaacatggtacatctctatgtattggttttggtaatgttgtaaataattgggagaatacattaaaatttggtaatagtgc

SEQ ID NO: 239837 - DNA, 554 bp, Homo sapiens
ttaaagagacgggtctcactaagttgcccaggctgctctcaaactcccaggctcaagcgatcctcctgcctcagcctcctgaatagctgggaggcgtgagccactatgcctggtaattgtactcgtttctacaagtgctttaggagagaaacacaaaggaagtagttttgattctgatacactttggcttctctcaaaaaactgggaaaatattttgacttttctacaggcttttcctatcttcagtcagaaagtgcacatctctatctgaatctgacagagtcatcattctctgagcttcttggagaatgttaaagttaggtcattttccaaagacgaaggcaagactctcttgtaaaagttaagtctcgtcatattcaggtgaaaaatcttaaaggcaaggctgggtccttctcatagaaactcgaaccatttctattcgtgcttttccctggcttctgtccaccactgaggctctttcacagcacagggcctgttttcggctgtgctcagttaaccctgaagaaaaggtctgtccattccccaagacgact

SEQ ID NO: 239838 - DNA, 378 bp, Homo sapiens
aggattttagtcatagtacttaggaggtaataattagtaactcctaactatttctagtttcatgaaaccctgagaatcttattaaactctgggtcttggccgggcgtggtggctcacgcctgtaatcccagcactttgggaggcagaggtgggcggatcacgaggtcaggagatggagaccatcctggctaacatggtgaaaccccgtctctactaaaaatacaaaaaaaattagccaggcgtggtggcaggggcctgtagtcccagctactagggaggctgaggccggagaatggcatgagctgggaggcagagcttgcagtgagccgagatcgcgccactgcactccagcctgggctagagggagagtctgtctca

SEQ ID NO: 239839 - DNA, 168 bp, Homo sapiens
aatattaaatgcctaccatgtgcactgttctagctatgtccgtgaacaaaacaaaggtcccttgtaaatcttgccttctaaagtgactgggagtaggggggattagtggagagcagacaaaagaaataacctcataccttatggaacgaggcagctggttaaataaac

SEQ ID NO: 239840 - DNA, 122 bp, Homo sapiens
gaaccacagtcagggctgtgcctagtagaatgtgtaggtttagatctgcccaactgcacagaatcacagaatcttaggggactttgtagtaagaatcctttccatccttcctctggtcgact

SEQ ID NO: 239841 - DNA, 650 bp, Homo sapiens
ggatttcaccatgttggccaggatggtctctaactcctgatctcaggtactccacccgccctggcctcccaaagtgctgggattgattagaggtatgagccaccgcgctcggccgggagtggagtgttgtgagcgtggacagtgaggtcaggaatcatccctttagggacagaatcaccttgtggttggcctttggcatccagctgcccagattagaatcccagctgcagcactaaccaggcagattgggtaacagaccccatcttcacctttgccatccattaaatgggcttttgtcaaaatgaaggaagacaaccggtttggagcacctggcctgcagctcctgtgacctgtagcaggagatctagagaagcttaacagaggtccacaacatgacagaaaacaaagagacacagagaaagataaagatggggacattggccgggcgtggtggctcacacctgtaatcccagcactttgggaggccaacgtggatggatcacctgaggtcaggatttcgagaccagcctggccagcatggtgaaaccctgcctctactaaaaatacaaaaatttgtcgggtatggccgggcacagtggcttatgcctgtaatcccagcaaattgggaggccaaggtgggacgatcatct

SEQ ID NO: 239842 - DNA, 434 bp, Homo sapiens
ttttttttttaagcacagaagttcaccagggctagtagaaaatttcaagttaagaaaataactcttgctgggtgcggtggctcatgcctgtaatccaagcactttgggaggccgaggcgggcggatcacccgaggtcaggagttcaagcaatcctccaacctcagcctccaaccaactccggaccccgccccatgtcccatcgcctcccctgccctcggccccgcaaacacccctggccttgactttcccaccagcgcggcccagccccactgtgttccatcggcgctcaataaaatactgaatgaggccgggcgcggtggctcacccctgtaatcccagcgctttgggaggccgaggagagcggatcacgaggtcaggagatcgagactagcctggccaacacggttaaaccccgtctctactaaaaatacaa

SEQ ID NO: 239843 - DNA, 209 bp, Homo sapiens
ggtggagtctcactctgtcgtccaggctggatcttggctcactgcaacctccccctcccggactcaggtgatccgcccgcctcagcctcccaaagtgctgggattacaggtgtgagccaccacgcccagccaagtgtcatgttttaaatattacacattatgggtttattaactgatatttagcagtttatcataatctcagttttcat

SEQ ID NO: 239844 - DNA, 427 bp, Homo sapiens
tgcaagctccaaactccacctcaccacaggtgactcctccttcactttctcctccagcctttctcagagtggctgggcgggcaaagccagaaaagccactctggccacactgcagcctctgttgccaccaccaactgcagtgaggcaagccatggtgccacaggctccaacctccagcatgtggcaggtgattccccttccccttctcctggttctctaagccaggaacagagtagctcggtgggcagatacagaagagcctaaaatctgttgtactattttaagaaaaacttctcttgcctgtaatcccagcactttgggaggccgaggtgggtggatcacccaaagtcaggaattcaagaccagcctggccaacatagcaaaacctcatcgctactaaaaatacaaaaaacaaaaaacaaacaaa

SEQ ID NO: 239845 - DNA, 193 bp, Homo sapiens
ttttgaaagaactgctgacattgtatggtcttgatattcaccttcttaaacttcaatatctaaatattctcctatgaaggggtcagcataaatatcattgtccttaattacttctgttactctttgattcctactagacatagggcacttaatatattacagattgtgtgaaacattggattgctactcctaa

SEQ ID NO: 239846 - DNA, 2571 bp, Homo sapiens
tggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactca

SEQ ID NO: 239847 - DNA, 2731 bp, Homo sapiens
tggtaattatcttaaactgcatgagatcccggaatccagatgaaagtgcaaaattggcagacagtattgcactaaattaccaactttcttccaaggaacaaagagcttttggtgccaaactgaaggaaattgaaaagcagcacaagaactgtgaaaacttttattccttcatgatcatgaaaagcaattttgatgaaacatatatagaaaatgtagtcaggaatatcctaaaaggacaggatgttgacagcaaggaagcacaactcatttccttcctggctttactcagctcttatgttactgactctacaatttcagtttcacagtgtgaaatatttttgggaatcatatacactagtacaccctgggaacctgaaagcttagaagacaagatgggaacttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactcttggaatatcttaatccaaactacaaagatgctaccaccatggaaagtatagtgaatgaatatgccttcctactgcagcaaaactcaaaaaagcccatgacaaatgagaaacaaaattccattttggccaacattattctgagttgtctaaagcccaactccaagttaattcaaccacttaccacgctaaaaaaacaactccgagaggtcttgcaatttgtaggactaagtcatcaatatccaggtccttatttcttggcctgcctcctgttctggccagaaaatcaagagctagatcaagattccaaactaatagaaaagtatgtttcatccttaaatagatccttcaggggacagtacaagcgcatgtgcaggtccaagcaggcaagcacacttttctatctgggcaaaaggaagggtctaaacagtattgttcacaaggccaaaatagagcagtactttgataaagcacaaaatacaaattccctctggcacagtggggatgtgtggaaaaaaaatgaagtcaaagacctcctgcgtcgtctaactggtcaggctgaaggcaagctaatctctgtagaatatggaacagaggaaaaaataaaaataccagtaatatctgtttattcaggtccactcagaagtggtaggaacatagaaagagtgtctttctacctaggattttccattgaaggccctctggcatatgatatagaagtaatttaagacaatacatcacctgtagttcaaatacgtttatttatatctttatgattttattctctctctctattctcatggcactttcataacattatggctaacctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaaaacttttataagttttctaaattatttcttcactgtgacagcaaagatttaaataagatgaatgtaaaagagaaagcttattggactcaaacccacagatccacaccagagttctatttacctcatcttggtatcaataaaaacttatgtggaaggtaa

SEQ ID NO: 239848 - DNA, 469 bp, Homo sapiens
tgccccttgcccttctcccagctcattgctccaggagagagaagagttcaaaaaataaagtaatcataaacttgaactctctccattctcttgttctctaattacagattttgcttttgcctccctgaatgaattacaagcctttttaagatatgaaatatgcctacccgcagagcttggcacaaagtggagtcaatcttttaatgttttaaatatgcattttcagactcaaataattaagaagtttcattgatatccactggtcacatcataactgtctatagggcaataaaatctgtgttaaactcaaaacttttataagttttctaaattatttcttcactgtgacagcaaagatttaaataagatgaatgtaaaagagaaagcttattggactcaaacccacagatccacaccagagttctatttacctcatcttggtatcaataaaaacttatgtggaaggtaa

SEQ ID NO: 239849 - DNA, 640 bp, Homo sapiens
ccctaattcctctacaattttaggaagctaaaaacataggagtaggaccttaacccacttgcagacaacaattttcttgaatatatattccgtatagcctttttatctcagttgacttgaatgctcaccctaaaatccaaaactaagactaactgggttaaggaaaatcttaatacagagacagaagtaagtatgccctaaaatacctagaacaggtctagagacccatcaacatgagaatatatttagttcagcaaccaaatgaatagaatcggcttcttgtttgggattttgaaagtactttttcatttgaactagtcttaggcaatggtctcgcctgaccttcagcgagcctcagtgtctactgggtggcaagaaatagataccgtgaatggtcacagcattatttacagcatttaatcattctggacctcaaagagatttgagaacatttctcattttcctagttatggtaggtaattttttttttctctaaccaactactcaagagtcattgaagagattctaaacactgcttttcttgttagtatggcgtgttgttactatcgtacaaagccaccattttccaatgagtcttcaaatcatttggaagtgcatttgggaaacaagaaagaatcct

SEQ ID NO: 239850 - DNA, 661 bp, Homo sapiens
ataatgtggtagtgacacacatgtgtaaaccaatatactggttgaacagaattaaaagcccagaaatacatccaagtatgcatggaaatctagtatatgatataggtggcatttcttcactaagtcataatactgaggaatggaattaatttggaaaaaaataataaaattatatccataactcatgccatacataggaataaactccaaatggatctgtaatctaaatgttaggaaatgaaactaggccaaacatggtggctcatgcttgtaatcttaacacttttgagaggccaaggcaggaggatcacttgagcccatgaattctagaccagtcagggaaactgagggagaccccatctctacaaaaaaataaaataaattagccaggtagtggcacgtacctgtagtcccagctacttgggaggttgaggtaggaggattgcttgaactcaggaggtcaaggctgcagtgagctatattcatgccagtgtgctccagtttggtcaacagagcaagatcctgtctcaaaaaaagaaaccacactagtattttactgtcagtgtagggaaagactttttaactgtgactcagaatccagaggcaataaaataaatgattgataaatttaactacattttaaaaattacatggctgaaga

SEQ ID NO: 239851 - DNA, 442 bp, Homo sapiens
ttctgtaccattagagcagtagtttttttaaggttatacagtgtgttcctgtatccttcattttcagtgacatgtggcttctttgcaatacaaatgtgatgacaacaggattttaaagcagcaaattggttaaaactgggagacattagcaaatcaccacccatgatgtccaccagccttggaagggccaatttcatcatccgctatgtcttcgacaaccaaccaatcttttttcctccaccttggttttccattggtataatgtcaacattctgttaatgtgtccttgggatctatcaactttacgatttcttaactagcttctctctacaaatatgtttatatactctactctattacttttcttctgtttcaactgtaatttaaaattttttaagtttcacatgattttcctaataaatgagaaaaagtctaaatcttt

SEQ ID NO: 239852 - DNA, 952 bp, Homo sapiens
gcggcggcggcggggaggcgtcgcttccgctctggggggtttcgcggctcggggagctctttgttagtttaactcctcgggctcggggccagcgtcgggaccaccggttctcttcagtccctctgcccgcagcagccgcgcgttggtcaccatcccgggatggttgcgtcggttctaccgggagctctctccgcctcggtcctatggagacccgtaattaaataacagattatgccttggcgttcacatgctagttcccttgaaggtttaatttaaaaaattttaaaattaaactctttataagcatggcgtgcatcctttgctctacccaattttgtggattactcagtacactttttacctcttcggttacaacacttcaacagaagtgttggcagctgttggtacacccctaccttcaagtaaaacaaatcttaaaattactaaagtttttcattggtaatttattccacatttgccccatgaaaggatgaagtgagctcagggttgcattaaacacacattcctagagccaggtctttctcttaccagaaatgttagggggaggcagaaggaatgtgatcattttgtccacagcaagtagttagcttcagttggatggagactttaaggaaacaaagcggagcaaacgttattgcccttttttggtgcacttaagcggttttaatgacttagatgttatttaaacatttaacacatgaattgtgattaattctgcaaactttaacagaattacgaaactgtacacatatatcctactattaggttaaaagggtttttaccttaccttttaaaaataagacgcacattagaagccctttatagccgtttgaatttttaaataataaaaaaaaaggctggtcagtcacccagcgttgcagtttccagttaccaggatgtgagagcaaactttgcaacacatttaaaaaag

SEQ ID NO: 239853 - DNA, 519 bp, Homo sapiens
tctggtgtggtggggctaattttctggcattgcatgtgagctgttttctcttcagattacacaaatcaatttttctggatagtgaagtgtcatgatttaatactagacatgtcctcagtgagtagatatttgaaggcttatgcttagtcatgtgtgacatttcttttttcctctcctgaaagatggttttgtggttgtgatcactgatggttgggaatagctgttcatcctcatccacccatctgcattaggagcctcgctgaggacagtgcggtgctagacattgggaaccgcgttacatggaccgttctcatgagggcgcaggatgggaggatggaccgtgtctgcatctgttcttctgcgcttgcgacctgacacgcgtgattccaggtggacatggtgctgagctgcagcgctgtgtggggttggttgaagggctgctgtgtataaaaagtcatgctctatgaaaaaaatataagactgaattcgtgcaattttcaaaaaaaagtataatctagg

SEQ ID NO: 239854 - DNA, 706 bp, Homo sapiens
cctccactattgaactgtttggctcctgttttttggttgctactcatcatgatatgatgaacaccctgttacatacatctttgtgttcacctctaatagattactcaagtgttatacacatttgtaaggtgctgccttaatgttgcttgattgttctttggaaaggtagattatgtgggtaccatttatttgtaatttatccagcagtcgtttaagccacatgctgtatttttcttataataaaacctagagtttaacattatttaattatcagtatacttcatgttttcatagttatttgtagtttgtaattaatctctgattctccatttgaaatttgtaactgtagccaggttttcatcttaaactaacaaggtggtagagtctattctcttctgaatcatagacattttcttgagtggatgtttatgtattgaaggaacttgttcagttcacattgtcatctgcattagctacttgggtgtcagtgtccttagatggttattattcagcagctatttggatgagtagccatttgcatcatgagtgcttgatttattttgtgtcatcatctttaaaatgatttgcttgcccatagatgtccttaatagaagaagattcctttatccaaaacaactgttagttccatacactgtgatgttaaaagtgaacaatcacaaccacaatgagaggggacttttgatta

SEQ ID NO: 239855 - DNA, 503 bp, Homo sapiens
cttatgaccaaggagcctcaacatgtcacagcttttgtgggctgtgggcagtaggagagagggcactgccactggagacctgcgctgtggcctctttggccagtgccttgctgtgccatgtgggacaaatcctttcccctccttattgggccctaatttcccatctgtgaacagttcatagcaacttggggctgctgggaggagggcaagcaagcctggaacccagagcgtggccagaaatgatgtcgacgatgcccatgaccacctcctctgttctccaagacctttgcctctcctcaggcccctggtcacctttccctgggtcttcgttctttgatgtgagaagagggcagctttaatcccccacctgatagagaagaaaactaagctgtggagtagggtggagtgagggagtggaaggaaggttgtggtttcctggtgaggtgtgatgcttagacctggtctctaaaaataaaattaaagttaaaaaaaatgaattaaaa

SEQ ID NO: 239856 - DNA, 665 bp, Homo sapiens
ggacctcaatcctacagctgcacatgactgaattctgccggcaactgaattgactgactcttctccagattcccaggtaagaactcaggctagcccaacccctgagtgtggctatgtgagaccctaaagcagagggtccaggacttctggacttctcatctgtagaattgtgagctaataaatgggtgcagttctaagctgctaaatatggtaatatgttacgcagcagtagaaaactaagacagccatattcttttcagttctcatgctttccatggcataatctctgctttatttaagtactcagtaaaggtttgcccatggcatgttgaactacttcgaagacacctgtacttatcttttaacaaaagattccttttcattatttctcatggatcctactgatgaaaataaagataagcatatattcaaggaaatgcatttctacatcattatctgaggacaatattggtgatgtcccctgggtattcaggttttaaatgagccagttcaacagtatcttgatacatttcctgatgtgtctcacactctttttcttatatgcaaatttttctatctagattatatgcaagtaaagtttaaattctatattatttctgtgacggaaagttattgatcttatagctatcatgttgctatcagac

SEQ ID NO: 239857 - DNA, 392 bp, Homo sapiens
actactgctgacatttcatcagtctccagcctttaaaaaataaagtaaaataaaataaaatgagtttgggatgtattcatcatgagaaaatacaaaattacacgaacaaggccggtggcggtaatcccagcactttgggaggccgaggcgggtggatcacctgaggtcaggagttcgagaccagcctggccaacatggttgaaactctgtctctactgaaaaaataaaaataaaaaaaaacaaattagccgagcgtggtggtgcgtgcccataatcctagctacttgggaggctgaggcaggagaattgcttgaacccgggaggcggaggtttcagtgaaccgagatcgcgccactggattccagcctgggcaacagagcaagactccgtct

SEQ ID NO: 239858 - DNA, 447 bp, Homo sapiens
ttcttattttgaaaagtgaatggatgtctaaatcccaagaacaagcacagaaaggcagaacagggctagcagcttgtcttcccagaatgaatattgcgccaaccactgtgaaaacctggaactccaatagtcattccacacacaaaaaaaatctgatgcttagcatacatatttttggaacatctaataagttaatactttacattagtgggttttttttacatttatagtaaatctgacacataaagacctccatcctcagccaccccaactctgtttgaatggcacctggtggcttgtctgatgagctgcagccacactgccaccagcttgcccagcctcaggcttgtcctccagggcttggataggtaagtaaatgactccactgacatagtgactcccagcttctggaaaccaggaaataaatatgatttctaagagagctga

SEQ ID NO: 239859 - DNA, 364 bp, Homo sapiens
atatatatatatatatatatatatatattcttttcataatttcatataacttcagtgtattccttatctgttagccagaggctgtggttttaatgacatctctgtgtggtatttatatatatatataaatacatatataaggatattgaagttgtggaacttactgcaaaaaatacctgaaaaattaactgtgcattttttgttgagtaatttattgtactatccatgggggtggtaactgaggaataatttttaatagtgattgcattttttaaaactccctgttatttcttttagttggcatacgttatggcatgttatatacatcatgccttgtcaggtagaagccacttctctgtaaatg

SEQ ID NO: 239860 - DNA, 309 bp, Homo sapiens
gagcagaagggagtgcattgagtcctcagaggagaaagtgacttggctggaggctcagggaatctttcccaggatgagctgcacctcggaggtggggtagcatttgagcgttcaaaggctggggtcatttcagatgagtgaggaccagcccagagtcaaggccttgtggaagaagatgggcggaagcaggaaccactcagggtctcaaggagctggctaaagtgaccccgacaagagtgatcacgatataaacctggaattgcacatttaagagtccaagtgcacatagatgggcctagtcagcagtgt

SEQ ID NO: 239861 - DNA, 844 bp, Homo sapiens
atgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaataggaagaatatcgattggcatggacagtcgggtcgagtggataatgggcatactgatagagtgag

SEQ ID NO: 239862 - DNA, 1072 bp, Homo sapiens
gagtttgggtatcgttgttggtaataaacatccctgcagaactgactgcgatttcacatgaattgtttaaaaataaaccaaaattacacattatatattccctctcccaaaggaatctccttgggaagctgttacgttttctactatagctgcccttatcgaagtttcgatcctaccctcccttctccttctccgtccctcactcttccaccattttcttcccctctttcttttctttctgtctatcaagagttgcatgaaaaagcacatctctttgaccagcctccaaggtgataaatcttcatcagctgagaataaatttgatttttggaaacagccagcagtcagagtcaaggtcagtgggtaataaaactatagtaacattttgagttagagatggggagtgactgtaaagtagtgagcccatttttcttgagtttttggaaggcaaagaaggaaatcccaaaacaggaaatctcagtttattgtgtatatttgttaaaaacaaaagaaaacaaaacaaaaaactagtcttgtttgataatgacattgcaagttttgtatattatttatttatttttgtatttgtgactttttccccccaatggttgtgtctttcaactgactgtgggatccttgtcacacttttattttatgttgataatccttttggcattttaaatgatatctgtatgtcatattgaaatacagtaattaaagtggcacaacataggaggaaatcaaatttcatttaatgtttaattacataaattgactacctgatagatttttttttaaatttggagtttaacatttgaaaattggcaggaaggttttaatgcttgttttaaacatagtcatcatctagatctgtactatcaaatgcaatgatattacttattataacattatcaaatgttatatgtagtgccatcaatttatattgttttcaaagtgtaacttttaaaaatagagatattcagcagttatactaaacatttgagtctttcaatgtctgttaaatgtaaaacttgatatttattaaaagagaattttaaacttagaaaaacag

SEQ ID NO: 239863 - DNA, 387 bp, Homo sapiens
cggggcgcgagccagacacagagggccgcggaggacgcgggaggcgagcggggagccgaggtcgtgctaggatcccgcgcccaggggccttcgtcgagggaggggcgtggcggcggcagcaggagggcagcaggagctgtcaggctggcggttccgcgccgcggctccttctgcgctgcgcccgcaactctgggctgagaacttctcccgccggcccactcgccctcgccccgcgcactcggcgccaggcgactcccgcaccttgtacccggcccgccccgcctcctccttcggccgcaccactccccctgccggccgcgcttctctccgttacaaaggagggaaaatgagccgggcggcggcggcgcggcgcggggccaccacggc

SEQ ID NO: 239864 - DNA, 500 bp, Homo sapiens
caatgctgtggagaaggcaaacatcaagcccaggcggactggtactggctgaagaatgggtgccacatcatcgtgctggctgagggttggctggtcaacctgggctgtgctatgggccgccccagctttgtggggagtaactccttcaaccaggtgatggtgcagattgcgctgtggacccacccagacaagtaccccattctctaccaaaaatacagaaaaatttgcctggcatcgtcgttgcacctgtagtttgagctactctagaggctgaggtggaagaatcacttaaacccgggaggtggaggttgcagtgagtggagatggtgccactgcactccagcctgggtgacagagtgagaccctgtctcaaaaaaaaaaaaaaaaaaaaaaaaaaaagatacttatgaaggaaattcttataaaattgtggaaaaaatcattaatataactatttatgccatgattcccaaattgtgtaaatgataatatgtgcagag

SEQ ID NO: 239865 - DNA, 543 bp, Homo sapiens
tgcgtcagtgctcccgggttctactgagaagtgcaactgctagctcacacagtaactctgacggtaactctgtctcatttcccgaggggctgccgtcctgttccccgcaacagctgcaccatgctacattcccagcagcagtgcacagggactggctttcactctgattaacacttctacaaggacgccctccccacagtggcctcccacaagtagggcccacaaccccaggaaggaaggccagactcacccaacagcacactctggccccgctggagcatggggcgtgcgtgctttcactcattcactcactgagttgctctgggcggcctcatcctgccgcctgccccagccctgtcctcactcgctcctgcacggactctggtcacctgaggaccctgccctccagacagcagcgtggaccaggatctcttccgcccagccactccacggtgccaccactgctgggctgcatcctgtgcttggctcaaggcctcctggagaggctgcgtggccaactctgcagccctggcaagcggccgc

SEQ ID NO: 239866 - DNA, 749 bp, Homo sapiens
aaacgaagccagaaagatggtggccagcacacctatggcaactatcaccacggtctccatgcttccggggagctcctgactcagtcccgttcacatcgtcctcatgggctaaggctgctggaagtggcaaactgggggaagaggatggcaggagctaggttcctccacgacacctccagagacctgagggcctcaagctgcagctccggggcacatcccgctgcgctcccacgacggccccgcggatggcaaagtcagcggcatcgcctatgcaggcaatcaaaggatgttgatggataagtgtttcaggcagaataatggccctcaaagatgttgacaccagaatcttcagaacctttgcatatgttacctaacatgacaaaagggactttgctgatgtgattaaggttaagaactttgagaagggaagattatcctggattatacaggtcgacgtttatttctttctgaactttcctggaggatcatcggccatactccagcagaagggtggatttgaaaaaataacgtttccacggcaacagtggcagcaattcaaaggaagacgttggagaattcacatgctattttagctggctctgtgattgcaatcacacaaatcattacattccagcgagatcccatcaacagaaggtttttccatttcagtctgtcaagtttttcaggcatgaatactgtaagcaagaagagaaaagttacaataaattgacatttatagtaaaaaaaaa

SEQ ID NO: 239867 - DNA, 1071 bp, Homo sapiens
aaacgaagccagaaagatggtggccagcacacctatggcaactatcaccacggtctccatgcttccggggagctcctgactcagtcccgttcacatcgtcctcatgggctaaggctgctggaagtggcaaactgggggaagaggatggcaggagctaggttcctccacgacacctccagagacctgagggcctcaagctgcagctccggggcacatcccgctgcgctcccacgacggccccgcggatggcaaagtcagcgaattgaccacaagagaagactccctttcaaactcttcattctctggttcagaggtttgatgtaatggttgtctcatcgtacatggtcagccacaggatatacttcatccatttcagagctgtactcctgagttccatgctataatcagaaatatgtggcacattttgaacaaaggaaatatatacccaacaaagtgttaaaatggagctgccaaccagacaaaccctagaaatatgtagccacttacaggcagaacacaactacatgtgttcccaatgtggaaggcattccggaagtgtatgcatccacatttctacatgaggcatcgcctatgcaggcaatcaaaggatgttgatggataagtgtttcaggcagaataatggccctcaaagatgttgacaccagaatcttcagaacctttgcatatgttacctaacatgacaaaagggactttgctgatgtgattaaggttaagaactttgagaagggaagattatcctggattatacaggtcgacgtttatttctttctgaactttcctggaggatcatcggccatactccagcagaagggtggatttgaaaaaataacgtttccacggcaacagtggcagcaattcaaaggaagacgttggagaattcacatgctattttagctggctctgtgattgcaatcacacaaatcattacattccagcgagatcccatcaacagaaggtttttccatttcagtctgtcaagtttttcaggcatgaatactgtaagcaagaagagaaaagttacaataaattgacatttatagtaaaaaaaaa

SEQ ID NO: 239868 - DNA, 1042 bp, Homo sapiens
aaacgaagccagaaagatggtggccagcacacctatggcaactatcaccacggtctccatgcttccggggagctcctgactcagtcccgttcacatcgtcctcatgggctaaggctgctggaagtggcaaactgggggaagaggatggcaggagctaggttcctccacgacacctccagagacctgagggcctcaagctgcagctccggggcacatcccgctgcgctcccacgacggccccgcggatggcaaagtcagcgaattgaccacaagagaagactccctttcaaactcttcattctctggttcagaggtttgatgtaatggttgtctcatcgtacatggtcagccacaggatatacttcatccatttcagagctgtactcctgagttccatgctataatcagaaatatgtggcacattttgaacaaaggaaatatatacccaacaaagtgttaaaatggagctgccaaccagacaaaccctagaaatatgtagccacttacaggcagaacacaactacatgtgttcccaatgtggaaggcattccggaagtgtatgcatccacatttctacatgaggcatcgcctatgcaggcaatcaaaggatgttgatggataagtgtttcaggcagaataatggccctcaaagatgttgacaccagaatcttcagaacctttgcatatgttacctaacatgacaaaagggactttgctgatgtgattaaggttaagaactttgagaagggaagattatcctggattatacaggtcgacgtttatttctttctgaactttcctggaggatcatcggccatactccagcagaagggtggatttgaaaaaataacaaggaagacgttggagaattcacatgctattttagctggctctgtgattgcaatcacacaaatcattacattccagcgagatcccatcaacagaaggtttttccatttcagtctgtcaagtttttcaggcatgaatactgtaagcaagaagagaaaagttacaataaattgacatttatagtaaaaaaaaa

SEQ ID NO: 239869 - DNA, 389 bp, Homo sapiens
tgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcct

SEQ ID NO: 239870 - DNA, 457 bp, Homo sapiens
ctgctctctctgctccagccaaactggcctcttttattccctatttaccagcttcctggcctccacagagcttttgctcatgctttgctctgtgcctggaaggttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgtt

SEQ ID NO: 239871 - DNA, 342 bp, Homo sapiens
acaggatcgcagctgtttttgtttttgcaaagtcccattgtcctgccttcactcagcgttcaggacccggtgtgctgcggctagtgccacaacaaagcttttctcttatagaacaattagaaatcctattgtggggatacaaggtcaaggtagcaacatagagtctgtttctctaaaagagaatttgtaagccaaagtgctgaaagttttaagagaatcttcaaagaataatggattattttgttggtttctccatctgggtgtctctgtatatagtaaggtatagtaatgaatgcatacgtttattccagcctgggtgacccagagcgagactccatctca

SEQ ID NO: 239872 - DNA, 369 bp, Homo sapiens
ctctgagctaccaccttgagaaagacattgacaaatggttatttcagaaatggagaatacccatctcaaggaccaaagcagccatccactcaattttatcttatctacaaggcaaattatgcttatcattgcaaagatacaacccagtttaaaagctttggcagcagtattctgaaaccatacatcactccatgaagctattcctgtttctctataaaatgcaatgtgatcctgattttccagaaaaggttggggttccctattactgaaaaaaaaagagaaaaacagatgacttaacaaatgtctgtactttcacattttgttggaacttataacactctaaacacacaaaaattcaagaaacgtaat

SEQ ID NO: 239873 - DNA, 411 bp, Homo sapiens
tatctagctaatatgctaacaaatactgtagggatagggtatagtctagccgattgtagtacaggaataagaatcaattttccagtgctatacctttatagagttctattatttaaaatggatttctggccaggctcagtggctcatgcctgtaatccctgcactttgggaggctgaggagcagggatcacctgaggtcaggagtttgagatcagcctggccaacatggcaaaacccaatctctactaagaatacaaaaaattagctgggtgtggtggtgggtgcctgtaatcccagctactcaggatactgaagcagagaatcgcttgaacccgggaggtggaggttgcagtgagccaagatcgcgccactgcactccagcctgggtgacagagcgagactccatctcaa

SEQ ID NO: 239874 - DNA, 458 bp, Homo sapiens
ctggttgcatggccatagttgggaagagggcagagctggcagacatgtggcacacaggagactgaggcacacatctcagacagaagtttgcaaactgaagggtagtgggccacagccagcctggagatacattttgtttgacttccaagttctttagaaaaattttaattaggccaggtgcggtggctcacgcctataatcccagcactttgggaggccgaggcgggtggaccacttgaggtcaggagtttcgagaccagcctggccaacgtggtgaaaccccatctctactaaaaatagaaaaattaactgggcatggtggcaggcacctgtaatcccagctactcaggaggctaagggaggagaatcacttgaacctgggagacaggggttgcagtgagccgagatcatgccattgcactccagcctggaagacaagagcaaaactccatctcaaa

SEQ ID NO: 239875 - DNA, 464 bp, Homo sapiens
caggtatccgtatcaattgggataatttcattataaacttgtttttacaaagctaatcttcactctcattttaagcagcacagagttcctgggatcagtcacagacattttcaccagacttctaagatgctgtttaattcagttccaattgttactttaatgctgttgagatgctagaagctctccacataataggccagctgcctaagcgtaacactgatgacctttcgtaggactcaaagattttgtttgggattgtgtcttcagtaattcataacaggttttgttgctttttaaatcaaacatagtaaagatttccttttatgctctccttttagctacttggcttctggagtgttactctgttttcctaaatttacagtagctgccagtcttgtgctgagttctcctccaagtacactgaattgtgcaattcttgcttggcccagttttggacaggcatc

SEQ ID NO: 239876 - DNA, 386 bp, Homo sapiens
ccaaagtgctagtattacaggcgtgagccaccgcaccctatcttcttgtataagtgagaacacagagccccagctagatccattgattcagtgggggccataaggctagtaactgaagaagccaggacttgaattcacgtttccctgattcacagatggtgttcccaacctctagctgtactgccttagccggagtgaccccatttgagaggtagtcacctgcttccaccgttctagcttcccatctgtgccctgaacacatggggagatctgctcattttagaaggcgtgcttttcattcattattgtgaagggcaaccagtagtagatgagctccaatgccttgcagggacaaagattaaacaaattttcatcatgtccactga

SEQ ID NO: 239877 - DNA, 1251 bp, Homo sapiens
tatcccttgagggcaaagtttagaaactggtcactctgcctactgtctgttcagcctcttgtacaatggcagtttggcagctttaaatccttaacctagaaatgtatttaaggtttttctttcaagaaatggggtatacatatgaaggagagagtaacaactctttttatacacctattcagatttcagccctgaatttggcaaattttagattaggtctcacataaggtaaatatgactcactaactctttttttctcatcttccccacccccccatatatatttatttattttaatggagttagggaccactagtgaaatgatgaaaggcccaattctgagtaacaattgtctactcttcacataaaatatactgaaaaagaattaagattccttgatccagtagacatagagaaacataaacattcatgacagatgagtaggtaaattcagggatcactttggaacttgctggattatggtgatggtttttggatagtatgtgcttcattattttatttggggtagttacagtgttgtagtttttgttaacagctacacttttggtactattttccttttaaatttttggtgtctaagatttaccactaattactaatatatgcctttccaattcacttaaaaccttaataagtgaaatgttcaggtattgctagggtaaatgtgtcttttcctactattgagattttaaaaggctgtgattaagagagactttattaatttgatctgaaagaagtagaaacctctatgaaacaatttttattttcctttgcataataccttagaaatgtgttaaggacaagctatattttccttacttgcttttgatagtttttttttttttttttaagcatagatatccaggttggcaggcctctgaaatgtgaaattgtaatttttatagatggcattactatgaatctgaaatcagtgctaggtgtacaaatgtgaatttttcaatcctgtaatcaaagaacaagatcttgtgggttcctactgctgaaaaaggatgctttcttttgtacttgtttttagtgaaagacctttttgagggagagctattttataggtagttgctattgatatctccatttgagaaatagacatttttctgtatttctagaggtgttctgaattttaaacctgaattcttcagtttagaaaacccagaataaaattatacccacagtgggcactcaacaagtgtgatatttcacaaatgtcagaga

SEQ ID NO: 239878 - DNA, 621 bp, Homo sapiens
cagcaaacctccccacttgtccctgaccattcagtagttccagaggcagtgagcttggaatcttagcaagagagatcttggggtggggtgtggactttccacaaaggcattacctacatgcacgttcccttacacatgtagccttccaatctcatacgtaagaacacttatttaagtaaaatatgcctattccaacagcaggagctctcggctggggagtagagttgttattagtttactatttagtattaactgagtaaacatttagaaaggactggatgggggtgggcacatggggctggggtgcatttgctctggctctacatttatgaaggacctcaaatttcattatgtgacattttctgtaaacaagggtatatatactacaacagatacacagaggctagaaaaaagtccatcataaaacttcacacttgtgttctattacaaaaccacattgtctgcatggtattatgatgtcggcaaatatataaatcttgtatttatagacatttaaaaaatgtaaaatgcatatatttattatatgtaaacatcataaatataccataacttttatatccttcttttcctcctcctccaatggctatctttagagattca

SEQ ID NO: 239879 - DNA, 259 bp, Homo sapiens
gccactgcgcccggccttagtttttttattttttaagtgacgggggtctcactatgttgcctaagctggccttgaacccctgggctcaagcagtcctcccacctcagcctcgtgagtagctgggactacaggcacatgccactgtgcctggctatactctctagttttaacatccattgatgatccttgcctgaatcagtcatttctgtgattgtcaaatgattgtgtaattcttccttttacatttattaggagcttt

SEQ ID NO: 239880 - DNA, 2358 bp, Homo sapiens
aacagggaatgaaagctgagtgtagtggctcatgcctgtaatcccagcactttgggaggccaaggcaggcggatcacatgaggccaggagctaaagaccagcctggccaacgtggcgaaatcctgtctctattgaaaatacaaaaattagccaagcgtggtggcacacgcctgtaatcctaactatttgggtggctgaggcttgagaattgcttgaacccaggaggcggaggttgcagtgggccaagattgtgccactgcactccagcctgggtgacagagcaagacctagtctcaaaaaaaaaaaaaaaaggaaatgaaagacatgcaatagatgatttggtttatttctttaaaacctggatattggctctaaagtgtttatttaaataaatcagatttagaattactgatggaaattggccattcttctatgccatgactctaggatgagtgtcgaagaaatagcagtcaactttaattcagtagacagggcaagaagaatcaaagggactcttaaattaaaccctaagtagtagaacatggaatcaggctttaggaggtcaagtaagaggtgggagaggaggaattcagttctaccaatatttgagtgcctactctttaacacactttctaaaccctggcttcaatagtaacaaaaacaatagctttcctgtctttctagagcttacattctagtaggggaaacaggcaataaagaaaataaaacttgcagcatttcagaaggtggaagataccctgaaagacagtaaagtagataatggtgaacaggagtgaaattttaaaacagggaagttctcactgataaaatgacatttgagtaaagatctaaaggaggtaaggtagtgaattatatagctatgtgggaaaagaacataagcagaaggatgactaatatgtttggaaaatggcagggcagccagatggctacaatgaagagaggcaggggaagagaagcaggagaaaaggttaaataaataggacccaggaagcaatataatacaggactctagggattatagtatatgattgtattgtgattgtaaaggccattgactttaatttgatggaaatggggaaccacatgggattctaatatacatttgaagactgtcactctagctgttatactgaaaatggactccttgggggcacaggaagagcaagatcggttaggaggctgttgcagttatcttagctgagatgatagcagcttatagcaggacagaaatggtaagggctgtgttttttatactgactgtagagtataggatttgctgataagttagatgtgggagttagatgtagagagagagagaactcaaagatgactccaaggttttagcctttgcaaatggcaagacgttgttgtttagtgggatggaaaaggcagtttccccagggaagatcagatgtttagttttgggtatgttaaatgtgagatgccggccaggcatggtggctcatacctgtaatctcagcacttggggaggccaaggcaggaggatcacgtgggcccaggagttcaagaccagcctggcaacataaggaagcaccatctttacaaaaaataaaaattagtgacttgtggtggcacacctactcaggaggcttaggtgggaggatcagttgatccccaacaggttgtggctactacagtgaactgtgatcacatcactgtcctccagcctgggtaacagagtaaagaccctgtctcaaaaaaaaaaaaatgaggtgcccattaagatatcaaaatgtaaatgttgagtaggtagttacatgagtctggagttcaggaaaaaagtctggtcctcagcctcccaaagtgctgagattacaagcatgagccactgcacccggacagaaaatatttttaaatgacggaaattacaacatgtttgtatactaatgggaatgatccaaacagcgaagttaatgatgcaggagataagagcgtcctgcaggtggcattagtgagcactgtggaccaggatttctcaaccttggcattattgacgttttggacctgatcattctttgttggggggcagggggagctgtcctgtgcattgtaggatgtttagcatcattcctggccttgactctctaggtgccagtggaactccctcagttgtgacaatcaaaacgtcttacacacgccaattataccccgggtggcagaaaggggcaaaattgcccaattgagaaccatggttacaggctgacaacatgagtttcaaagctagttttaggaaagagggcaagtaaagagtctgggagtagcaaggaagacacctaattccagtctcagatccagtggtatgagctgtgagaggtt

SEQ ID NO: 239881 - DNA, 159 bp, Homo sapiens
agtaattgtatttaatagtaagaaaatatataagcaatgattttttaaaagggagttctcaagagttttggatttctttctgccgtgtatagaggtttcttatgcatggacatttgtgctgttttatatctttttcaattaaaaaaaaatttaaaggca

SEQ ID NO: 239882 - DNA, 2162 bp, Homo sapiens
  misc_feature (544)..(544): n is a, c, g, or t
  misc_feature (1152)..(1152): n is a, c, g, or t
gttttgttttgttttcaatctaacatagaggcagccttttaaattgactttttttcccccagtttttagtttgacctattaaatatctagacagactttcatactccagtgttcctaaagatcaagcatgctacttgttgaggtgtcttaagttgcgtattttaaacaataaatattgggtaaaagtagtgaaacattagaagtatccttttaccaacactacaagaaaccaggacagaaatcacctcttccattttccttgccagtgaatcttggaaggttataaagttttttgcaagtacaggctgcttttccatgtttatagatatttgctataaaatagcctgcatcaaaaacatgtctattaactgtcttactgaaggcttgatagtgtatttttcaaagcaaaacagactttgaaggtgtctgtctgaagatttccggaccagagggaatgcatatgtggacaattcagagatctcagggaaagtaattgtgtaggctggcgatcaatttggcatgagggaaaggagagtgacaatcnatatctagctgggaggtgagagaagagcctcaatagtgacagctcagtcaaccaacggaggaaaaaagtaacacccaatgggaaaaggccaccaagagcaacacttacttgccctgcttgaatttcggccctgagtcacctggacacaattgaaaagttagcgaggctgggctgccagtcactgagtagtagtcccatatatatcttcagtcctcacaatgcacacatagaagacagcatattagcaccaatatctggttctcttctctttgctgggcactcagaagactaagtttaccagctaccctagcagtgagttgggccatgtgactagtcctggccagtggcccttaaactgaagtgacagctgttgaatgaggcagtgaaaatccatactacattctccagtttatcttttcctgtccatagagaaaacttcatattgagagagtggggcaggctaaatatttgagtcattccattgatatgaagattataatctttatcatccaaaccaggacgatttttggactgaaaggggtgttgttaataatttgccaggacagtaagcttgagctgaactgtcctgggaaaccaggacatagacnccctacccatggaagaaaagtgactaccctgctgctcagacccgaagttgcccagactttatgtcaataagaaattcagtaagtcagtcactgagaggttggggttgttactccagcataacctagcctatcccaactagtataatagattattctctaaaccaattactagctgaaacttggagagaggtgctttaccccttgaactttctcaaaaagagacaaagcaggtaggggccttcataaagtgttaacttgattggatggggcttccaagaagccaattttctgcccttctcacatcagcaccaaaaggtttacaattcagatagcctggatctttaaaaccataataaaaacaagtatcaacatatatagcattttttattttgtcttattgcatcctcataacatctctctgaagtaagtaggactgggaggatgtattcattttacaggtaactgaggctcaggaaatgtgatctgtcctaagttgcatagtggtgagagggcctccgctgagctccacctacgccccttagggagcacagggcctgaggttacactgaccatattatggccccaagagttgaggctgaaagaggatttggtagagcgacttttctggatgtgctgtggtttacaatatctgcttctttaagagaagctactctgaaatatcatggaacaagtgtcacaagaagcatgcaaattaaatagcaggcccagtgaagaatgtgctgttggcatccatacggctagatgggccagtactgtggattcttaaagcatctctttgccactgttccatcttcttgtccagaaaatataacactataattttatcccaaatacagccaattagattttcttgcctttcttttacacctccatcaaaaaaattagcaacagattaacaccggctacttactgtgctgctttggacattattcagatccagtgtgactgttagtttgacctctccaagctttaatgactaaacatgtgtc

SEQ ID NO: 239883 - DNA, 303 bp, Homo sapiens
agttagttcggcctgtgtccaggaatgaacaaggacagcttggaggttagaagcaagatagagttggttaggtcagatctctttcactgtctcagttacaatttttcaacagcagtttcattagggttctataggtcaagtaaaataatcagtatctacctatggatttgcacatgaggtagacactatagacactgggaagctagctcatcaatttcccggcctcctcccaggcagaggtggttatgtgccattcttgtctgctggaagatgtgcaataaagcctttgctttatagatttaa

SEQ ID NO: 239884 - DNA, 473 bp, Homo sapiens
tgagcaatgtaagttggataacctttatccaaaacacttgggaccagaattgtttcagatttcggatttgtttttttggattttagaatatttgcacagacataataagatatcttggggatgaaaccaaagtctaaaaacaaaatttgcttatgtttcatatatactttacacacataagctgagataattttatacaatactttgaataattttgtacatgaagcaaagtttgtactaagtacttatgtatggaattttctacttttaacttcatgttggtactcaaaaagtttcagattttggagcatttcggatttcagattattgtattatgcatgctcaatatgtacatgcaatatgccttaaaacacgcagaagtatacctacaacttaaaataataaggaattcaaaatgtcaaatctgtacatctggagacatttaataaacatatgtcaacattttaaaatag

SEQ ID NO: 239885 - DNA, 447 bp, Homo sapiens
tctgtaaaaggtataattaccctgctaatgctttacatatggcttgcagctcatgcccaggcccatgcccaggcttgtgcccaggcttgtggcttgcacccatggctcatgcccaggctcgcttgtgctgagatagagtaagaaccgtgtcaaaaccgtctgtgattcctcaagtgtttttccagctccctgccacttgtccacccactgccctcggtccccagcttgggctggaacccgacacttaggatgacaagcattatggtcttgtggatgttaattagacagcattattatagcataaaaaaaaggcacaagcccatttctaataattattgtattttcctaaccagtacatatgattttttttagattatcttgttttctgttcatgatcgcttgacattctatctcttattttattaaaagttgtgacattctttgcca

SEQ ID NO: 239886 - DNA, 569 bp, Homo sapiens
tgagatggaggctcgctctgtcgcccaggctggagtgcagtggtgtgatctcagctcactgcaagctccgcctcctgggttcacgctgttctcttgcctcagcctcctgagtagctgggactactggcgtgcaccgccatgtctggctaatttttgtatttttttgtagagatggggtcttgctatgttgcccaggctggtcttgaactcctggattcaggtgatcccccgtcgcagcctcccaaggtgctgggattacaggtgtgagccaccattcctggccctgaatgtttactttgggccaaatgattttcaactctgaatctttcacagatgagacagtgtgttgagtaattttgtcgagttcttggagtgtataagtgctagatataagtgcttatgccctaacaggaggggctgataataaacaaaacgcagtaatttgggatagttttagtgtcctgaagaacatagaacagggtatgtgatagagtgactgttaggggcagtgtgcaggtggagtggagccacacattattagcctaggttaggttggagaacagtcaggg

SEQ ID NO: 239887 - DNA, 480 bp, Homo sapiens
tgcagattttgcaggcggtgagttccgtgtggtgccataaagatggccacacattctttgtcattgggaggccattgagagttgacataaatttccccttctcttgaatctgggctggccttgtagttattttgaccaatagaatgcagtagaagtgacacttagtaatttccaaggctgacccttaagagatttttcagcttttctatgtgacttgcaacactttcttgaaacacagccaccatgcaagacatctacctaccctgtggccaccagtctgtgaagagcccacactagccataataagagagacagaaagagggtcagggtggaatagcactgaggtaccagatgtggtaacaccttttgaaatgtagccaagtgaaaccagcagaagcaatatagaactgaatgactgcctagtagagccctctccaaatttatgactcacaaataaaatggtggttgttttaagccaca

SEQ ID NO: 239888 - DNA, 325 bp, Homo sapiens
aagagaaatcaaactctaaggaaagaaaatatttttatttcagagttgaggagctgtggcccaaaggctgtggggtgaatattcatttttatttttctttatctttccatgtgctgctttatcccagatatgggcacatttgcagaaagtgcaacagaatgagctaagtaatgcccaagctttctggccagaagatagaagagagaagcttcagagaacagaaattagttgagagattttccagagggaggggctttagaaagtgaactcttatttatgatgaaaaactaaatgtaataaagtgtagtagaggaaatagtaatga

SEQ ID NO: 239889 - DNA, 717 bp, Homo sapiens
tcatgaggtgtagtagtaatatctaagaccttaactgaaatgtttaaagaaacctaggtataacagagaacattatgggtgctgatttccactctcactaaaagccagtgactttactatatcagcaagtataaagcactacttgactctgtagattgtatggaccaagaatgtagatatgagacagctgatctctacgaactgaatttttagtgagtaaagcaagcaagcatgtaatagagaacaataaaagctctgatagacatatgtacaaggtgttgtagaggtacaaaggaaagttattcagactaggcaagagagtgattaaacttaagtattgaagaacaaatagatcatagctctaggggatgtggaacatacaaagtggaaagtttgggaagagtattcccaaggcaaaaagcttagcacatacaaacataggaggaaagcgagacactcttaaagagttgctatgctttgggaggtggaggcgggcggatcacgagatcaagagattgagaccatcctggccgacacagtgaaaccctgtctctactaaaaatacaaaaattagctgggcgtggtgcgcgcctgtagttccagctactcaggaggccgaggcaggagaattgcttgaacccaggaggcagaggttgcagtgaactgagattgtgccactgtactccaacctggcaacagagcgagactcttgtctca

SEQ ID NO: 239890 - DNA, 426 bp, Homo sapiens
tttttttttttaagacagagtttccgtctgttgcccaggctggagtacagtggcgccatctcggctcactgcaacctccacctcccaggttcaagcatttctcgtgcctcagccttccaggtagctgggattgcaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtgttttttattttaattaggattttagtctatagctttttgttttgttttgatgtttacgttgctttggttttgggatcataaaatgaattggagagcgtttcccttctgttttctg

SEQ ID NO: 239891 - DNA, 738 bp, Homo sapiens
agttatattttaataataattctgtagtcactgggccgggcctggtggctcatgtctgtaatcccagcactttgggaggcagaggcaggcagatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattac

SEQ ID NO: 239892 - DNA, 1291 bp, Homo sapiens
acagagtatccggcgtgtgtacgctttggcttagggaatgatggctggtttgatcatctaagtagactagtaaaactttctctataacagcaataaggctattctgttttctcataatttgtgtgttcactagagcaacatctttaatttcctttaaaaatttttcctgcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagtaacaacaactgcgcggggtcgggcgtggtggctcacacctctaatcccagcactttgggaggccaaggtgggcggatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattac

SEQ ID NO: 239893 - DNA, 437 bp, Homo sapiens
tgtctcctgggcctcaagaggcttccgggggtttcagagtgcatgagaccttttgtagtcctctcctaggtgctagctgtgactccctgaacattctggaatgagttaggctggagccaaatggcccagtaccgttgccactagccacagggagctatttaactttacgttaattacaattagcatttcagtttctcaggtgcactagccatggttcaggtattcagtaggcgcacatgggttctgtactggataatgcacatagagaatgtttccattggcacagaaaggactcttggacagcaggagaatagagcctatggctgggcctgtaatcccggcacttggaaaggtcgaggcaggaggatctcttgaggccaggagtttgagaccagcctgggcaacatagtaagacctgtatctttacaaaaaatttg

SEQ ID NO: 239894 - DNA, 95 bp, Homo sapiens
cagccaagatgctaggagcacacacagcaggggccatgcccggggcagccgcacgccacctgttgtttaaaaccaaggccgccagcagttactga

SEQ ID NO: 239895 - DNA, 326 bp, Homo sapiens
tgaacaggttcacggcctaggagcaacaggctgcaccacagacgagcctcctcttccctccggtgaggcatggacaatcagacttctgggccaggcccactgtgccccaccgcctactggagccgtccttcaccgtgcctctagctggatgtaatcaggaactcagcgtgcaccacctcacgtctggctgtttctgcctttgtgatgtccgagaggttcgttcctgtgggtatgcatggctccagctgctcattttcttggccatacagaattcttgttatatacatattttatgattcataaacgctactgttggtgaacaaacc

SEQ ID NO: 239896 - DNA, 460 bp, Homo sapiens
acaaacgtaacatgcatgctgagactattactcctggaccacaactgtagataaacgacaaagtttgtatgttcaccctcataacattttgatcatttgaacttgtgacctctctactggaactgtattgaacttcacctaaaggaattgctggatccaatcgccgtgcctcgtggatcctccactaagatcccagttcccagaccgagatccccgattcccagatccccgttcctgagctgcagcagactccctagcaggactgggtccaacccgccggcaaacaattttaacataaaccgttttcaacttggtaagaggaaatcattttggtttctatcataagtggtccacgtaagtctattctttcaccttaaaactgcttcaaattggaacggtgctcccggggacatagtgaacactccagcctgggcaacaagagtgaaactccatctccaaa

SEQ ID NO: 239897 - DNA, 499 bp, Homo sapiens
cgccctgcagacctgccaccgctgcctcggggttcccctgggaaaggcacccagggagggccgggcagggaagcaggagcccacttggctcctgccagagagtgaacagaagcaaaacgtgcctttggttaatttttcttctaatagaagtaattcagagtcaaatgaaataccatttaaattttccatgaaaataatcaccctgctatttcacatgattttcccaggctttgttgtatgacttggaaaccaggcttgttatgaaggaggcagagttggggtgtacagcgaacaggcatttctcccaagctcacgggcacattttttcaaactgtgttttttaattggcctcttcatgtataaatgaacagtgtaacggacaagcagggcaccttaatcccaacgccacagtcggccagtttgcgggttcaggcctcctttatgatacatgccacaaacacaatatctttgtattaaaaggattttttttttttgctga

SEQ ID NO: 239898 - DNA, 833 bp, Homo sapiens
cttacaggtaagtaaacctgggcccaagtatcacagagcacacagctggaattcacagcaagacctgattgacttcgaagtcagtggtctttcccctgcttcccacgagacagttttgatcatcgatgattttctggttctaatgagatcaaggacatgaagaggctgagtgcctccatgagcttcattattttccatgatctgacctctcattctcttaagctttggagttggatgaaggaagaactctgaaaaaaagtatctgcacccaaggacccacaccaaaggagcagtaccagagggaacacatctgaagagccctatctggatttgccaacatgatttagatgataagatactggactttgagctggtgccataatgggatgaggctttgggagtccaaagggagataagtgtaagtgtatttcaccggtgaagaatgtaaaacataaaaggccagaacatgaactctgcagctaatctccaaagatggctctcagtgaaccacacctcatggaattcatgtccttgcatagtcccctcccgcactgaatctgggttaactttgtgactttctctaactatcagaatgtgacagaagtaacaatatgatacatccctccatttagtgagatcatctttaatttctcccaataatgttttgtagttttctgtgtagaggtcttacaaattttttagattgattctttgacatgtgacttttctatgctgttgataaatgatattttgttaaaatttttattttctaattgcttgttactagcatatagaaacttaattacatatagaaactaagtacaggactttgt

SEQ ID NO: 239899 - DNA, 687 bp, Homo sapiens
cttacaggtaagtaaacctgggcccaagtatcacagagcacacagctggaattcacagcaagacctgattgacttcgaagtcagtggtctttcccctgcttcccacgagacagtatctgcacccaaggacccacaccaaaggagcagtaccagagggaacacatctgaagagccctatctggatttgccaacatgatttagatgataagatactggactttgagctggtgccataatgggatgaggctttgggagtccaaagggagataagtgtaagtgtatttcaccggtgaagaatgtaaaacataaaaggccagaacatgaactctgcagctaatctccaaagatggctctcagtgaaccacacctcatggaattcatgtccttgcatagtcccctcccgcactgaatctgggttaactttgtgactttctctaactatcagaatgtgacagaagtaacaatatgatacatccctccatttagtgagatcatctttaatttctcccaataatgttttgtagttttctgtgtagaggtcttacaaattttttagattgattctttgacatgtgacttttctatgctgttgataaatgatattttgttaaaatttttattttctaattgcttgttactagcatatagaaacttaattacatatagaaactaagtacaggactttgt

SEQ ID NO: 239900 - DNA, 345 bp, Homo sapiens
ttacacaatgtatacatgtattgaaacatcacactgtgccccatgtgtgtaattattatgtcaattagaaacaaaaaaacaaaatgaccacaaaacagccttctgtatctgctgggtctgcatccttgaatttgatcaaccaaggataaaaaaaaatgtggaagaaaaaaccccaaacaataaaaaaaaccaatagaaaaataaaaaattagctattgtaagtaatctagagataatgaaaaatatacaggaggatgtgcataggttatatgcaagtaagtataccattttatatcagggacttgagcattcaaagattttggtaagctctgagggtgaggtggg

SEQ ID NO: 239901 - DNA, 480 bp, Homo sapiens
gtgctaactattgtataggaaaatatacatctatactattttgtcctcagacccactctgtgtgatagggactattattgtttaagttcttgattccctcactccagatattagcctcctcaaccatccccaactccgtaaatgatactatcatctgccctgttgctcaagcttggaacttaaaagccatcactgattctattcttcctctcaatcttacctttttggtcaccccatctgctttcttctaacccatcaacaagtcctgctttacctcccaggtgtttctgaaaattgtctctatacttcagcattaccacaaacattaacacaagccaccaactctcacctcttaactggacaccccacttctccttcagatcccttcccagccagtcagcaaagattagtcggagggaactttcaaaaaaataaatttccctgtgtagaatatttcaattgcttctgttaggatgaaaa

SEQ ID NO: 239902 - DNA, 352 bp, Homo sapiens
gaaagggagtttagcttgcagagtattaaagaatgcccttaggatcaacacctatggaaggcaagggaggaaagcaagggtgggcaaagggagaaatcaagctgcatgaaggccaaatgccggcctggactcaccctacagggaactctggggcttgattggcttcatagaattgtctggagttggggcaaggggtcaagcctttatattcccatatttatcagtcattggatgtagggtacccagaaatgggacctgaggccattgtagaagggcctatcatatgataggtataaactgaccactctctcaacatctgggaaacaaatccttcatctaaggggaatctgga

SEQ ID NO: 239903 - DNA, 594 bp, Homo sapiens
gtatggaggcttcccgtgccccaaatgtttggatgcatataaattacattttactaaaatgtctacacacgagttcatacacgcatgcgcacacgcaaatagcggagaatctggctctaattacttgcactttagttgaactgtggcgtttcctttgaatctctccctaatgtatgggagctgtaggctttgcagtcctgcagtgaatccacagaaaaagggagaaaaaaatccagataggctctctttggtgccaacacaaatgaagtccaaacgaacattttgaccaaacgcaactttgctcttcttccttaattagctgaaattactcccttccactgggattcggagctctgggctcaaaattcccctggggccatgcaggaaatgtcttttgctttataactcctttttcttttaaagctcagctgcccagagagtgcattaaaatactgtcttaatcacagaaggttctagtaaaaaggctaggctttcctaatgcatgatgcctgcctgcctgtaatcaggcccaacctaaaatcctgaaatctgtcaacatcgttttagccagccgtaaattagctctcacaaaga

SEQ ID NO: 239904 - DNA, 415 bp, Homo sapiens
gctgggctcagctgggactgcctcctacacgtggcctctccagcatggtgacgtcacggaagcctcagactcctcacacagatgctggattccccggagggagtgtttccaggggtcccctgcagaatcagcaagcaacgcttctgacacctgcctcggaagggccagagcacctctgctgttgtggtccattggcaagccaatcactaaggctggcctgtactcaaaggaagaattagatcccacctctccatgggccgcgcagcagataattcggggtcttggttaatctaccatgttctttctctccactgcaggtgtgttaaaccggaggccactgggtctcttggacaactagcagtgaatctgtgaatcccctgagtgcacagttttaaataaatgtgcaaaatgtgca

SEQ ID NO: 239905 - DNA, 463 bp, Homo sapiens
aactgaatagaacttggtccttgggatcctgggaaataggggctagttgtgaggcacttcctggggtggtgaagaggaagccctggatagaccttggtaaaagaggaaattgggatatcagccccacgggctatttgcacggtgtgttccgggcttcagcatgtttctacatattttaatgtgagtttaggagggtaggagttctttttcaacttcacagatgaggaaacagcctcatttaaggtcagcagtttaatcagggttacatgacttaagtgtgacagagccagacttgaagtgaggtttgtgactaatgagttttgttacattttcccacctcaccacagttccttgaacttgtcattggtatatctgtttcaggctttctgccttgtggcataccaccatactattatttacataatatttttcttaaataaacacaatttaaaagttaacctca

SEQ ID NO: 239906 - DNA, 406 bp, Homo sapiens
agggcttttctttcttggtagtaagataactgtaggtctttgcagtagtgtcttagattatgtgaaatatggtattttggcaagtgtacatggctaagaacaagtggaatcagaattcaacttaagtttgcttgactccaaagcttatgtgttttccagtataatgtgctgcagtatcaatggtctgtatgaacaaaggccatatcatttttattgacaaagtatagaaacggggaaatggtgactgaactggaacttgcatcatctaattccataactgaggagacaatagcctggggactgcatgtatcccacaggatgttaaaaaattgagaaaatgttatttcatgatcttcacttctctgttgattataacttatttttgaagaggctaaaataaatggca

SEQ ID NO: 239907 - DNA, 332 bp, Homo sapiens
gacctatggatgggaatttataatatccagcaaaattaaatgtatatttgtcctctgacctaaagtccaatattaaaggtttaacctagtaatacacttataaaaatgttaactacatataaagaagttcatttactgcagcttactcatggatgctaaaataattagtaggaacgttgccggggaacaagatattctgggcgtcctgcaagggatggtggctcatgcttgtaatcccaacattttctgagattgaggtgggaggatcacttgagcccagtagttcaaggctgcagtgagctaggatcgtgacactgcactccaccctgggc

SEQ ID NO: 239908 - DNA, 428 bp, Homo sapiens
gagaaagatttcagttttactttgtacaattaaacatgcatggctgcatgtatacatatgcatatttaaaatattttgaagtctttacaccaaatgttaactgaaattatctttggatgtagaatagtggttagtttttatttaatcctttcaactttcctgtatttaaattttttaaagaatacataccattataagcaaaaatacacataaaataaatgttttatttattaaactttaaaaatacatttcaaaacttgcacagaatgattcctggctccagatgaacaagatctggggctctgatgtatggcatgggtggtaatggaaagagtgaatttgactttggtaatcatcacgcattgtatatgtatatcaaatcatcacattatacactttgaatgtattcaatcttgttttgacaatta

SEQ ID NO: 239909 - DNA, 1769 bp, Homo sapiens
  misc_feature (1354)..(1354): n is a, c, g, or t
  misc_feature (1375)..(1375): n is a, c, g, or t
  misc_feature (1403)..(1403): n is a, c, g, or t
aacagattgctaacccacccccagattttcagattttattttatttatttatttatttttttatctgactgattttcagattttaaaaatctatccctagattttctggggtagagtttgaaaatttgtgtttctaacaagctcccagatgacgctgctgctactgcttcagggaccacatttcaagaaccattgatataactctaaaccattcttgtcttcttcctatgtattttccacatcagtcaaagtgatcttttcaaaccataaatctggtcattctactgcatagttttgaaatccattgtcttcccattgcttttaggacaagtcaaaatcctagaagtccctacacagtcccctcctagcctactcgttcagtgacatctcacactaatgctgcccctaccctcaacccactcttcgctgcaccagccaccatggtcacctttcagttcctcaaatttatcaagctccacccttccccaaggtctttccacatactgtttcttccaccaagatgttctccctacccccaagccctccctgaccacaattttgctcggttaattcctacttctcctccttgtgcaatgcgggattggttattaggatcttaacttaaatgtcactttcctaaggaagccttttctaactgcctcagccaagacagatgtctctggtttcctaactagagcctttaattatacatttgtttaatgattatttgagctacttactctactaactggtaagcatcataagagcacagaccatgtttttgtttgctcacaactgtatccctgtgccctgtacacatgaatatttggtaaatgaatgattgattctggaatatttggttgaagaccactagtggacttaggagttcttcccaaagaactgcactttgatctgaaagctcaaatttcttcagttctccttttaccagtacttacaggtgaatcgtctgcagctccatggacttttcttctcataaaccttagtatttcttatttgtagacttactaagtgtattaaggtttaataaaattcaatatggcgcattgttttagtatatataaaatcatgtgtttgagctcatattctttatttttttttcttttgagatggagtttcgctcttgttgcccaagctggagtgcaatgtcatagtctcggctcactgcaacctccacctcccgggttcaagcaactctcctgcttcagcctcccaggtggccgagattacaggcgtgcaccaccatgcccagctaattttttgtatttttacctggccaacatggtgaaacgacatctctataaaaatacaaaattagctgagcttgatggcgggngcctgtaatcccagctactcnggaggttgaggcaggacaaattgcttgnatacgggaggcagaggttgcagtaagccgagatcacaccactgcactccagcctgggcaacagagtaagactctgtctcaaaaaaaaatcgtaaaataaaataaatagataccttccttatttctaactccacgcgtccactcatccactggaggccatactttatgactatggccaccattttgagtttttgtaacattgagatatttggaaatttcatgaactctaccttctagaagattttcccacagaacagcatttaagagtccccactcagtcctcaagcatacgtcaatttttggctcaccatactcagacttgagtgccaaagcccacaggcctacacttctgtctttgaacatgctc

SEQ ID NO: 239910 - DNA, 1228 bp, Homo sapiens
  misc_feature (813)..(813): n is a, c, g, or t
  misc_feature (834)..(834): n is a, c, g, or t
  misc_feature (862)..(862): n is a, c, g, or t
aacagattgctaacccacccccagattttcagattttattttatttatttatttatttttttatctgactgattttcagattttaaaaatctatccctagattttctggggtagagtttgaaaatttgtgtttctaacaagctcccagatgacgctgctgctactgcttcagggaccacatttcaagaaccattgatataactctaaaccattcttgtcttcttcctatgtattttccacatcagtcaaagtgatcttttcaaaccataaatctggtcattctactgcatagttttgaaatccattgtcttcccattgcttttaggacaagtcaaaatcctagaagtccctacacagtcccctcctagcctactcgttcagtgacatctcacactaatgctgcccctaccctcaacccactcttcgctgcaccagccaccatggtcacctttcagttcctcaaatttatcaagctccacccttccccaaggtctttccacatactgtttcttccaccaagatgttctccctacccccaagccctccctgaccacaattttgctcggttaattcctacttctcctccttgtgcaatgcgggattggttattaggatcttaacttaaatgtcactttcctaaggaagccttttctaactgcctcagccaagacagatgtctctggtttcctaactagagcctttaattatacatttgtttaatgattatttgagctacttactctactaacctggccaacatggtgaaacgacatctctataaaaatacaaaattagctgagcttgatggcgggngcctgtaatcccagctactcnggaggttgaggcaggacaaattgcttgnatacgggaggcagaggttgcagtaagccgagatcacaccactgcactccagcctgggcaacagagtaagactctgtctcaaaaaaaaatcgtaaaataaaataaatagataccttccttatttctaactccacgcgtccactcatccactggaggccatactttatgactatggccaccattttgagtttttgtaacattgagatatttggaaatttcatgaactctaccttctagaagattttcccacagaacagcatttaagagtccccactcagtcctcaagcatacgtcaatttttggctcaccatactcagacttgagtgccaaagcccacaggcctacacttctgtctttgaacatgctc

SEQ ID NO: 239911 - DNA, 2028 bp, Homo sapiens
  misc_feature (822)..(822): n is a, c, g, or t
acaagaacacccaagactacaagcagttcattgtttttacagatagacttcagccaaccactgaagcagcagagatggaatttttaaatagacacaaactagagacagttcctttggtaaggcacaaaggtgaggcttctcagccccatagtggggctgcatgcatacagagaaggtctccacctcgggacagcttcttgaatccggtggatatcaactgtcactgtgtgtcagaatcaccttggggcttttaaaaaataatgatgcttgggcacccactcccagagctcaagtttacctgatctaaggcatgtgcctgggcattggtgtttctttagagcgcctccgtcccaggtgaagctaatggatagccagccctactttacgaatgaaccacagctcaaaatcttgtataaacaatttctctctccaacaccttatgtactcagttccactggatgtcttgcgctttatatgcttgaaactgagttcttgatttgggacccttccctacctggcccttgctcagggttccccatcttggtgagctgcactacccagcattctgtagtgaccagaatcccaagaactccccttcattctcatttctctgcccatcttctcccctgcccgcccatatacaattcgttctcggtgctgaggctattactttccaactgcacctagatatgtccacggctcgtcacctcccctgcttctgatgtagtcaaagctaccgtcatttgttctagggctactccctggcctctgggattccacttttgtctctttaagttgttctctgcagagtaggttgagtgnctttttctggcttaagacccatcaaaggctttctgctgtagagaattcaaacccaaacttttgcccaagaccagaaggccctgtggaatccgagcccccagatcccacacctctctcccctgctagttagcttgaagcaccaagctctaaagtctttccatttactgttcttttcaccgggaatgctttttcctccaccctttacaggctggcttcttcttcaccttcatgtcttagtctaagacatgacaattaactgcttgtagtcatgcttttgttttgtttttgtttttgtttttaaatcttggcactattgacatttggggctggaaaatttctttgtcgttggaacttttctgtacattataggatgtttagtctctactcactggatgacacaataatctgctccccagttgtgataagaaaaaatgtctctagacaatgccaaatgcctcatgaggacaaaatccctgccaactgataactactagcttaaatattaacttcttgaacaggtattctctgttctccaggctttaagtctccaggtgtatttctcaatcttcatatcctatttgttactttcatagaacttttctcaccttgaaattgaatatttatctagtaaatatctgtgtcatagtcccactagactatcttgactatttcattcaattctgtaatgatagcattgcgtacggctcctggtatgcagtagatgcttaataaacttctgttgaagaaatgcatgcacgcatgaatgaatgcatgagcaaacaaagactgctaggcaggcaagtgccttcccgccagggttagagagattatctagcagtgcaaaaagaccatggactaaaaaggaatgagataatgccccttgcagagacatggatgaagctggaagccatcatcctcagcaaactaacacaggaacagaaaaccaagtaccgcatgttctcactcataagtgggaactgaactatgagaacatagggacacagagagagtaacagcacacatcggggcctattggggtgggggtgagggtgaggggaggggaagtatcaggacaaatagctaatgcatgcagggcttaacactagggtgacgagttgataggtgaagcaaaccaccatgccacacatacagctatgtaacaaacctgtaagttctgcacatgtatcccggaatttaaagtaaaat

SEQ ID NO: 239912 - DNA, 193 bp, Homo sapiens
atgcaaatatgtaactagcctgaattgccgtataataatttaaacaatctggcaattgtaggatggcagtgtctctctcccgccctacaaaagatgcattgttcccttggcatttatcacatcatttagtggtaaagatttcttctgtaaagagaatgcagcttgactttaataaacagactttaaaaatagc

SEQ ID NO: 239913 - DNA, 350 bp, Homo sapiens
aataatctcagattgcttattatttttcagaaggctgtatttttagtcttaggctattggtttgtcttatattgcaggattttaaaaaaatgattagttcccagcactttgggaggctgagatgggcagatcacaaggtgaagagattgagaccatcctggccaacatggtgaaaccccctctctactaaaaatacaaaaattagctgggcgtggtggcatgtgcctgtagtcccagctactcagggggctgaggcaggagaattgcttaaactccagaggtggaggttgcagtgagccgaggtggtgccattgcactccagcctgctgacagagtgagactccgtctca

SEQ ID NO: 239914 - DNA, 909 bp, Homo sapiens
ctcactctattgcccaggctggagtacagtggcacaataatgggctcaagtgatccctcccaactcagcattcctagtagctgggactacaggtatacaccaccgcccccagctaattttttgggttttgtagagatgtaaagacagggtttcactatgttgctcaggctggtctttaactcctgggctcaagcgatcatccctcctctagctcccaaagtgttgagattacaggcataagccaacacacccagccgcttacatttctctttgaatagtccaatatataaataagtgtctccttaaactctaaaagcattttagaagagagatgatagaaggaagaagaaattaaacagaaagggaaaaaggtgagggaattattttaaaaaaggaaattagataatgggacaatataaaagcttccagtatgctagactggcagaactaaaagagatcttaactatcatgtagccaactttttataatatatattagataaatgagaccattgtaagttaagtgatctgccaattcacaggtaattaagttacagagcacaaactagatccaagattccagagacttccccgtcaactgcttttaattgctcacactgagatatgttatagggagtattatcaatttctagacccagttattataattcctgtcttacacaaagtgtggagaagagttcaagcacaataatgcaccaaagaaatttagaaattgcaagttaaaaacaagtccagagaaatcaacacattttattttattttatttttatttatttattttttgagacggagtctcgctctgtcgcccaggctggagtgcagtggcgtgatcttggctcactgcaagctccgcctcccaggttaatgccattctcctgcctcagcctcc

SEQ ID NO: 239915 - DNA, 441 bp, Homo sapiens
ggtgaccgtcggtggtcggaaaagtctttgtggctgaggagtgagggcaaaggggcatgtgctggcacttcctgcggccgactgtgacaatggaatgaaaagtcccctggaagggaggacagagagttgagggcaggaccttgggttctggcatcacagagggcactggaagaagaaatggaacaagggaaagggacttgaaacagtcacacgagaggagctgaagtatcaatacttcagagatggactcctgcatcttagggcagggatcgggaaatcactgcctgcctctgtttttggaccgcctgaaagctaagaatggtttttactttcttacacggctgaaaaaaaaatccaaaaagaaaaacaatctttcatgacacatgacaatttataaaaactggaattctagtgtctataaataaagttttattggaacgc

SEQ ID NO: 239916 - DNA, 481 bp, Homo sapiens
taagaataaatttgggggcagaatttccagaatagtagctctttctccccataacttgtgaggattaagagaaaaatgccccaaactccatccttctcatgggccccttgtcaaaccaaggtgactttctgaggtagccactcactgggtgccagaaaaccctgagcctgtttatccagaattctctgtgcctgtgccataagcaaaagttttgtgtctttagcagagatgatattgttccggggtttggctttccctcacccccaggggcacagtagatgctaatgactttgtaacggcagcagggggtcatgacagggagctgctgtgtgttgaggagagaaggcatgtttctttcttcattgtgtggagagcgtcacaagccactctctttccatctgcccatcatgctgggagttgttcagatggccaatggaggagcaggctgggactagtccttggcagggctccgcagaagggc

SEQ ID NO: 239917 - DNA, 443 bp, Homo sapiens
acagggggtaccggtaccggtccttggcctgttaggaaccacgcaggacagcaggaggaaatctgccggcatctctcagaaagaaacaccaaaaaagactgttgatatggaatcaactgaagtattcaccaagaaaactgagctgactgaagaagaaaagaatgaccaaaaacatctgaacaaaatcaaccagtattatcagttcaccttgccccaatatgtaaaagctgtttatcaatatcacaaaattatgaaaccatggaaaaacatgaagacaaatgcttaccaagttatccccactctgggatctttaagattcttgaattaactgctcctactttactttggaaacaatttctccttctacctcatagactgtattgactccatcaagcatgaacacagatagttattaacaatcttattatgtgccatgaattatc

SEQ ID NO: 239918 - DNA, 599 bp, Homo sapiens
gattagattaaatataattcttttaacgtggccagaggaatcagtcttaaaagcaggaaatactttctatacaaaagtttcacctttccgaatgtcatgatgtagttttaaaaaaagcctacctttcattgtatataatttttcaaacgtaggcattctcaatgcccaaatatagagaagcaattcagtaattagagtatggttacagctatgtataattttttaaaaatgtgtagaagaaaagctgaaagtctatcattggcagtagttattaggaaatgctattcttttacctttgagtacttttgccacagacagtgtaaatgtatttttatcatcatttcatcttttaaaataaaagacaataattgtgaaattaaattgttgggcttataacatgtaaagatgaaatatatgacagtaattgcacaaagaaaggagctatattgaaacagtttctgtatacttctagaatccagtaatcccaaagtaaaaacaagaatgaaataataaacagaataattgaaatcagtggaattgaaaatgggcaaatgatagagaagatagatggaactaaaaaacaaataaggattctttga

SEQ ID NO: 239919 - DNA, 527 bp, Homo sapiens
aatttagaaatgctttttctttactcctcatccttgcatctatatatatttagcacatataagtaattatttaagtccacaaacaaggtttggtgcacatttggattgacacctcacaatgactccacagatggctggcacctctgtggtccccaacttgcagaatggaaaccatggttctcaaagtgtagttcccagaacagcagcatacatatcacctgggaacttgtaaaaaactcaaaagtcctggacgggtgcggtggctcacgcctgtaatcccagcactttgggaggccaaggcgggtggattacttgaggtcaggagtgcaagaccagcctggccaacatggtggaaccccatctctactaaaaatacaaaaattagccagtgtcgtggctgtagtcccagctacttgggaggctgaggcaggagaatcacttgaacccaggaggcggatgttgcagtgagctgagatcgtgccactgaaccccagcctgggcgagagagcaagactctgtctccaaaa

SEQ ID NO: 239920 - DNA, 411 bp, Homo sapiens
gtatggtgtcaggccatggctgaagcccatgctgactttggtcttagggatttcccactgggtactctctgagtttctgaggacctggctgcagccactctggttacatcaggaggaaaaggtgacggacttatctcccacagcctacactctctcagaaagttcccaacacgaagaaatgataaatgtttgagatgatgggtatgctaattactctgatctgatcaccatacattacatgtatcaaaatatcactatgttctcaataaatatgtataattattgtatgtcaatttttaaaaaagacagttaaagtcatgaagatgcaaacatggaaagccctccttttcaagaacaggagtctcttctgtatttggagaagaccaaggaccaaaaaataaaccactcttt

SEQ ID NO: 239921 - DNA, 361 bp, Homo sapiens
tctcaataagagatagaaaaagcttggcagaagataagtaaggaaatagaggacttaaataacacaataaacaaaatatatctaacagacatgtatagaacactttacccagtaaaaatagaatacatttttctcaagtgctcatgaaacattctccatgacaaaccataggttagatcacaaatcctcagtagattttagaagataggtatcacgcaaagtatattctttgaccacaccaagatgatggtaaaaatcaatcgcagaaggaaaactggaaaattaacaaatctgtggaaattaaagcacatattcttaaataactaatgaatcaaagaggaaatcacaaggaaatttagaa

SEQ ID NO: 239922 - DNA, 358 bp, Homo sapiens
cagcacagcacagaacaaaacagacacagctcctgtccccgggctgacagccaagtaggagagatgaatgttcaacaatcttgcacataagcagtaagtgccatggtgttagccagcgttctccagagaaacagaaccaataggatggatatacagagatatagaaaaagatttattatgaggcattagctcccatgattatggacgctgagaagtacccaggatctgccctccgcaagctggagtagttccagtccgcgtctgaaggtgcaagaatcagagcatggatgtctgaagcagggaaaatatggtgtcccacctcaaagaagagcaaatttgcccttcctctgccttttta

SEQ ID NO: 239923 - DNA, 356 bp, Homo sapiens
actttagttcaattttatagctagggaagtgggttcagaggcaaatgacttcataagttaaaaggcaaattctcagcgatttcctggccattgctctgaggaccattgttgactctctcttgttgaatataacccatataaaaatagagtctaagctttttttgcagggggatggagtccccctctgtcatccaggctggagtgcgatgacacaatctcagctcactgcaacctccgtctcccgggttcaggagaatcccttgaaccaggaaggcaagagttgcagtgagccaagattgcaccattgcattccagcctgggcaacaagagtgaaactttgtctcaaaaaaaaaaaa

SEQ ID NO: 239924 - DNA, 1159 bp, Homo sapiens
ggcggagcctaggagtcagataccgcgagaagtagtctcccgaagaggttcggacaagcgcaggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgatta

SEQ ID NO: 239925 - DNA, 1452 bp, Homo sapiens
ggcggagcctaggagtcagataccgcgagaagtagtctcccgaagaggttcggacaagcgcaggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacc

SEQ ID NO: 239926 - DNA, 344 bp, Homo sapiens
gtgagtcctccgcggagggggacctgccagggatgtgggagcggaggacccgctccaccggggagggatgccacggttcccggcagattctggaggcttctccatgtttccctgacacccccaaaacagggagttgaagtccatgctccagtcggcaggtattcgtattaaaagcagttctggtagccgacaggtgaattagatacgatctttcctctcaaggagggtacatgtaaatatgtcgttccaaaacgtggcacagtcgtgcaaagcaggagggaagaaacggtgccaggtagtgactcgccgagaatgagaccgaactaattcacaaagggtgtaaa

SEQ ID NO: 239927 - DNA, 2473 bp, Homo sapiens
tttctgctacagacaggccagggacttagacacaaatggcgagggatgaggagcttgatgacgtgtcaagggggattagatatcaagtgtgggggatgaaaagcaggattcttgctggaactgagcttgccacggttggacgtggaaggccaatgttgaggcctagtggagaagagggcttggaggagcctggctaaggtttggtcaaggagagtctgtcacaagatagacccatctgtatccaggctaacgcaatagggtgaccaaatgcagcccgcacgcttctctgtgtttctctccaggtcctttgggcacttagtttataattttttattttctattttttatttttatgggtacatagtataggtgtgtatggagtacatgagatgttttgatacaggcatgcaatgtgtaataatcacatcatggaaaacagggtattatgggcacttagtttagccataaggcttccgtgccaagtggcctgggagccagctggggccagcttctgccacaggcatccttcacccacccttctcacaaacaagcgattcttcaataaacaataaacagaatacacaaaaagcaaaccaaaacatctctagatttattaatagatgggtgaattaaaggagtcttttccaaataatgtgactaacagaagccaagggggatgaatgcccaaagctggggcttgccagaacctgctggtaccgagagctgattgctgaagtgtgaggaattttgtgagccagctgacagcacattggcagcttgggatctgccagggcgggattgtttacaccacaggatttagcaaacgttatgaatcaacccctccatcggccccaagcttccctgacacaccaaacagtagaaattcactgcctttttttttttttttttaactctgcttggtgttagctaactagtcatgaagaatagaggctgaagtgaccaaagagatctttctgcattttgacattcaaatatttggaaagattttccgcattcagcatttggattctagtcccattgccaggctcaagtaagctctgtgataacaacactcagctgttggaaactgctgtccgaagcatctctcagcagatagggaggcctaaaaggacacggcagagtggtgtctggtgggtcctctcctgacatttcttctctctctggtcaaatgctggatgcacacatatagtggctctgagacttcctatctgggtgagctcaggcagttctagggacctctctgagccctagtttcatgtcctgtacaacagtagtcattcctactgcacatggttcttgagaagattggaccagaacatgtagctctggctcctggcccagacctgatcaacactcagcaaatagtggacactgatgctgttaggagaacagagcatccatatgaagggcggttccctgagctggggagaccagtgacaactgtaagtctgggttcagagcatgagtcgggggacggagaaggcccctgggcatctggccctgggtggctgagccctgggaatcctgcttttcccagagatgtgcttgtgcccagtgtgctcatgttttaaatgccagcacctactccaggaaaatgatgggtatttcaatatctgctcacattatgcatatttaaatatgaatttaaatactgtttaattctcctagggatgtgttgtcatttaaaagaggttgtgattagcatgaaggactggggacaggagcaggagatggcagagcagctgtaggcactgatgtaatgcctccagctttatgaggacgggcccaaccaggcttcacccatttggggccctcaagcgggagcgtcagtggcagccctcgccatcgtccgtctgttgaatgtattgccacatggccacattatgccccaggagccatgtgttggaggacagtatccttaggcttctcagaaattccacatgggagcctcaaatggacatgcttttcttgaaaacaaaaatatttgtaaaaatgtaacaatgggagtcgtttaatctcaagtctcccctataagcaaaaatagataaaattatgaaatgtaagatgtaaattattctgtttcttagctgatccttaatcttgatgatattttcaaaacaaatgaataataaagacatgagaaaaggtttcctttaaaaagtcgtggttctcgccaggcgcagtggctcatgcctgtaatcccagcaccttaggaggccaaggcaggcggatcatgaggtcaagagatagagaccatcctggccaacatggtgaaaccctgtctctactaaaaatgcaagaattagctgggcatggtggcgcatgcctgtagttccagctactcgggaggctgaggcaggatttaaatactgtttgaacccaggaggcggaggttgcatgagccgagatcgcaccactgtactgcagcctgacaacagagtgagactctgtc

SEQ ID NO: 239928 - DNA, 2335 bp, Homo sapiens
tttctgctacagacaggccagggacttagacacaaatggcgagggatgaggagcttgatgacgtgtcaagggggattagatatcaagtgtgggggatgaaaagcaggattcttgctggaactgagcttgccacggttggacgtggaaggccaatgttgaggcctagtggagaagagggcttggaggagcctggctaaggtttggtcaaggagagtctgtcacaagatagacccatctgtatccaggctaacgcaatagggtgaccaaatgcaatgtgtaataatcacatcatggaaaacagggtattatgggcacttagtttagccataaggcttccgtgccaagtggcctgggagccagctggggccagcttctgccacaggcatccttcacccacccttctcacaaacaagcgattcttcaataaacaataaacagaatacacaaaaagcaaaccaaaacatctctagatttattaatagatgggtgaattaaaggagtcttttccaaataatgtgactaacagaagccaagggggatgaatgcccaaagctggggcttgccagaacctgctggtaccgagagctgattgctgaagtgtgaggaattttgtgagccagctgacagcacattggcagcttgggatctgccagggcgggattgtttacaccacaggatttagcaaacgttatgaatcaacccctccatcggccccaagcttccctgacacaccaaacagtagaaattcactgcctttttttttttttttttaactctgcttggtgttagctaactagtcatgaagaatagaggctgaagtgaccaaagagatctttctgcattttgacattcaaatatttggaaagattttccgcattcagcatttggattctagtcccattgccaggctcaagtaagctctgtgataacaacactcagctgttggaaactgctgtccgaagcatctctcagcagatagggaggcctaaaaggacacggcagagtggtgtctggtgggtcctctcctgacatttcttctctctctggtcaaatgctggatgcacacatatagtggctctgagacttcctatctgggtgagctcaggcagttctagggacctctctgagccctagtttcatgtcctgtacaacagtagtcattcctactgcacatggttcttgagaagattggaccagaacatgtagctctggctcctggcccagacctgatcaacactcagcaaatagtggacactgatgctgttaggagaacagagcatccatatgaagggcggttccctgagctggggagaccagtgacaactgtaagtctgggttcagagcatgagtcgggggacggagaaggcccctgggcatctggccctgggtggctgagccctgggaatcctgcttttcccagagatgtgcttgtgcccagtgtgctcatgttttaaatgccagcacctactccaggaaaatgatgggtatttcaatatctgctcacattatgcatatttaaatatgaatttaaatactgtttaattctcctagggatgtgttgtcatttaaaagaggttgtgattagcatgaaggactggggacaggagcaggagatggcagagcagctgtaggcactgatgtaatgcctccagctttatgaggacgggcccaaccaggcttcacccatttggggccctcaagcgggagcgtcagtggcagccctcgccatcgtccgtctgttgaatgtattgccacatggccacattatgccccaggagccatgtgttggaggacagtatccttaggcttctcagaaattccacatgggagcctcaaatggacatgcttttcttgaaaacaaaaatatttgtaaaaatgtaacaatgggagtcgtttaatctcaagtctcccctataagcaaaaatagataaaattatgaaatgtaagatgtaaattattctgtttcttagctgatccttaatcttgatgatattttcaaaacaaatgaataataaagacatgagaaaaggtttcctttaaaaagtcgtggttctcgccaggcgcagtggctcatgcctgtaatcccagcaccttaggaggccaaggcaggcggatcatgaggtcaagagatagagaccatcctggccaacatggtgaaaccctgtctctactaaaaatgcaagaattagctgggcatggtggcgcatgcctgtagttccagctactcgggaggctgaggcaggatttaaatactgtttgaacccaggaggcggaggttgcatgagccgagatcgcaccactgtactgcagcctgacaacagagtgagactctgtc

SEQ ID NO: 239929 - DNA, 407 bp, Homo sapiens
ccaatggaacaggacagagaactcagaaataaagccaaatatgtataaccaacctgatcttcaataaagcatacaaaaaagtaaattaggaaaggacaccctatttaataaatggtgctgggagaactggttagccacatgaagaagaatgaaactggattcctatctctcaccttatacaaaagtcaattcaagatggatcaaagacttaaatctaagactcaaaactggaactagaagataaccttggaaaacctcttctgacattggcctaggcaaagaattcatgactatggtggctcacgcctgtaatcccagcactttgggaggccgaggcgggcggatcacaaggtcaggagatcaagaccatcctgatctcagtgaaaccccgtctctactaaaataca

SEQ ID NO: 239930 - DNA, 406 bp, Homo sapiens
tatgacagttgtatttattttggtaataatatattacaagcaaatattatagaaactaacgacattgtgaataaaagagtgtcttatttctatgaagactaagttgaagtctttggaaaggttataataaaggtaataaaaataatcaaattatgtgtgggcaagatgactacaaaagattagagaaaatcttaaattttcaaaaggttatatactctgattattgtaagaatctttagatttccattgtatttaaataaaatactaaagcctaaggattactgcaaataagatgtcttaagacttcaaccagcagattcattctttaattaaaaaaagcctttgttatatataagtacattggcaaatgtatacatttttagataaaataaaaaaattaaaacct

SEQ ID NO: 239931 - DNA, 442 bp, Homo sapiens
gctcaactgggtgagtaagtcacaaaaatctgttcttttgttatttactaagtgttaggtaatctgaaatgacaggaatgggaaaataaaacattaaaaaatttgtgaagaaatatgagatttaaagaacatgagcaagaaaatgtggaaaattcatagagtgaggccaggcgcggtggctcatgcctgaaaccccagcactttgggaggccgaggtgggcagatcacaaggtcaagagatcgagaccatcctggccaacatggtgaaactccatctctactaaaaatacaaaaatcagctgggtatggtggcacacgcctgtagtcccagctactggggaggctgaggcagaaggattgtttgaacccgggaggcaaggttgcagtgagctgagatgacgccactgcactccagcctggcgacagagcaagactctgtctc

SEQ ID NO: 239932 - DNA, 383 bp, Homo sapiens
ttttatgaggttggtatttacctaatatcaaaaccagatatggaggcatttgaaggaaactttaggcaaatattcctcagaaacataaatgacaaaatttgaggccaggcacagtggctcacacctgtaatcccggcactttgggaggctgagtcgggcagatcacctgaggtcaggagttcgagaccagactggccaacatggtgaaaccccatctctactaaaaaaaaaaattggccaggtgtggtggaatgcgcccgtagtcccagctacctgggaggctgagacagaagaatctcttgaactcaggaggtggacattgcagtgagccgaggtcgcactgctgcactccagcctgggtgacagagcgagactacatctcc

SEQ ID NO: 239933 - DNA, 460 bp, Homo sapiens
ttcagctttctggcttcactgtgggatccagcatagaacatgattgagctgtcagagaacctcctgaaggaaagttgtacctgataagtaagagtttccagaaaaatggtgacacatacaggaagaaaaatagattgtttaactcagtctgaaaaatcccttttgattcataaactgtctacatgattgaaacatacgaaaccatctctttctctaagcagattcttctcaattcacatacaagcacctcaggggcaaataaaacttctctgtgtaggcatgaggaggaatcactttagcagaaggaaaataaggtgctgtagaaatgagaaagtgctgtagaaatgagaacacaaaatgctaacctggaggagagagggtggcagagtgagtgaaagagagggcatctgatgccgtttaaatcatttttaaggaaaactaaacatcctgattggaaaaa

SEQ ID NO: 239934 - DNA, 555 bp, Homo sapiens
ccatgggtcatgtgggaggtccatatgcaaggtatcccagtggttggtgaggcttcctgatggagtctgtggagtgctgagtaggtttcagagcctttcttccctgctcccagcctttcccaacgcttagctatgacagtcacctcaatattttaattggagcaagaaagaggtagggttcttaggcagcatcccacacagctaggggctgagcactctcactatgctatcaccttctcccatgggagaaattgtggactgaggggagtctctcttgccactaagctgtgccaacttcaaagagtgatgcagataaagtgaaaatcttcttcttccttttctttaatgcatttattctcagatatttctgctccaatggtgtgctggaacttccacataggacttctggattcctacaaaagaactaccatctgaaagtactggtaaaaatcaatgcttctgtggaagaatgatgatataaagctcctattctgccatcttgctaacatcactctctaaagttacttttaaaggaataaaatattttagtatcta

SEQ ID NO: 239935 - DNA, 390 bp, Homo sapiens
ggcacacagagtttacaggaaacagtccttaagtccttaggggtggcccgagcttctgttgcctccttctagattgattataggctcagaaatgggagagacttgggccgggcatggtggcttatgcctgtaatcccagcactttgggaggctgaggcaggtggatcacttgaggtcaggaatccgagaccagtctgatcaacatggtgaatccccatctctgctaaaagtactcaaattaactgggagtagtggcacgtgcctgtaatcccagctactcaggaggctgaggcgggagaattgcttgaaccagggaagcagagggtgcagtgagctgagatcacgccactgcactccagtctgggcgacagagtaagactcctccgtctc

SEQ ID NO: 239936 - DNA, 414 bp, Homo sapiens
cggccagtgaggagacagacgcatgaatcatacttccagtgaagaccgtccgtgcgagtgctgtgaggtacaggcttacaccaagggctcctcaactcattcttggaggggtgagcttcaaaaaagcttactggggccgggtgcagtggttcatgcctgtaatcccagcactttgggaggtggagacaggcagatcacaaggtcaggagtttgagaccagcctggccagcatggtaaaaccccgtctctactaaaaatacaaaattagctgggcatggtggcatgcatctgtaaccccagctacttgggaggctaggcaggagaattgcttgaaccctggaggcggaagttgcagtgagtggagatcgcgccactgcactccagcctgggagacagagcaagactctgtcttgg

SEQ ID NO: 239937 - DNA, 220 bp, Homo sapiens
gtacttaagactctgaggaaaatgggggaaggtgtacaagtaggaagggggtttggaagcacaccaggaaacagcaactgtccatttgagttgctgcattgctaggactagactaattctagtcggcttgcgatgcagacaacaggtggggcaactctgactgtctccaggacttcggatagactgttcagacctagtgggcctctcagaggtctgggtc

SEQ ID NO: 239938 - DNA, 947 bp, Homo sapiens
atttgaaaagattaatttacattatacttcttcaagaatagatttctcaggtttttataggttgcaaatattttgtaggataatgatttattgacctcatttttgttttcttaaacatcaataacttttgtcattttttataattattatccatttttcattgaatttcctgtttacacacaccatcaaatttcatattggactatatccctcatacttcacttaaagtttgtcagaaatttccagtatttttaccaaaaaaaatcgttattaaaagctggtgattaagaatcactgacattcaggtgtttggtattgtagttggaatttctgtgaaatgggccagagactcccatttgtaatacagaattatacagtaaatggttacatagctgaatgatcatatttctcaggtcaaggtttaggtaggacacattttgccctgaaatcacacagctaaattgatgtgctatttgtaactgggtgtgaggaattctcatcatccctttactatgtctcacagggagtgcttgcaccttagtgggagaggcttccaggcctttctccagaggagttatggtaactgtcttgagtagctttctcacattatattcaactcttggtgaagatgtgcttgctaaatttaaatattttcaaatgtaatgattggggtaaaactttttcttaagtgttccttacaaatgaagaaagaaaatattgactgtgcagaccacaaattgctgagtattttttaaaatatgatttttaatcttaagacctcaatgtcaacacgagagtcattgtagtactattccaggtaatacatggtatattcaggtattgcatgtgattgcagtaacttgtagccacatttaatgtaacttgtattcagtgttttgtctcactggcctgatgcccagagccttcttcatctacccagtgttaaa

SEQ ID NO: 239939 - DNA, 470 bp, Homo sapiens
actacaagagaaaatggctggggaagtgcttggctaactctgcctcccttggctaaacctggaagtgaaatccagggaactgaagttggagttggctgctggatttgggtaggaatagggaggttgtggccacagggcactgcatgtctaggtggtatttcttactctcggtaccaatttcaaaaccaaggggatgagtccaaattaaagaagatccctgattaggcacaaaactcaacttggctgtttggaagattctgcactccctttaaggttggccagggtctcttgcctccaggagtgcacagttctggaaacacaggcagaaccatttgacatgggttgggagacccaagtagctgcctggttaacagactgcttatcagtgtctctgggaagatctactttgacagtccagcccctgcagatcctcatgaattagaccgctccttaaaataacaaaccaacct

SEQ ID NO: 239940 - DNA, 1858 bp, Homo sapiens
  misc_feature (26)..(26): n is a, c, g, or t
  misc_feature (171)..(171): n is a, c, g, or t
  misc_feature (634)..(634): n is a, c, g, or t
  misc_feature (648)..(648): n is a, c, g, or t
  misc_feature (1059)..(1059): n is a, c, g, or t
aaaaaaaaaaaaaaaaggggaaaaanaaatgaataaagtgcttgggtagttctgatgagagagattatgtctaagaatacatcagggatggcttcatggaggaaaccatttttaatcttggccttaattaatagatacagagaaagaaagataaaaataaagaaaatagcntggcattccaggcagaatgaacaataaaggaaaacaatattgccttttgcaaaaatacactgtttttttttttgagggactctgtgttttcattgtttgtaatatcacgtctccgtgttaaagacctgtgtgtaattttcagtcattaattatgcacggatgatttctccctatgcagaatgctgtttgggcttaatcaggcaatcttttaaaagatgtagtctctagggatttgctatttaagaagtggaactagctacgttataattaaataattcctgctacagtaccatgtaaaaggtcattcatcattcaacatttatttattctacaaaatatttatcgagtgcccattatatatctggtactattctaggcaatagagatacacataagtcaatatttatccctcatggggcctaatattctttttttgttctttttttttattattatactttangttctagggtacangtgcataacatgcaggtttgttacatatgtatacatgtgccgtgttggtttgctgcacccgttaactcatcatttacattgggtatttctcctaatggtatccttcccccatccccccaccccacgacaggccccggtgtgtgatgttccctgccctgtgtccaagtgttctcattgttcaattcccacctatgagtgagaacacgcggtgttcagttttctgtccttgtgatagtttgctcagaatgatggtttccagcttcatccgtgtcactacaaaggacatgaactcatccttttttatggctgcatagtattccatggtatatatgtgctacgttttcttaatccagtctatcatcaatggacatttaggttggttccaagtctttgctattgtgaatagtgccncaataaacatacgtgtgcatgtgtctttatagtatcatgatttataatcctttgggtatatacccagtaatggggtggctgggtcaaatggtatttctagttctagatccctgaggaatcgccacactgtcttccacaatggttgaactagtttacagtcccaccaacagtgtaagtgttcctatttctccacatcctctccagcacctgttgtttcctgactttttaataattgccattctgactgatgtgagatggtatctcactgtggttttgatttgcatttctctgatggccagtgatgatgagcattttttcatgtgtctgttggctgcataaatgtcttcttttgagacgtgtctgttcatatcctttgcccacttttcgatggggttgtttgatttttttcttgtaaatttgtttaagttctttgtagattttggatattagccctttgtcagatgggtagattgcaaaaattttctcccattctgtaggttgcctgttcactctgatggtagtttcttttgctgtgcagaagctcttgagtttaattagatcccatttgtctattttggttttgttgccattgctaatattcttaaattatatttaatatcaaacattctaagaaatcactctgtaatgaatgtaaaaccactttgggtagagagtatgataccagtagttctatttaatcttccttttaaacaaatatatatttattttaaaacatgggtttttcatgattttttttttggttaaattttcagcaatgtgtttaatactccaggatacc

SEQ ID NO: 239941 - DNA, 2384 bp, Homo sapiens
agggcgggttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtactcctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacacgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaaacgcc

SEQ ID NO: 239942 - DNA, 3048 bp, Homo sapiens
  misc_feature (2471)..(2471): n is a, c, g, or t
  misc_feature (2681)..(2681): n is a, c, g, or t
  misc_feature (2759)..(2759): n is a, c, g, or t
  misc_feature (2784)..(2784): n is a, c, g, or t
agggcgggttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtactcctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacacgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaaacgcctattatttcatttactagcattttaggatccagaagaattccaccagattgcatgagttagattgggaaatgggagtgggagataanattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctangcagaatctgtttctcctgaatctctgtgatgctggtgggaattgtttgcatagaggaaggacaataaccctgccatngtgagttaatgtccgggctggtcanagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcag

SEQ ID NO: 239943 - DNA, 491 bp, Homo sapiens
  misc_feature (488)..(488): n is a, c, g, or t
gcctattagagaagaaagattggaaaaaataacatttgtttttcctcttcatcagttttcaaccttggcctttaaattatgatttaagagtccctcctctcgagagatgagtagtttcctctgtggagtaatcaagcatcagaggagcctgagcgtaatgttaatgttctgagtgcttctgaagtgacaggaagtggtgcatatgcccagggacaaagccaagttgaggagcagaaccacagcactttgggaggccaaggtgggcggatcacgagatcaggagatcaagaccatcctggctaacatggtgaaacctcatctctactaaaaatacaaaaattagctgggtgtggtggcacgcacctgtaatcccagctactcgggaggctgaggcaggagaatcgcttgaacccgggaggcggagcttgcagtgagccgagatcaagccactacactccagcctgggcgacagagcaagactccatctncag

SEQ ID NO: 239944 - DNA, 534 bp, Homo sapiens
cagtatatacctgagaagagtgatttctgtgatcaaagagttcaattcagatttattcagaaagagctactcagaagctctatagttcatgagctacttgatattttctagagatcattttatgttaagctattatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtacctaaaaaaaattca

SEQ ID NO: 239945 - DNA, 284 bp, Homo sapiens
ggtggtgggcacctgtagtcccagctactgaggaagctgaggcaggagaatggcgtgaacccgggaggcggagcttgcagtgagcctagatcgcgccactgcactccagcctgggccacagagtgagactccttcggggggggggggggggggggggaatccaaaaatcagccggacatggtgccatgctcctatagttccagtcacccaggaggcggaggttgcagtgagctgagatcacgccattgcacttcagcttggtcaacaaagtgagactctctttc

SEQ ID NO: 239946 - DNA, 618 bp, Homo sapiens
tggcgcgatctcggctcactgcaaatctccgcctcctggattcaagagattcttgtgcctcagttctggcagaaggtggtgtttttacaagatgatttctaggattacaggcatgcaccaccatgcctggttaatttttgtatttttagtagagacgaggtttcgccattttagccaggctggtctcgaactcttgacctcaggttatctacccgcctcagcctccctaagtgctgagattacaggcctgagccactgcgccaggcctggttttttggtttcaaaccacaatagacattgctggagaatcaagctcatagtttctttttactctgcatgatatccctccaaaagcttgtctattctcatgacttcatgacagttctttgccaatgatttgcaaacattatctccagtcttgattctttcctaggctttatttctaaatactcactagtcatttccacttagaagctttgtcttcttttcaaactcagcatatccaaaactgacctcatcttgttgccctaactagaacatgccacaacccatttctgcctataatgtcattattctcttaaggcccccatatttgcaaatcaggagtcatctttgcct

SEQ ID NO: 239947 - DNA, 247 bp, Homo sapiens
gcagaatgcattaaaatattacccaatagagctcatactaacctatgaaacgtctcaaaaaatcaacatagtttaaagttatacaaaagacagtgtctatctacagtggaatttacaaaactatcaatacagagagtcatctggaaaaatctccatatattgggacatcaatgaacatgtatctaaatggtccagaggagaaatcacaagatactttagaaaatatgttcaactgatagaaaatgaa

SEQ ID NO: 239948 - DNA, 643 bp, Homo sapiens
acttgtgtaaggctcccgtggggtcattggcttaagttagagctggctgatgaagagggcgagcacctcaaagtgtgagtatttctccagatcccttcactgtagcaggtgggcagcctcgcccactatacttctgcccctttcaaagcaggtgggcagagaggtgtttgtggtaagaaagacctagaggcttttgttcgctgattcttcttccttcatcagccatcaccagaccttagatgtgaatcccccattcttgctcttggtcttacctctgcagatcagttatggccgtgggggggagttcccaaatgtcaggtgagtatgggttggctgtacagtcctggggaatgtttaaaaagaccggctgggcgcagtggctcatgcctgtaatcccagcactttgggaggccgaggcgggcggatcacgaggtcaggagttcgagaccatcctggctaacacggtgaaaccccatctctacttaaaaaaaaaaaaaaaaaaaaaaatcgttagctgtgcacatgcctgtagtcccagctactcgggaggctgaggcaggagaatcgcttgaacccgggaggcggaggttgcagtgaaccaagattgcgcctaggcgacagagactccgtctcaaaaaaaaaa

SEQ ID NO: 239949 - DNA, 445 bp, Homo sapiens
ttctccctaccactgtagtccatattggaccctgtggtcagagtgatcctgatataaaacatacctgattatgtgtctcccttggttagaagcgtctctttacttgttgttgccttcagaaggcaagttcaaatttcttagtatggtgtatgatgtcctttacaatctcagtgtgtcacagcacccccacaatccctgccaacccttggccccctgcgttttctccttggccctttccccttcccttaaagaccaagctaagaggtctcattctttttttttttttttttttaagatggagcctcggcctcccaaagtgctgggattataggtgtgagccactgcacctggccaaaggtcccattctttctgaagccttcacaattgtcccagggaaagctgtttcctctacccttctgaattacaacgagtcatgctttgtttt

SEQ ID NO: 239950 - DNA, 358 bp, Homo sapiens
ggggtggattcttgctctgtcgcccaggctagagtgcagtggcttaatctctgctcactgcaactttcccctcccaggctcaagtgattctcctgccttagccttcagaatagctgggaatacaagcgtgtgccaccatgtctggctaatttttgtatttttagtagagacggggtttcaccatgttggccaggctggtctcgaactcctggagcctcggcctcccaaagtgctgggattataggtgtgagccactgcacctggccaaaggtcccattctttctgaagccttcacaattgtcccagggaaagctgtttcctctacccttctgaattacaacgagtcatgctttgtttt

SEQ ID NO: 239951 - DNA, 427 bp, Homo sapiens
taattcagaggtttagaagattcatgtcactaaaaatgtccgttagggtaatatttcattgagaataccactacaaagcatatatgaggatttactatttctcaattatacttttaaaatatatatttctttatacttacaaatttataaaaaccacccaaaatagtccatttgtttcatcttgttggaaaatgtagttgtcaaaatggcctatttacagtgaatcaatggtgctctaaatgtgctgggaaatggatattgtatggatagagtaacaacccaagtaggaagtaggaacactgtctaataaatgtttacacaccatcaagtctacaaacattaaatatcatacatgatagaatctttctcatcctgtaatttatctcaatttttccattactttctttcattttctcttctagcttta

SEQ ID NO: 239952 - DNA, 447 bp, Homo sapiens
taatcccctcttctgtggggtgtgaagtcccctgagctgctgtatgtcctctttgcatttgctcttacacaaggaagcctcagaagaaacacagccttctctctgtatcttcaatggaaagtaattttgtcataaaaataactgactctggaatctttgctattacgaaaatatttgtcatgtgtggtgaaaaggtacagtaggtatcagtgtagtacaattactggcttccgtgagtctaatgtgatttaggagtctgcaggggttagcttcagggtatattgtaatttcaagactaggttctttgtacttttactagtattagaataaacttagtatgaaagtggtgtctaatagttaaaataatatttcagaaagactattactgcctatcgtgtgaaaagtagagtgtaaattttcacttttaaactttaaatctccagcatt

SEQ ID NO: 239953 - DNA, 1304 bp, Homo sapiens
actgcaacctccgcttcctgggttcaagcagttctcctacctcagcctctggagtagctaggattacaggtgcccgccaccatgcccggctaatttttgtatttttggtagagacggggtttcaccatgttggccaggctggtcccaaactcctcatctcaggtgatctgcctgcctcggccttccaaagtgctggaattacaggtgtgagccaccacacccggccactttttcttcttttctttcaataaggtctcactctgtcacccaggcagaaatgcagtgactcaatcacagctcactgcaacctccacctcctgggctcaagcaattctcccactcagcctcctgagtagctggttctacaggctcacaccaccatgcccggctaattttttggatttttggtagagatggggtctcaccatattgccctggctggtctcaaactcctggggtcaagtgatccactcacctcggcctctcagagtgctgggattacaggcgtgagccaccgtacccggcctccagtactttctatatatgtgtgtccagcattgttttaagtgcttcacgtgcgctacatcagtgaaccctatgataaccatacaaggtaggttctattattgtctccattttgcagatgagaaaagtgagacacagaaaagtagctcaaataaagtcaccacgcccggccctcttccaggtttcaagttttatttttttggcacctccctaacctgtttctttttctatttctgtcgcccaggctggagtgcagtggtcgaggctcactgtagccttgacctcccaggctcaagccatactcccgcctcagccttcagaatagctgggaccacaggtgcacgccaccacacccagctaattttttgttttcaaattgtttcgtagagatgggggtctcgccatgttgcccaggtgggtctcaaactcatgggatcaagggatcctccaacctcggcctcccaaagtgctgtgattacaggcatgagccaccacgccggatgccataaccagcatcattgtcagccttctgtcacaccagcgccaccctggtagcccctggctctagtctgggtttcagttctgcagggctgctgcctcaacattttaggttctgatagctgtattctcagtcctggagtgacaggtgtagcctgcagttactatttttatacggtgcagttactatttctgcgctgtttcttctcattcctttcacggtttcctgagacctgtttaatttatctgagacccgtgtattaattcatctctgttgaagt

SEQ ID NO: 239954 - DNA, 371 bp, Homo sapiens
aattatcaagaactggccaatctcaagttatctttgccctactggattactttaagatagatctcagacatcacgtcactcacttataaatacttcaatttgataagcaagaatatctccaatcactacagacacttaggatgagttacttcaataacatagtctacgtctctaaaagttcatgtgaatttagaagaaaagtgcttaatttgcataacacggtacatcatattatcaaatacaaatataatagtcaagatcaaaaggtttaacatttctagatagtggttataatgctctgccttttaataaagatattggctactttttttattttaagagtaatgtaggctcatcaccaaaaaaaaaaa

SEQ ID NO: 239955 - DNA, 1066 bp, Homo sapiens
gcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaagcaagctgccatgttgtgagctgccctatggagaggcccacaggaaaagaaactgagggaagcctccaaccaacactcagtgaggaactgaggccctcagtccaactacagcctgcaaggaactgaattgctgccaacagccacgtacgtgagtgagcttggaagcggatccttccccaggcaagccttgagatgactgcagccctggctggcaccttgattgaagcctgtaggagaccttgagccagaggacccagctaagccatgcctacagatactatgagataataaatgttgttttaagcc

SEQ ID NO: 239956 - DNA, 1120 bp, Homo sapiens
gcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaagcctttctcagtgttcagagtatgaaagaagagctacaatggagattcagaattactgtgccatggtactgaaaatgaagcatgatgtcattgaaatgccgaattctacaaatacctcggaagtagttaccgaaatataaaaaacactatgccaaacttctgtgtttggaaatgcctacatttctaaacagctgttttccattatgaaataggatcaaattagtcacttgaagtgaaagcattcaaggctcaattctgtactgcatgttgtaacaaaaatataagacctaacattgacctcttggcacataaatgtgtcaggccaccagttccaagtcaaaggagaataaacaaacaaaa

SEQ ID NO: 239957 - DNA, 1117 bp, Homo sapiens
gcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgactcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaagcaagctgccatgttgtgagctgccctatggagaggcccacaggaaaagaaactgagggaagcctccaaccaacactcagtgaggaactgaggccctcagtccaactacagcctgcaaggaactgaattgctgccaacagccacgtacgtgagtgagcttggaagcggatccttccccaggcaagccttgagatgactgcagccctggctggcaccttgattgaagcctgtaggagaccttgagccagaggacccagctaagccatgcctacagatactatgagataataaatgttgttttaagccactaagtttgggggctactttgttacacagaaatagataactgaaacacca

SEQ ID NO: 239958 - DNA, 433 bp, Homo sapiens
aaaactgtgacttccatcttgtttgcactctctctctctttctctctggctcttcttgcttgatcactctgatgaagcaagctgccatgttgtgagctgccctatggagaggcccacaggaaaagaaactgagggaagcctccaaccaacactcagtgaggaactgaggccctcagtccaactacagcctgcaaggaactgaattgctgccaacagccacgtacgtgagtgagcttggaagcggatccttccccaggcaagccttgagatgactgcagccctggctggcaccttgattgaagcctgtaggagaccttgagccagaggacccagctaagccatgcctacagatactatgagataataaatgttgttttaagccactaagtttgggggctactttgttacacagaaatagataactgaaacacca

SEQ ID NO: 239959 - DNA, 1028 bp, Homo sapiens
agtcttgagatttttaataacaattgttcaaaattagtaagtatggctacagattgtgcttctgcaatagtgttaagaactgttggacccaagaaacaatttgaagcagaaacactttccagggacctaaacttaaagctatttctgctaaaagcttcaaaatgaatcagtcagatcagaaactagtaattaacattgtggtttgcaccacaattgaatactttgcttggtgaattattaggtgcatgttatggaaatctgccctatgacatggaggttgattggcttagttgaacatgatactcaagatgctgaaaaaaatgatttggcatccaaagggcattcaccacacccgcagagattgaaataaaatatttggcttgtttggttgattttacaactcatctagacactatgaataaaaacagcattgttcagaaataccttcacaaatgtatggttgtacttgcttgttcctagcaaaattatgcctttgggaaactcatttggcaagagataaactggctgactttcctttgctgaaattggtttccaagaattgaaagtgatggcctgaattacattcccacagttgtggagttgtctgttgaattccagaaaaggttctctgacatatttgatgaaaatgaactaatattgttcaattagcctttctcagtgttcagagtatgaaagaagagctacaatggagattcagaattactgtgccatggtactgaaaatgaagcatgatgtcattgaaatgccgaattctacaaatacctcggaagtagttaccgaaatataaaaaacactatgccaaacttctgtgtttggaaatgcctacatttctaaacagctgttttccattatgaaataggatcaaattagtcacttgaagtgaaagcattcaaggctcaattctgtactgcatgttgtaacaaaaatataagacctaacattgacctcttggcacataaatgtgtcaggccaccagttccaagtcaaaggagaataaacaaacaaaa

SEQ ID NO: 239960 - DNA, 4409 bp, Homo sapiens
gcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcaagaaatgctgtcatctgaaataaggaccagctttcaacagcagtggcaaaaccctaatgaaaatgtcagcacaattggaaatttcactaacttgaaagtaaataccaacagcaaacagccttttaacggtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgatactcaagatgctgaaaaaaatgatttggcatccaaagggcattcaccacacccgcagagattgaaataaaatatttggcttgtttggttgattttacaactcatctagacactatgaataaaaacagcattgttcagaaataccttcacaaatgtatggttgtacttgcttgttcctagcaaaattatgcctttgggaaactcatttggcaagagataaactggctgactttcctttgctgaaattggtttccaagaattgaaagtgatggcctgaattacattcccacagttgtggagttgtctgttgaattccagaaaaggttctctgacatatttgatgaaaatgaactaatattgttcaattagcctttctcagtgttcagagtatgaaagaagagctacaatggagattcagaattactgtgccatggtactgaaaatgaagcatgatgtcattgaaatgccgaattctacaaatacctcggaagtagttaccgaaatataaaaaacactatgccaaacttctgtgtttggaaatgcctacatttctaaacagctgttttccattatgaaataggatcaaattagtcacttgaagtgaaagcattcaaggctcaattctgtactgcatgttgtaacaaaaatataagacctaacattgacctcttggcacataaatgtgtcaggccaccagttccaagtcaaaggagaataaacaaacaaaa

SEQ ID NO: 239961 - DNA, 240 bp, Homo sapiens
agctccctctgttgctctgtaacagcattttattcatgatttgtgatgtgataaggaaatttttgctaatgtgtcaaaacaaattcaattttcctttaaggcaatttataactttatttaaatggaatataaaggaagaaccccctatatgtaaaattctgaccttcaaatttatgttaatatttttaaattattaaaacattaaaaatgcatctatttctcaccactaagagggaaaaa

SEQ ID NO: 239962 - DNA, 425 bp, Homo sapiens
gtgctgcatcatcccatggcaggagacagaagcgcaagagagcaggagagccagggcaagagaaagagggctaacctcatccttttatcaggagcccactactgcaacaacagcattcaactgttcatgagggcagagctcccatgacccaatcacatcttaaagtttccacctctcaacaacgttgcattggggattaagtttccaatacataaactttggggtacacattcaaaccacagcagtcctcaataaggaatgttgactgttttcgttgggcagggaataaggaatttgcttctgggctgaccaatattttgtatctcttttttgttaacttgaaacttagactggtcattgggactaaaagtgttctacctttttagtctattaaaaaagatgaaaattcatctctgtgaccacag

SEQ ID NO: 239963 - DNA, 673 bp, Homo sapiens
gttgggactacaggagtgcaccactacacccatctaatttttgtatttttagtagagatggggtttcaccatgttggccaggatagtctcgacctcctgacctcaagtgatctgcccgcctttgtgattagcactttggcctcccaaagtaagccaccatgccaggactgatagagatatttaattcaatttttttcaggcaaatgtgatagctggccaattttttttttcgttttttaaaatcttttgttttttagaaacctcacctggaaaatttccaaaaacctagaatgccatttttattaccatttcagaaaagtaaatactttcttcattgtctaattcataccaagtggcagcagttgatgctctcatttcttttcttgtctaaaattagcttataattgtacccgagtgttgttgttggcaagtggtccaatttctttctccaggaacacttgaccatgcagaggtctgcaaccatgaagacatataatatggttctatcatgttgctttgaaagtttgatgctgggtgcatggtctcatgcctgtactcccaacacttagggaggccaaggcaggagaatggcttgagcttaggagttttaagaccagcctgggaaatataggaaatatagtgagaccttgtctctacaacaaatgcaaaaatt

SEQ ID NO: 239964 - DNA, 189 bp, Homo sapiens
cctgggaggcatttattgccttactagggaatgttaattgaagccacccctatgctaatgggttttgtttgtttgtttgtttgtttgtttttgaaagagtctccctctgtcgcccaggctggagcttgcagtgagccgagattgcgccactgcactccagcctgggggacacagcaagactctgtctca

SEQ ID NO: 239965 - DNA, 181 bp, Homo sapiens
ttttttgcaggtcctcaagaccaggcatcaaagagagttgacagcaaaatggcccggagtccctctgcatgaatggcggctctcccagtctccagctgccggcgccctggtggccgggccacacacacacacacacacacacacacacacacacacacacacacaccccttcttgtacttc

SEQ ID NO: 239966 - DNA, 396 bp, Homo sapiens
cagaatcccctgaaagtttattctctgtcttctagatcatttttacaataatgtttttacaataactgaccaggtagccttcaggacctgaagcccatctcatacttgccctcctgtcaaagatgactttgtcctgagctgagtggttttgagagaggaaaggctgttctggataaaaattttccaactactttttgccaggcacaatgctgtacactgcacatgtattactcacctaatccttgtcacaacccctaccagtggggcaccagagccaggcccatgctgtggatcagaagcgaccataaacaagaaaatccaatctgtcttctggctttcttgaggcaagatgcggggaagagggcattgcagaaatagaggggaatgattaaagaa

SEQ ID NO: 239967 - DNA, 2146 bp, Homo sapiens
  misc_feature (1191)..(1191): n is a, c, g, or t
ttatttttcactgtataatgttgctacccaatattttcatgaatccttaaccaggcaacactttaaaaacttttcaagtctttgataataccattttcttatataaacctttttggtattaacaagattcagagaaggacagggatagataaacccaacagcagcaagctaaagaaatattaccttttgtagaacttgctagtttctatggggatggcaactcaactaataattgctgagaatttattttgtatcatctagcagataattatagtcatcttcaaaaaggaaggtcaacaatatactttaagcatgaatacagtctcatgcttcatactcagccttttccatttcttgatttctaccacttcattgaacaacatttaattattggggcgtcttttagcaaagtgtgtaatttgcttgtgctatctgactttaaccattgctctggactatggggttatactgagctgaatactatcttctttctaaatcttctttcttcctatattttgcaactcactattgacaccatcacacacacaccagcctttcctggagaaacccagagatcatccttgagtcttctcaccgtgtcacacagtggctagctgttcagatttggagtctgccagggtctaccatatttgttacatgaccttgggcaattttcttaacctcacagtgcctctgtttcctcatttgtttagacgtaatactactcctcacctagggtattgcaagggttaaatgtgattatgcaggaaagccctatgatcattaattagtagttattattgttacttctctgccttcacatctaattagttaccaactcctgctggttttaccttccaaatagttcttgactctgcctctccttttcatccttccctcttctgccccactttaggcctttacactctgatgactgcagtggcctcccaaattgagcccactcagacaatcctatcacaatccatactgtggctacctagggggagtttctagaatgcacactggtgctttttgcctccctacttatgccctccaaaggccttcaggatcacctctgaatgccttgacctgtggagggatttttgtttgctttttgatttggggctttgtgactttttggtggtattttggtagcattgtcattgtaaataaaggtttatggtcctgggnaaccttgcctaatcatccagacaccaggcagaaactgggagaggaacacaggagaaagaagagaaacttacaaataactcttcccttccgtttctcttacctcaaaaataaagaaaatctaataaaatagcattcataaaatgaagttgccatattaatctcaggaaatagagatctgaaaatactgaagctatgaaaacattgtaaagattagaaaaattattaaataaaaactcataaaacaggcaatttaatattggattcatttcttgggtagaatgccttccaggttaatgtaatggagcccagaagtattagcaattcttcttcacacctttacaaatcatacccagttgtcaaaagaagcagaatgtttctgccatcagccccattacacagaccagaataatagtttagcagccaatttctgctattaacagaactcaagggaaagaaatgacagaaaagcaagccagggatggtgaaactaattgtgatgacaagcatattattagagacaggtaatgggcggaaaactacttcatcatcagtgtttttctcaatccagtaatgaagaccatgcggatataggtgtaaagaggcctctgcttgttcaccagcaggtgtggaataattggtgctggtgtgagggggtagagggaagacagaataaacattgcaaatacaagtagacaaaaatgccatcactgcaaataaaagtagacaaaaatgccattttcttgtcttagattcagataggagattcttcttaagatgctccgtgttttttgttttttgtttttctgtagaagcaagagcagtctgtgatagaattatggcagcaagttcttaaccctttccagattaccaaactctgagaatctgacatagcctgagagtcttttctctcccttgaaaatagccattaattcagtgactgtttggagctgtgagg

SEQ ID NO: 239968 - DNA, 414 bp, Homo sapiens
tttggaatgcccctggcgatggtggaatatactgtcttcattctacagatgaggacagtgacccagagatgtaactgacttgcctagagtcacaggatccacagcaggagtgagaaccccgtggggcttcctaatccagcgctccaaggaaatgcaaggatattggtcatgggtgactcaatttaaccaacagtagcttggttagacaatctgcctttggattcattcatagttaatttcttcatgtttgcttggattcatgatgccataattcatgctgtctggtatggtttggctacagagacatgcaatagggcatgtattttgtggtttggtgacaaatcaggacacacgtgcagtgctgctgtgagccaagccagtttcctcagggtcaaggccttggctgctgagctc

SEQ ID NO: 239969 - DNA, 438 bp, Homo sapiens
  misc_feature (425)..(425): n is a, c, g, or t
  misc_feature (435)..(435): n is a, c, g, or t
cggagaggtggaagaaatgaaaatattttctgtctcttgcttgcagaagcaaatcagtctttgaggacttatgttttttctgtgtgatcacagtcagacgttctctctgaaatccccttggcacatatttaggatgccagactgcttgtagttttagtggttcaggccatcactgccttttgataatgtgtctgctgctgataatgatgatgatgacaacctcagtgacgagtgtggtctgatgcagaaaaagactgcttacagtcttgctggagagatgccaagagcactgacgagacaattagaaaacataaatctattcaaaatggtatgatgcagactcaaagtgcaacagagattcctaagaaaagagaattgaagggaagttggcgaaggtttgaggaagaagcctgggcaacagagcnacagtccatntca

SEQ ID NO: 239970 - DNA, 333 bp, Homo sapiens
ggcttaagaagattaacaaggaaaaaaaaaaaaacaccatagcatgcatttctttctactcccatctagggtttggggttgcaagtttttagagaaaggaatttggcaagaaaagaatccagatgtaactgacagcaaagtgacacatggcaaagcaacatctctgctcttaggcatacttgttcccagctactaattaactgacagaaacagaaacctttccctttaatatttgccactgtcaaggtcaaggatggaccttaatacatcaaaattgtacttactctctacttgttaaatacagatttaccctttactaacagttaaaaatgc

SEQ ID NO: 239971 - DNA, 593 bp, Homo sapiens
ctatctccaaaaaaagagaaagaaagaaaaagaaaagaaaagacaaaggcttagctactaagctacagcattgggcagtctccattgacctccccagaaggagcctagagcaatcaactttgagcttgcaaagccttttaactgctcaagataatttttagagctaactatgacatgaattcacaaaattcccaccttccaaatggcggagaccaagagacagaactgccacgtggttagaaagtcaagctcccaaggacataaaacaagatgagagggaaacctcatccagtttttgtttcagggacctgcagcagcaaagtttatagttgatcagtgctgggtcagctcaaatagcagacttacaggggtcctaggcctgcattatatctatgacacaccttttatgacagagtgacacacaaagacaagtttgtagcacaaagttcaccaaattcgctacagcctaagactagcctcaccagtcctttttcccattaatcagagaggctgaagcctgacttgtaagaaactcttgtccttttgccagtgtgccaggtttctgggttccccttctctgaatggctttgatg

SEQ ID NO: 239972 - DNA, 468 bp, Homo sapiens
tttcagtgctttcccttatcagatttgaccaactccaaaccttctagctcactaatgtggaatgttccactccaaagaaataagagcaccttgctcccctcagcctttcctggcattctcaggcaactgagaatcacctgagggtgtctgggagaaacactccctaagacatgcagtggctctaaataggttccccctcagaagaacatacttggagtttaatctcaaccagcaggtacatagaaggagctgacccctcccgaaccttgaggccctgacacactgtgccaggtggctgagacatgggcggacagaacaggttcagggggtcatgactctgaagagctaggtctgcgagcagcacattttgggtctgacatacgtcccaacttggtcagatccaaagagtaactctgaattatggggaacaaggcctttgaagtgggaggaaaatggccagcaaaaggg

SEQ ID NO: 239973 - DNA, 498 bp, Homo sapiens
tcctaaaaatgtgtaagttctgtgatttcttggactaaaagatatctatttacatagtgaaaggccaggccttgtaaagatcgtgacagtattcaatcctattctcgtttttttgtttcaatgtgttgctagttatcttatctcagtgtattgtatttatataactgcatatttgattaagatacctaacctatgagacatattaacataatgaacacatgtaagcacacaacccaatttaagcataagaacagtatcaataattttgcagttatctttcactctttttcagtcacacagagacaactatactcttaattttgtgtttagagtcctctattttcttaatagacagattgcacatggttaaaggtctatgtttacatcaagagagcctgtgtctggatcttgttcaccccgcttatgtctcttttgaagttatgcttaagctttatcccttgttcctttatggaaatttgagtattttaggaaaagtaa

SEQ ID NO: 239974 - DNA, 418 bp, Homo sapiens
catagacatgggagtgggagccgcagatgctgtttgaggcagaagagtttccatctcctcttgcccccccagtatgccagtatccctcagtgttgcctctgggcaaaacctagctggcagcaagttggcaagggagcctgggaaatggaagttcttataagagtaaggggatcgggatgcctctcagaacaaagtgaaatggtcaatgcagcaaccaaatagggtaaaatagtgctcttggcagttttggatagggatatccctgttggtctggaatccaggctggaatacaaattcagcatgtatgagtaaagatacttttgatagatgaatgtggtggagtagttaagatcactagagaaggtatatagagttaaaaaaaaaaaaaaaaaacagaagaagaagaaagaaggcaagg

SEQ ID NO: 239975 - DNA, 172 bp, Homo sapiens
agctgaggaaaatattaagttggtgccttttgttttgctcttgtttttttctccaggaatttttcattggttggctctcctttcttgttctcattgctgtcatctcacacatcctttctaacttttttcttttgcatagcttcttaagttaggcccttccatcactgatttc

SEQ ID NO: 239976 - DNA, 439 bp, Homo sapiens
ctttgttcttctagcatcaacatctttcctttggacagtggttattatcttaacataatgtttaaaaaaaaaacgtagatttttaatttatgatctctttgtgccaggaattgaaatactttatgggtaaacctaaattatttgataaaaaaatcttaatgtaggctgggtgcctggctcacgcctgtaatcccagcactttgggaggctgaagtgggcggatcacgaggtcaggagatctacctggctaacacggtgaaaccccgtctctagtaaaaatacaaaaaattagccgggcatggtggtgggcacctgtagtcccagctactggggaggctgaggcaggagaatggcatgcacccaggaggcagagcttgcagtgagccgagattgccgccactgaactccagcctgggcgacagagcgagactccacctca

SEQ ID NO: 239977 - DNA, 499 bp, Homo sapiens
tcttaacattttatgaatgtgtaaaatccagtccattcattagcatcaacagggagcagcttatgtggcatacttctcaaatagtctatctgaggcataatgacattggtgattttctggtattttaccacacttctgagttgatttttagtttcaaattgggtaagctcagagtatctttgtttgttttaagtagcaagatttctagtcatttaaaccacttaaaatcaagtagcaggctttatttgaatttgtgattaggaattctgtaattgtatttgttaggaaaattttcagtgtgtttgctgtaaatgtgtgtatgtggttttgttttttgttttttgtttttgtttttgtttttttgagatggagttttgcttttgttgctggggcaggagaacagcttgagcccaggaggcggaggttgcagtgagccaagatcatgccactgcattctagcctgggcaacagagcgggaccctctctcaaaaaaaaaaaa

SEQ ID NO: 239978 - DNA, 420 bp, Homo sapiens
cctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgca

SEQ ID NO: 239979 - DNA, 146 bp, Homo sapiens
ttaaatgattcacttgaaatatatacagaaattgtaatttgcttttttttaaaaaagggggctaaagtaacactttcctactttgtaaattatagatcttaaattcatgcaccccgtgggagctcaataaagatatactgaattga

SEQ ID NO: 239980 - DNA, 387 bp, Homo sapiens
agagaatttaggaaatatttcatagtcacttggatattttgtaatcactcaaatttctgacacaaattaagagtcagaaaactgtgggaagtatggctgagattttctgattcccacattctgcaacaataaaatataaacatgactaaccaggatacatttacaatacacatgactaagtgacaacacgtgggagataactggcttttgaaatgcatgtctgtattaatcagagttctccagagaaacagaattaatagggttctacaaacctgcagagcctatatcccagcttgaaactgaaggctgtaaggctgctgtagtaccagaaagagccactgtctcagagttcaaaggccatcaggcaaaggaaaaaagaacacacac

SEQ ID NO: 239981 - DNA, 516 bp, Homo sapiens
tctcgttctgtcacccaggctggagtgcagtggcgcaatctcggctcgctgcaagctctgcctcccggattcccgccattctcctgcctcagcctccctagtagctgggactacaggcgccccccaccatgcccggctaatttttgatatttttagtagagacagggtttcactgtgttagccaggatggtctcgatctcctgacctcgtgatccacctgcctcggcctcccaaagtgctgggattacatgtgtgagccaccacacccggccccatttttaatacgttttttaaagatgcatataaaatgcattaccctctggaagattccagtaacttactgaagcaagtttctcctctacatatacctatttctgccatgagtaactgttcattttcagtgagtcatttgagtttctgttattcaggtatacagagttcctgttgtctttttagtcaacaaagtttaacaaagaccataataaagatggctttcagcagctctgttattgggaa

SEQ ID NO: 239982 - DNA, 436 bp, Homo sapiens
ttttcaataaatgcagaattccagaggcaatggagtaatttttaaaaaatacttaagaaaataaatttgaaggtagaattttacaattaataaatttgtatttcaaacatgtgatgacaataaaaatattctcaggcatacaagtcctttttaccataaaaaggactaccattgaaaagatattttaacataagtgctccaaaagagaaagagaagaaaaaatatcaagaaaaaaaagaactatatccaaaataccacagaattaaagctctatatggtgtcaatatgattggcaaccctggtggggggaagaccaaaagtaatgaacatatactaaaaatcttgtctagttagagggtgtatatacacaaacatatatatatatatatatataatatactgtatatatattaattactttaaataagaaagtatt

SEQ ID NO: 239983 - DNA, 383 bp, Homo sapiens
agagctcctgagaggtcagcgtggctgatcagggaaggctgacagcaggaagaggggagatgctcctaagaacagtttgaacacaccgatgcataaacaaacctcccttcctagccacacaaggtgacagtgaaaaagacaagcaaatgtaaaggaggtgatagactcttagaagctaccgtactcgctcgtggatagagtgatggcggcagccaactctgccaaacctgctgctcctggcaagtcccacagccagtgccatgttgggcacggtcatctctcttggactctgacactgcctcgcggcagcccttgttcctgcagcctcaccccagtggcttgttctatgctactaacaaattagaattggttgcctcctgaaa

SEQ ID NO: 239984 - DNA, 499 bp, Homo sapiens
cggaggctgggtgcagtggctcacacctgtaatcccagcactttgggaggctgaggcaggcagatcacttcaggtcaggagctcgagaccagcctggccaacatggtgaaactccatctctaccaaaaaatacaaaaattagccagggtggtggtgcacacctgtaatcccagctacttgggaggctgaggcatgagaatgggttgaagccaggaggtgaaggttgcagtgagctgagatcgtgccactgcactccagcctcggtgacagagcaagaccctgtctcaaaaaaaaagaaaaaaaggtaatcactgagactatggaattataattattttaaaaaatataataaatattcatatttatatttaaacattgatatttaaatacaaacgtatttatatttaaatgttaaaaatcagaattgtatagtcagaaacagtcaaatttaattaaaacatgtttttgtttcttccccagagaacaaatataatatcta

SEQ ID NO: 239985 - DNA, 1104 bp, Homo sapiens
caagtagaattgcttttacttatccccctattggagtttaaacaatttttaaaaaaataaaagcaaattcagataccaaacaaaccaaaaaacttactgtgatgatcctgagaggttttgagatgatgttgatctcagattgatattgatcaaatttattgtattactagagaagtacatttttaccagtgaaaatacagtcaagtgtgaacattttaaatgcagaaagcctgagattttgtcctattcaataaaacggctgaattatagaatactcaagagatgttgttttccttaagaagatatactataaatattcatgcgtactaagcctatagaaacataaactaggcttagttcaacaataaatacttgcaagctcaatgaagacataatggatacaaagatgataccctcaggaagcttatagtttagttctaaattacactactgtattttcttttcttttttttttttttttaaagaaaacagtttaacatcaaatgtttcccaggtttactttttgcacagtgcatacagttttgggaaaatatgtggttacaacacgatattctaggccagttatgttggctcacacctgtaatctcagcctcccaaagtgctgggattacaggcgagagctacagtgcctggctagtccagaatcttaacattgctatttgtatatctttttccttctgccttcagggaacccctcaatcactgcttattactgtgagtttgctctaacctgctgccatcaccttctgtcgtccgaatgaaaaaactaattttttcttgatgactctaatattgtttgaggggcaattcttctttttctcagcttttctcattaatgttgttatcttttatatgaaactgaaggatggccaaatcccattatccagctatcctgggtcagctttctaggttttacagtggtcccttggaggattttaggagtcctgtattttaaaaatttggtgacatggggtttagtgtagaagatgcagagaggccatgggaagggattccagtttgtatcccagaacatggatatattcaggttgagatcttgtgattgtcaaaaactcttgtgtattt

SEQ ID NO: 239986 - DNA, 1100 bp, Homo sapiens
gatggtgaggcttatgtggcaggactgggagggtttaatgcatgctttttgacagtttggatctggaggggtctcaggcttccacaaaaattacattgtggacagtttcataggattttgccttttaactcttcaaagcaacagttttctcaactgtcatccccacttcctctgctccttacaatggcttcatatggaaggtgaagctgagatcaccccaattttacaggtgaggaaactgaggtcaagctaggagcgtccagcggggctgagaaattgccaggatttccttccccattaaggagctgagagtcttagctccagacacgttggcttgttagaatatcaaaaccaccgaaggggaaaaaccacttactggaattaaatgctatctgctgtattagtttaaatcagtggcgttcaaacttgtttctccttttcactgcggaacacgttcttgacatgtacttgactcagagtcccatgtctaaaggagacagagcccaaggcagcccacctgaagctggggagggagtccaaagtgcaagccacctggtctccatttccccgccccttgggggcctttgggcagctccttggacccctgaaagaggccaccaggataaactttgttaaaatgcatgccttgtgccccactgtcctattacgggctttcagtagtctccactccctcggcaggcaaagacactggccatctccaaattccctcccctcctgcacagcatcagccacctggcaagcagtctcacataggaccatttgccagcaggccctgcaagcctgggggacagcctagaggaggtgacttacatacacagcataagagttttcaggagaccaaaaagattcaatatatgtcattaactcctgactcagtttccccaaaccatgcctcctgagtgctccctctgtctccaaatcctgatttttgtgcgcggacccctgtctacaataaacaggatcctatgacttcaaaaacacaaaccaacaaaaacgcacacaacccacaaaaagacaaacacaaaagggggggcgcccccaaaaggattccccccggggggccccacccagggggaccc

SEQ ID NO: 239987 - DNA, 414 bp, Homo sapiens
tgtgaacacgtaggtatactgaggggatgacagtcatttagatttatatctatgaatctgtgattatatctaaatttaaatctagacatatcaagtctttaaaagggatttctgaaagtcaagtccaaagaatatgccaaatttatctcccattcacagccaacaaaacatccatcttccacaaaaaccaccagccaggtgcagtggctcacgcctgtaatccaagcactttgggagaggcagatcacttgataccaggagttcaagaccagcctgggcaacaaattaagacctggtctctacaaaaagtttagattagctgggcatagtggtgcgtacctgtggtctcagttactcaagagtaagtgggcagatcgcttgagcctaggagtttgaggctgcaatgaactaaga

SEQ ID NO: 239988 - DNA, 450 bp, Homo sapiens
tgagagagagatttttcaactggctgcaaacaagatagggtagatcttggaaaccataatatagaggaattgaaggcacttggccatgagaagaaagaagtcattgcaggcaagagcactgtgttccaatgcttagggatacagaatgaagaacagaattattttgtgtggtccagaagacaaatctaggacaaatagttggcttttcatatagggatggtttcatcttagcataaagaaaaacactgtcttcaatttctcatcatttgagctagttagcaatagaatgaggcacctgcatcattgggcttatgaattaattctgcaaatatgtattgaatgcctactatatgccaagccctgttctggacatgagcaggtgatcaatgagatagtcatggatttgccgtaatagaatttacattctagtggggcagataaccaacaagc

SEQ ID NO: 239989 - DNA, 4476 bp, Homo sapiens
  misc_feature (1029)..(1029): n is a, c, g, or t
  misc_feature (1227)..(1227): n is a, c, g, or t
  misc_feature (2061)..(2061): n is a, c, g, or t
  misc_feature (2302)..(2302): n is a, c, g, or t
  misc_feature (2511)..(2512): n is a, c, g, or t
  misc_feature (3225)..(3225): n is a, c, g, or t
cggatgggacagggagaggaagcagctgtgctttcatgctgaccctgatcctctgtgggggggcgtctccaaactggttgctgaaattggggatctgaaaaacatcttaagctatcctacagcaaaagttgatgattctaatgttagcaatcctgtctataggaataacggggttgtgaatcaatttgtaaacagtctttggaccctaaagtcagaaatcctatctacaggaacaactgggatacacaaggtcaggatcttgtgctgtgtgactttcagcaacaaggaagtgggccaaagtgcagcccaattaatgcttaattataactctatttcagtccataatgtggcatgcaattcttgtcaaccctctggggacacttttgaatttgggcatttgggaaatgttccttcattcaccagttgctgtttttaactaagtgatttactttgtgctggagctgagctgcgccaagctggagacacaaatagaacaaacacactccctgctctcatggagctcctggcattgtcccgtgcactagtgaccatttgctgcacacccagctcttctctaagcacttttcaaggatgctcttgtttaatcctcatgacaaccttatgaggcagatactgttattctcctcaggtgaggaaaccgaggcacagggagattaaataacttggccaaggtcactccatctgagccgggattccaacccaagtagtcttgctgcagagtcctagctattcaggacagtgctttgcacgggagagatttttgcccatagctctagggggatagaaagccacaggaacattatggctgaagtgcataattttggttggaaggaaacctctttgtagaaagaacagtataaggtaatgaggcaggtttccctaggccaggtaggcagtcagccccgctcctgctagctcctgtcaactctgcaagtcaggggagggtggcacccagaatggaagtactgtgcaaaagttttcaccagattctctcattaatcttcaccnagaagaccagcgatgctcaaactatctgtgcattcaaatcattgggcaggcttttaaaactccatgtcctgaccacaccctatgccaattaaatcagagtctctgatggtgggattcgggcttcatgattttttaaagctctcaatgtagttgcccaatggtttcttcttgcctgctgcccaggaaagcaaattcacngagaacagcaggttttgcagcaaagaaagagtttaataatcacaaggccagccaagccagaggatgggagagaattctcaagtcaaccttcttgagaatttagaggttagaatttttcaaggatagtttgtcaggctagggaatggggaatgctgattggttgggttggggataaagtcatagggggttgaagctgtcttcttgcactgagtcagttcctgggttgggggtcacaagatcagctgagccagtttcttggtatggttactggttgatatggtttggctgtgtccccacccaaatctcatcttgaattgtagctcccataattcccatgtgttgtgggagggacccagtgggagataattgaatcatgggggtggtttcccccatacctttctcgtggtaatgaataagtctcacgagatctgatggttttataaagggtttcccctttcacctggctctcattctgtcttgcctgctaccatgtaagacatgcctttcaccttctgccatgattgtgagtccattaaacctctttttctttataagttacccagcctctggtatgtctttatcagcagcctaaaaatggactaatataccggtccaggtggtgccagctggtttatcagaatgcagagtctgaaagatacctgaaagatacctcaaacaccaatcatacgttttacagttgtgatgttatctgtaggagcagttggggaggttaggaatcttgtgatccctggctacatgacttccaaagcataattctaaccttgtggctaacttgttagttttacaaaggtggtccctgagcaaggagggaantagttttgggaaggggctggtattgtctttgttttaaggttgaagtataaacaaattcctcccatagttagcttggcttatgctcaagaatcatcaaggacagcttgtgaggctagaagcaagatggagtcagctatgtcagatttctctgcctgtcataacttttgcagaggcagttttatccagatgattccagtgtgcaaactagatagaaccactgagctaggccagaacttctgangaacccttctgccccaggtgtgcaccaccaattctgaggcagggaacacaggcacatgagaggggacagcaaaattgtcattctttcctgaggctcttcccagagcaccttaaccaaagcagaggaactaagagaggcctgagagcagcctgtgggaaggcataggccttccagtggccggagtgcagaaggaaggaggagggtgcagnnggcggggaggataaatgtcaggcatgggcccagccgtttcagctgcttatttggctgtctccagagtggccagtaagaagactgagtcatttttgcaaagaattgttatgatctggctttgattgcatgtcagatatgcgtgcaggggactctttggagggaaaggctgtggtgggtggccccctcaatgcccattagcccacccttgctggccaacctggggcacagaggaggaatgaaagccaaaggtttttctcctttgcttttctttccctgcagctcatacttaaggacagaaaaatgtctctaggtttattggtagattcttaaaacatcccgtgcttcccatcctattgatgggggtgcccgccatacttcctgcacctcactagccccctcctccctggagagcaccgatggtcccaccccacagatcatgaggtggaaggacggtcttaaagatgaaaggttgtggttcagagatgtgaaggggcttgcctgagggtgcacagctttaaatggcagtgccaaaattagggtctgtgtccctggccctgttcaccctgccaaatggcccatcgtcagcaggagactcagaactccagtccacccagctttttctgcaggctagaactcagcctgcaggattgtcaaggctgtgcagtgtgctcctggctctctgagggctggagctgttctatttccatttgctnctgccccacctctgccaggatgcccagtccaggaccatgtggcagtagggaaggctcagcccctgtccccgcctgactccacccagaagggtgtggtggagtggtctgagagatgtgtgtgtgtggctccggagccttcttgttgcagcatgaccccctgtccctgccaggttaccacagtctgcttgcttgtctcttgtggcattttgagagggggtatgcagcttagcgcagcacagcaaggcgtccttgatcttggttgtttttgtgtccaggcaccagagctgccttgaggctgagatgtgggcctagggctggcctggattctctagcaatgctggaatcagaggccagctagcaattctggttacctctatgctaggtgctcacctcccttgacacttccccaggtcctgacccctccttctcacagggtcccactgtgggcaccacactggaccaggaaagcattctggagccatcgtttgtaatcatcctgcttctcagccggttccactgatgtaaaacaagtttacctgtcaatattgctaacaattagtgagacgggggcaagctgacctcagggaagtaattttgtgtaaacactgcccactctgcttctactattattgattactctaaacttcccacagacataggtgggagtccagggtggctgtctacagtgggaggagggccagccagtgcatagtttaattctgcttgaggtttttgccttgccataggccactgagtccttgactttagtcctcacctaagacatgaggccttgcaacagaagcccacacacttgagggccatgggaaagttaaagggacattcctctggcttcataaaaggattctagaacctcacatcctacattctacagtcataggctcaaagagatagaagtaaccccagaatgccctgtagactcaaagcctctcattatctggaatagtggaatgttggaggccgagtgcagtggctcatgcctgtaatcccagcactttgggaggccgaggcaggtggatcacttgaggtcaggagttcgagaccagcctggccattatggtgaaatcccatctctactaaaaatgcaaaaattagctgggtgtggtggcgtgcacctgtaatcccagggaggctgaggcaggagaatcacttgaacccaggaggtggaggttgcagtgagctgagatcgcgccattgcaccccagcctgggcaacagagcaagactctgtctc

SEQ ID NO: 239990 - DNA, 475 bp, Homo sapiens
taagtaaaattcagagaccatagaaaaatagattgaggagcagctgaaagggtaggcggaaagacagaggcagggaaccacctagaaagcatggagaagctgttatgcctcagggtcatttgtatatttaggaatgcctaaatattaatacattactgacttgttaaattgttttctgactgtaaaagtaataatacttattgtagaaagtttggaaaatgcaaattaataactaaagagggacagagaaaaatcaaaaccaccaaatatctcattattcatagattattatttatcagcactttttttttgacacagagcgagggcagtggcgcgatctcggctcactgcagcctccacctcccaggttcaggtgaggcaggagaatggtgtgggcctgggaggtggagcttgcagtgagccaggattacaccactgcactccagcctgggcaacaaagcaagattccgtcttt

SEQ ID NO: 239991 - DNA, 308 bp, Homo sapiens
gttgtcatcactgtcaccatcattaccatcaccttcaccattatcaccactactatcattatcaccatcaccatcactaccatcatcatcatcatcatcatcattaccaccccagcaccactcaccatcatcattatcatcatcaccatcaccaccaccatcatcaccatcatcatctctactttacaatagaggttccaagagcttgtgatctgcccaagatcccatttccagtacgggctggggtaaacactctagttcaggtgtcacagctccaaaagaaatggacttttttttcctcttggtct

SEQ ID NO: 239992 - DNA, 404 bp, Homo sapiens
tatttaatctcttcatatctcagttttctcttctttaaaataaggacagtaattgtatctacctcacaggattgttgtgaggattaaaagaaatattacatagttgctactgcattgtaaatacttaataaatattagactttcttattgcagagaaataatttgcaggattttacctaaagctacagatagtgacattgctaacctattagggttcctcacccatacattctaagatgcaggacctattctgtgctggaccagccaccaatgtgagcaccctgggaaaccacagagttttaaaggaaggtatgattgtggcctatacacatacatttccccaacacttaggagctagtgttaaatgtttttaaaaaaaattcctttagacctcctgatattag

SEQ ID NO: 239993 - DNA, 344 bp, Homo sapiens
tctgtgactttcttgagaacaaaatactgtctgtgtcagtttggatccccattattttgagaaatgcctgaataagtttgatgctgaataatttgaataagcaattgaatcaatttaatagccaaaaatcctgtttttgataagaataaataatagatcatgtgtgaatgtgtatgtatatacatacataaatacaattgtaagcaatttaaagtaatgaacaattatggaataatattagttattattttagaacattcagtgttcaaaattaggtgaaaagggccgaaaagtttctctcaataaaagatgggtcttgacgaaagtcaagaatttggattgga

SEQ ID NO: 239994 - DNA, 462 bp, Homo sapiens
ttggaaaaggcctcctttataggtgctgcttcaaaatcctgcctcctggtccttaaagggcacattttataaatcgcatgtattcagagtaaatacagcaaaaaaatctcttgaggggttgtggtcatgctggaaaacaaccagagctgggactgctccctcctcatcctggaatgtatcacccatcctctcctccactgctttccaagaagaggactgacccctcactcttttccagaattaatccacttttctctcactttccatcccaccatctgttgcctcttctgggagcttgagtcaaaacccgccccttctcacttctgcctccttagcctcagcgcacaggtatgctcgaggcttccaggagaactaacccaagcaacccgcttccaacctatcctccagccctcacgcaaccattgagcttttttccttctttaagtgcatatttcttgaaaa

SEQ ID NO: 239995 - DNA, 634 bp, Homo sapiens
gtgtgagttggaattattatccaattaaatgaacataaattatactgcctacatagattggaaaaatatcttttggtgggccgtgtgtgtatatgcacccatgtgtttatgtaaaaccaaacatcaacttacaaaaaccagttcagtcttatagccttgtatagtgtaacatacgggctgagacatttgcttatttgagccttttcaccctttatttgtaaaaaggaggagagcctttaagtgaaatgtaaactaaacttggaacccctaaaacgattttgaacactacttgacatttaaatgtttattaaaaataaagcaaagtttaagaagcatgtttggtaaagagttctttggcaggaaatggggacctatcagccaagctaatagccttagctatggcatccatagtaactaagacacgctgccgatgtaaatatttatgccagcaagcagtgctgcagaacccgggccgagcagttcagagcagtgaaattaaagcatcagccgccaatgtttgatttattttgtattatccggtattccaagcattaccatcattcatctcttctagggtttttcaaaatagtttagccctaagaacaagaatcctagaagaccagtttactcggag

SEQ ID NO: 239996 - DNA, 633 bp, Homo sapiens
ctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagttt

SEQ ID NO: 239997 - DNA, 637 bp, Homo sapiens
gtccaagggctgctgatgtcccccggccctttggatcatctcttgtgcagctgaaaccctggcttaggggaagaggaaccgcctgggaggggctgggggagatcctgggttcccctctggcactaaccaatgtggccaccagagggcgcaaggtggcagagcctggacttggccaggatgctctctgctgggttggggccaacaccaggaaggaagcatgggccatagggaagctcccattggtgctggggcaacccgcagcagctctgcgtcttctgctcttctgatgggaactgcaggcctctcccctggccccagagagtcgggcttctgggcccagccgctgtctgtcatgcctgcactcaggcagctggaggggtgggaggggagatggctcctggccttggccatggctgctttggcttccaccgttcctgctcctcttccatgtggccccctgacttggttgtgtgagcactccagtcctggcagagcctgacaggcactccctgaggttggggtatcccttggctctgtcctggggttgaggtccaggacctggcacggctgtgagaaggaccttgggctggagctgtggactcggtgctttattcgttctaagatgaaagtcattcat

SEQ ID NO: 239998 - DNA, 452 bp, Homo sapiens
gtccaagggctgctgatgtcccccggccctttggatcatctcttgtgcagctgaaaccctggcttaggggaagaggaaccgcctgggaggggctgggggagatcctgggttcccctctggcactaaccaatgtggccaccagagggcgcaaggtggcagagcctggacttggccaggatgctctctgctgggttggggccaacaccaggaaggaagcatgggccatagggaagctcccattggtgctggggcaacccgcagcagctctgcgtcttctgctcttctgatgggaactgcaggcctctcccctggccccagagagtcgggcttctgggcccagccgctgtctgtcatgcctgcactcaggcagctggaggggtgggaggggaacatttcatcaccttcctgaccttcttacacccttcatccgtaccagatccctctaccactgc

SEQ ID NO: 239999 - DNA, 440 bp, Homo sapiens
gtccaagggctgctgatgtcccccggccctttggatcatctcttgtgcagctgaaaccctggcttaggggaagaggaaccgcctgggaggggctgggggagatcctgggttcccctctggcactaaccaatgtggccaccagagggcgcaaggtggcagagcctggacttggccaggatgctctctgctgggttggggccaacaccaggaaggaagcatgggccatagggaagctcccattggtgctggggcaacccgcagcagctctgcgtcttctgctcttctgatgggaactgcaggcctctcccctggccccagagagtcgggcttctgggcccagccgctgtctgtcatgcctgcactcaggcagctggaggggtgggaggggacgacgcctctcccctgtgtgctcgtgtctcgccccgccgcgtcctttcccg

SEQ ID NO: 240000 - DNA, 646 bp, Homo sapiens
aactgtaaattatcgagacattctgcattctgttttgcatattgtctttgaatcccatgagtttacacttagagcccaattcagatactacattttcatcagaaaaacttgatctgtatttagatttaattaaatgtacagtcgtaaacattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccctttggcccaagcgatttttaaattgggcaagttttatcctggggcccgaattcggggctaattgggcaatttccccttaaggggggccgtttaaaattcaatggccggggttttaaaacggtgggactgggaaaaccctgggggtacccaacttaaacgccttggaagaaaatccctttttcccaagtggggaaaaaaccaaaaggccccgaccggagggcctttccaaaaagtggccaacccttaatggcaaatggaaatggaaggcgtaaaatttgggaaaaatccgcggaaaatttgtgtaaacaccgcttatttttaacccataggccgaaattgggtggacacggggcccttattaagaacggggctttcaaggaaggggg

SEQ ID NO: 240001 - DNA, 427 bp, Homo sapiens
attccagtaataggaagttatcctaagaaagtcatcacaaataaatgtaaaaatttagccacaagaatgttcactgtagtactatttacaataaaaacaggaaacctaaatatccatatggggctgattggataatttgtggtaatccctattaagaaacatcctgcagcttttcagaatatctggttaaatggaatgataatcgaggacacacaaaaaggttcatcatattataaaaacaaaaaattgtgttataaatcaatattccaaaacgttctaactttagtttttttctgggtgatggggtcctgtgtaacttttatcttcttatggttttctgtgttataatttttctctaagagttatatatcactcatataaatgtattttgaaaaagtgtttaagaataaattttaactagtcacaa

SEQ ID NO: 240002 - DNA, 380 bp, Homo sapiens
cggaaggcacgagagctggaggccaacgtgaaggggccgcggacagacctgccgaaccaggcggagggcgcgacaatccggaacgcctagcgcctgccctaggggcttgaggcgcagggagaagcgcgggagcggcggcggcggcgccgccagcgggaggagcgcggggcggacgaggtggagaataagcggcggcgccaaaacctaagcaggaagaaggcggccagctccccgcgctccctgcactgggcccgcaaggggacgatcccgtccaggacctggagcgcgccggctttgggggcgcccgagggctccccccttcccccaccccaggcccagcgtgtccctggcctgggcctttcccacctggggctgccgtc

SEQ ID NO: 240003 - DNA, 487 bp, Homo sapiens
cctgcttaattaatgtgctctaaatctggaaatgattcaaatgtttgtcagttggtgattggaaaaacaaaccgtgggaaaaccatacaatgaaatacttaccaatataaaggaatgaactatttttattatatgtaatagcatgaataaatctcaaaataatgctgagtgaagaagtcagatgaaaaaggggccatactgcatgattccaatcatataaaaatttagaaaatacagcccatagtgacagaaagcatgtgagtggttgtctgaggttgagggtatgggtcagggagaggtgaaagggaaggatcaaaaagggtcgtcagaaaacctttggggtgactgatatgtgcatttttgattgtggtgatggtttcattggtatgtacatatgtaaaatcatcaaattgtacgtgttgaacatatgtaatctattgtacatcaataacatgtcaataaacctgcaaaaaagataatatataca

SEQ ID NO: 240004 - DNA, 392 bp, Homo sapiens
aacattactgaggacttgggttttgctgaacattgtatataggtactataaatacaaaaatgagtagacatgcccttggacccagataatcctttgagagtcacctttgagcctgaatcctggaagtctccacatataggagtaaataaaaaatcatcgtgttaaaacaggtggcttaatgctagaaacctccatccaacccaagcaccagaatacagataataattcacatttacctatattctttttcccagccactttttcttatccaaggaaaacacaacgatgaacattgagtttataattttcttgcttttttttgttcttaagggttgtttatgtttttaaaaaaatgaacttcattaaaacagcaccaagttttatataatctt

SEQ ID NO: 240005 - DNA, 542 bp, Homo sapiens
ccgcatgctggtcctttctttcctgacaggcgggcagtctccctccagcttctgggaggacagttcaaattatggaggagggggtgcatgtagggcagcagtgcccaggggagtatgggggagttgggggagcagaggctcatttttctttatagctcagattcccaagcctgtgactttgagaatctttgtcttccttgcaacatttcaatctgaggctcttgtggagagggcagagttggagccagatggaagagtggtgggagaggagtgggtggagggaacatggagaatgtttcaggtggtgtctttatttctggcaccttactttgcctactggagtttcccagtctgttccagacgccctctctagaccctgagagggcctgaggaggcatgttagttgccagtgtggtggagatggagtgccgggaggtggaggttgcagtgagccaagatcacgccactgcactccaggctgggtgacacagcgagtctctgtctcaataaataaataaataaataaacaaacaaatggaagg

SEQ ID NO: 240006 - DNA, 496 bp, Homo sapiens
attcacaggattacaaaaatataatatccacatttactcaaagaaactttaaatttggatcctccaacccaaattaaggatgtgagaactgactttgcatagttatcttagacagatctgctctttttagagtgttcaggttttattcacttcatgttaactccttacctgatacctccccaagaacaagtcacatgtacttgaggcaagataagtttggagcatatatgactacagagaaacggtaagagtgtttagcaccgaaattttctatgtgtactttttatataatactctaatggcaaattcactcttgttaaatgagtcattagaatacatttgattttttaaaatctgaaagatttttggctgggcttggtggctcacacctataatctcagcactttgggaggccaaggcgggaagactgcttgaggccaggggtttgagaccatcctgggcaacaaagtaagaccccacttctacagaaaaatta

SEQ ID NO: 240007 - DNA, 778 bp, Homo sapiens
taatcatttatagaactcctttagttggtttacttgcctcttagggtaaaaacaaaattagacttccagagtagtctgtgatcttggaaaagtctttctgaaaaatgattatagaactgttaagacatctcccatctcatctcatatggcatcatacttttcccaattattttcagatattttagcatcaaagttttctagaatgagttttgtagaacactagtatccctcattgcttaaatatattaggaggaaaaggattttttttattaaataagtttgggaatatatagagtggacaaaattagttttaaaattacaggtcatttgagaggtcttgaagtaccagtgtcttgtggatccctgaagggctagatgagggtggggcatgtagcctttctcaaatttatgtgactaccatacagtttgaggaaagctggtctatataaatgcattacctgtgaaacctggctttcttccacatctcctctgacttgctttgctatttttttccccatctcttacagtacttcctgctatcccccaaattgggggaattctttcttttttcattttaaaatatgatattctggagatctgaattctctctttttacatttttatatgtgtattccactttgagcaatattaatactagcttacattttaaaatacgatattctggagatccaatgtataacatgagggctatagttaataatattgtattgcactgggattttttttgagagtagattttagttgcccttgctaaaaa

SEQ ID NO: 240008 - DNA, 603 bp, Homo sapiens
cccaggatccggagcttcgggggggccgagtccgggtttggggcccgggaggcggggccagttaggtcgagggtccctgggatcgtcgggtcaggccttgggctaacgtaggcactctcgcagttcctccgccttcaggaaggtctttttagcaggggccttacgggtgcatgcttcggtcctggaggacttaggctagcctcctctccatcagcgccacccgtctggggcccgaaaggagggagctttccctctgtcccccagcctttggactgtcaccaaacaagccattcgttcaccaaatactttttaagcgcctaccatgtgcctgacaagggatatgtaacggtgagaaaaactaggtgtggtccaggcccttcagggactcaggggctcgtggaagaagtggatattgaagtacttatcacacaaaggaggataaaagtacgatagcgatatctaccacgaaggtgagcagacagagctagcggggcttgcaggaggagttttgatcttgcagggacaggaaggaggagttagctcctgcggggtgggattgggggtggtagtgatatagacgtggggacagagtggaaaacaaca

SEQ ID NO: 240009 - DNA, 264 bp, Homo sapiens
atacagttctttctattataaggagacttaaactcaccacactatgtaaagtcatacaataaagaccacagggcctattggaaaaatgaagttaggggcacaacactcaaaaacttcatcagtgacacatttgaaaaaaagatgggctgggcacagtgtctcacacctgtaatcccagcactttgggaggccaagacaggaagatcacttgagcccaggagttggagaccagtccgtgcaacacagtgagagcccatctctaca

SEQ ID NO: 240010 - DNA, 447 bp, Homo sapiens
gtttaaggttccctataggcagatcctgagatgaagatttaaatgcacaccacttattgaggaggtgatttcaggaaacaccggcaggagagtggggcagtatgacagggaaagaaaggaagcaaaaaaataaagggcatgttctcaaaggaatcagttggagagcagtcatgctggagacactggaagagagtatagaagatgtctcaatgtagtcctgcctagggatcaggaagtcgaagtatttatccactaattcttgtcaattgagaatttatttgaggggcattaactctccaaaacggtctccctgtgccggaaaaataaccctaagcagaatgttgtaggtatttgcagcaaatagccctcagtgtgtcctgaggattggtgtagtacataaatatacaaaattatttttatttataaaaaagctttctatgcatcagg

SEQ ID NO: 240011 - DNA, 406 bp, Homo sapiens
tcaggtaaataagaaggaaggtcttcagctaaaaatgaagagaggtgttggattcatccaagagaatggggaagaatgagttgaaaataaggaaaagttttaggatttccaggcagcacctagtgcccatttgatgtttgtagttgtaaacctaggtgagaccctacttagcatagttgtacacttttcctgcagctgtgttgagctgcttggatgtggcaatgtggaagggaatagctgaagtaggatggaggacaccaccattggaagtgggggaatcaaggcactgagaggtaaagattgtggtgaagattgaggttatcataaattaacagaatgacctagggacctgtagatgtctgtaacagggagagatagcaggtagttattgtttgaagacatgaag

SEQ ID NO: 240012 - DNA, 402 bp, Homo sapiens
tttcttttaactttttcaagggttatgaaatcattaaacattaaattccagttactgggacaagcatgaataaaggactaaagtccagaagttgattattttcataaataggatatgccacaaatgaccttacatacctgctgagccttgatgtctttctaaaaaatttatacctaagaagaacttaatgaagactggaagtagattattttaaattggcaggtaacaaataagttcagagagcaataattttttttttttttgaaatggagtctttctctgtcacccacactggaccctgtcacccaggctagagtgcagtagcatgaactcggctcactgcaacctctgcctcctgggttcaagcagttcttgtgcctcagcctcctgagtagctgagac

SEQ ID NO: 240013 - DNA, 419 bp, Homo sapiens
gggggatggagtctagctcagtcatccaggctggagtgcagtggcacgatcgcagctcactgcaacctccacctcctgggttcaagcgattctcctgcctcagcctcccgagtacctgggattacaggtgcttgccaccatgcctggctaatttttgtattttttgtagagacggggtttcaccatgctggccaggattttgagaccagcccctggcaaaacaaggagacctcgtctctacaaaaaattaaaaaaaaaaaaaaaaaacaggtgtggtggtgcatgcctgtaatcccagcaactcagaggctgaggtgggacaatcgcttgagcctgggagatcaaggctgcagtgagccatgattacaccactgcactgtgatccatcagactggccaacagagcaagactctgtcaag

SEQ ID NO: 240014 - DNA, 508 bp, Homo sapiens
cgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatcagctaa

SEQ ID NO: 240015 - DNA, 198 bp, Homo sapiens
ggtgagtcaccacacacacctctcccagtctaggaaacgggaatgaggacacgcacctggcagggctgtggggagactcaataacgggagggtgctgtaatatcagttgttaattccagaaagctaaccccagggaagagttcctaattttctcttgtatatggggtacaagtaaacattcaagcctgttgtcacttc

SEQ ID NO: 240016 - DNA, 377 bp, Homo sapiens
ccccaggctggagtgcagtggcacgatctcagctcactgcaacctccgcctgcctggttcaagtgattctcccgccacgtgtatttttagtagagacggggtttcactgtgttagccaggatggtctcgatcttctgaccttgtgatccgccagccttggcctcccaaagtgctgggattacaggcctgagccacctcgcccggactacattttaattatggtatgcacatatgttaaacttttatacagaacaatcattttataagtaagccaagttaaataattcatttttatgttcttacgccggagtcttcagatttatacaggataataataaaataagtagtaaaaatatgtatgcttgcgtatgtttcta

SEQ ID NO: 240017 - DNA, 437 bp, Homo sapiens
attcatagatgtctagggcttataacattcctggcacataacaagtcattattttttattactacttcggaagggaattgagtactataccctgaagaaggtgagtatgggaattctctacgggtctggaatgtccctatatttgtttattttgccttcaagtgactaactttaataccctattgtgattagaagttaaacttctgcaaccaaaaggaagcaggaagctagtatttcttgaagtgcttattacatgccaggtactgtgctacaaaaacaaaacaaaacaactgtaaaaaaaacttcaaatttggctgcgtgcagctgctcatgcctgtcatcccagcactttgaggaactgaagggaggattgcttgagtccaggagttccagaccagcctgggcaacacagtgagaccctgtctctacaaaaaaac

SEQ ID NO: 240018 - DNA, 348 bp, Homo sapiens
gaatgatccttttaaacttagattttaaactatctctgtcactttagaaacccaagtttccctgtctcacttagaataaaagccaaagtacttacagtggccttaaccccacacaacctggcattctcatgtatctcagatagtctttgccttgctcattaattttcagccatattagggcctcctggctattccttgagcataccagacacattcctcccttaggggctttgcagtggctgttctgtgccttggatgctctttccccagatttccacatagctaacacctcctttacctccttcaggtctctgctaaatgccaccctttcaatgagactgtgatcac

SEQ ID NO: 240019 - DNA, 697 bp, Homo sapiens
tgcttatttcactaagaaaacccaacaactgagactgcctagcccgccggtcctgtgcgcttttattgtgcttctaaccccagtagagtagaactaaattgcactgaatgtatagttaactctgtcttgaattctctgtttatgcaatgtgctcgaaagaaaaaaatgttaaaaatatatctataataataattttttgtcatttgtctttatgtccagctatgaatgtagattttgtgtcccgacagccctgttcctggtccaagtactttgtattgtatacgtgagtcataataataaaaagaagaagaaaaataatagaagctggaatgacttgctttttctccacagctcttccctattctctaccttctctctccttatccccctgtccaactctctggaaaaggtctgcttcactgctctggctttggggttcagaaactcacgtggagagaagcctgggaattgagaaagcatgctggcctgggagggcaggtgaaaggggtgaggggttgagaggaggaagaaaaggagcagtccattggttgagagagtaaggagtctataggtatgcccttgggggaatcttggctccaaacaaagtgggtttccagacgccaggatcccaatgggaagaaagatttcctcactcatccaccctcctcctcctcagccttgggctgggcccagacaa

SEQ ID NO: 240020 - DNA, 506 bp, Homo sapiens
ttttatcctatagccttttaaagtgcattcctgactttctgaattacaaaagcatctgcagtcttgctcagacctcaaccaatgaggattttggcagccaaagcctgttcaacattttacttgttgataaggcattacttttcttgtttcagaaagaaaggagagaaagaataaattaattgttgtattcaaggcaacttgcaataaaaagacatctacctggccgggcgcggcggctcacgcctgtaatcccagcactttgggaggccgaggcaggtagatcacgaggtcaggagatcgagaccatcctggctaacacggtgaaaccccatctctactacaaatataaaaacttagccaggcgtgatggcgggcgcctgtagtcccagctactcgggaggctgaggcaggagaatggtgtgaacccgggaggcggagcctgcagtgagccaagatcacgccactgcactccagcctgggcaacagagcgagactctgtctcaaaa

SEQ ID NO: 240021 - DNA, 552 bp, Homo sapiens
gaaataactataaagatgggccattttgtggttggtataagcaacatcttggcggtagtcagatattaagcttatgttccccagagagaattcctctgtatttcaatagcacctcgtagctatcttcattactgacaacattagttatattgcagtgcactttttacgtccacttccacaaactgaacacagggacagcctatctcattcccatattcacagatgggaacaggacaaaatattttattagagttattagggggaaaaaatcccattaagagcacatatgctgccttcataagggtttagatgcaacacagaacaaatgagctataacaactatttccatttcaaaaaacaattagaaacaggttattaaaaacaatcacctctactctgtgaaagctaaggaaatagattctcctcacttctgaatcattgaacattccaatattgatgtagaaagcatagagccttatttcatttgatagtaaagaataaagcaagcaatattgccacataacaaaccacacacaccacagacaaaaacac

SEQ ID NO: 240022 - DNA, 548 bp, Homo sapiens
tttttgtctctaatatcccagacatggcgctaaaactgaatattatatttaatggtaaaagactgaatggagccaagtgtggtggctcacacctataatcccagcactttggaaagccaaggcagatggattgcttgatctcaggagttcaagaccagcctgggcaaaatggtcttgacaagaggatagcttgagcccgagtttgagcccaatctgggcaacataacaagacattgtctctaaaagaattaaaatgccagccaggtgcggtggctcatgcctgtaatcccagcactttgggaggttgaggcaggcggatcacatgaggtcgggagattgagaccagcctgaccaacatggagaaactctgtctctactaaaaatacaaaattagctgggggtggtggtgcatgcctataatcctagctacttgggaggctgaggcggagaattgcttgaacccaggaggcggaggttgcagtgagcggagatcacaccattgcactccagcctgggcaacaagagcgaaactccgtctcaaaaaaaaa

SEQ ID NO: 240023 - DNA, 532 bp, Homo sapiens
ctgctagtgtggctgaagaggaacagatgtgttgattttgattgatttgcatttagaaattatgcaatatttgtaacgtgtcctagatcattgtgctcttcttttataaaatagaaataagcgtgtaggcgtggatatattgcaccccaccatgaccgaatagttattacttggaatttttcacacctagcagtggtgctgatgtttcaagtatagctttttgagagccatgattaccactgactcattccttttctatgacttgaaatcgtgtaggaaagggaagagtagataagtttaaagagatttccttgttgcagaaaacactaaggtataacaaaatgaaagagttgcaaatggcatggatgatgtgttgcccaaaccctcctctgagagatgtaaaacttgaagccaggaaaaagacatggctggtatttggagataggtgaggactagaaaccaggaataagaaggaaaaacaaaactgaaagctgcaaatgggttataaggatttatcgggaaacactgatgg

SEQ ID NO: 240024 - DNA, 179 bp, Homo sapiens
caaggtcaggtccaggctccccagatgtccccgcatcccttgctgcttccagctcccaccactgtcaactcacacccagtccctcaggtctcctttggaaacagttggcttggggaacagtctgccacctctgctctatcattgtctttgccagcacaataaacttatttttataggat

SEQ ID NO: 240025 - DNA, 372 bp, Homo sapiens
cagtccttatcttacgtgacctttaccatccaaagagatgactgtctcattcttgaaagattcttcccttgacttctgttttggctttactccgtctcagttttctttcagaatacattatcttttgcccattcattgaactatcattgtttcttaagagtttgatttatacctttttacgctttctaaaatgtttcaaattagataatattttatatacacatgaatatatgtatcatatatatgttaggaaccataatagccaaatgaattcttgtgaacccaccatccaatttacacactagacaattaccagtacctttatttttgtatattctctgtgaggctgaataatgacacagccacccacca

SEQ ID NO: 240026 - DNA, 496 bp, Homo sapiens
atccatattaatctgacaatcatacagctgtagaattataaattagttgataacttctttcctactcttataattataaattatgcttttaaggtgccaggagagaggagaacaggagagcttcatctctttgatgaagtcagggaaagatttttctgagaaacggatgtcttgagcccaaattgactaatggggagcattaaataagtgaaggggttggtggattctccaggtggagggaacagctagggcacaggacctgtgatcagtgggatcatggttctaatcaaaggcgtaaaggaacactgctgtggctggagcaccaagaacaagggagctgcacagggcttggtccacacagggtcttataaactcagtttaggattttggtcttcatcccaacttgaatggaaacccatagaagttgttcagacatggggatgaaaggattagatttgcattttgaaatttacttggactatgtagttgagctttg

SEQ ID NO: 240027 - DNA, 456 bp, Homo sapiens
tttttgtagatggggtctcgccatgtcacccacgctggtcttgaactcctgggctcaagcgatcctcctgccccagccttccaaagtactgggattacaggtatggaacaggctgacagagctggatccaaagggctcagaatggagcaaccaaggtgtattcacctgatgctttggtctccctaagctcttccatagaaacgatcatatatcacctcggcaattgttttacgatttctcactgtgtttctcagaatggtctcagactcctggcctcaagcgatccttctgcctgagcctcccaaagtgccgggattacaggcatgaaccactgcactcagcctgttttcaaccttatataaatggaatcctactgtatgtgctttttgatatctgggctcctttgctctatattatgtctgtgagattaataaacttgtttgttcagttacgtta

SEQ ID NO: 240028 - DNA, 421 bp, Homo sapiens
tttttgtagatggggtctcgccatgtcacccacgctggtcttgaactcctgggctcaagcgatcctcctgccccagccttccaaagtactgggattacaggtgtgaaccaatatgcccagccatatttttgatgaatctcaagagaaacggaaggggcactgcaaaatgactgattagatttctaattatccgggacgatttctcactgtgtttctcagaatggtctcagactcctggcctcaagcgatccttctgcctgagcctcccaaagtgccgggattacaggcatgaaccactgcactcagcctgttttcaaccttatataaatggaatcctactgtatgtgctttttgatatctgggctcctttgctctatattatgtctgtgagattaataaacttgtttgttcagttacgtta

SEQ ID NO: 240029 - DNA, 289 bp, Homo sapiens
  misc_feature (42)..(42): n is a, c, g, or t
gaaaaataataaattaaatataattttaattagagaggaagngaagcttgagcagatactaacacgatttctcactgtgtttctcagaatggtctcagactcctggcctcaagcgatccttctgcctgagcctcccaaagtgccgggattacaggcatgaaccactgcactcagcctgttttcaaccttatataaatggaatcctactgtatgtgctttttgatatctgggctcctttgctctatattatgtctgtgagattaataaacttgtttgttcagttacgtta

SEQ ID NO: 240030 - DNA, 400 bp, Homo sapiens
aggtacaaccaggaaaaggcccggagctacaaccgggaaacacaggatccagactctcaagttctctacatggctgtgcaaccccatcacagacacttcagtgaagattcagaactgcagcagaaaaaagaaatgtgatttccagagaatacaccgtaagcttcagctcatgtgaagggtatcttctgaagctcgtttccatgaaactcgccctgttaaatatctcccttcccgtgattcgtgagagagctagtctaaaaacaaaaaacctcccctttgctccaggtcggagataattttcctctagttgctgacagtttggtgaccaggcattactgaaaatgtgcacgttgaaccagcagcagatttgtgtttaagaataaactgacaaattttcact

SEQ ID NO: 240031 - DNA, 803 bp, Homo sapiens
aaggtgatgatgggtttccacatgactcttttcaagaccacagccgacgcctttaaaatcatgactggcttatgtgtcgacatgtattctcacactcaaatttcagaataaggcatgaggtggatgtatgtgatggcaccaactctgctttctcttttctagtgaccactcaggccctgcctgcacctattcttactcattttagggctccatccattactctgagccttcaacctgcagctctgcttttcgctgtctgcagatgctgaagaaaggcgtcactaaaggcctcgggctgctggctgcgatcagcaccgatgggagctgccaggatccaacccagtttttaaaaacacacttgatcaagattcacataccataaaatctgcacattaaaagcatgagattcagtagtgggttttagtatattaacaaagttgtgtaaccatcaccccaaaaagaaacactgttccagtagtagtcactccccactccgtactaccctccagctcctggcaatcactagtctactttgtctcacagatttgcctactctgggcatttcatagaaatggaatcctctctgcagccttttgtctctgccatcttcacctcgcgtcatgcttcaagggaatctgtgctgcagcatgtttcagcacctcatttcttagtttggctgaataacattccattgtatggataacaaattttgtttgcccattcattcgttggtgggaatttgggttatttctatcttttggctgttatgaataatgctgctataaacatttgtgtacaagtgt

SEQ ID NO: 240032 - DNA, 365 bp, Homo sapiens
caactggcctccagggggcattgttggaacatgcgatcatcccaaagcatttcagcttgaagaagatctaggacacagtttgttgttaccacctcagagcatttagatgggatgtgatggatggaattgaagttaaaaacccattcaccatttctaggtagtacagtaggctcctaatttacagaaatgcttgtgaaattgggaatcatgataaaatcctcatacctcctcctcttttaaccaaatctttctaaaatgcacaattataatttcttacctttaggaaaaagtaattatgttatatgtgttatatacactatgtaaatatagttcattaaatcattctttggcgtttgaagactttc

SEQ ID NO: 240033 - DNA, 488 bp, Homo sapiens
tcccaaaaatgtgtaagttctgtgatttcttgtactaaaagatatctatttacatagtgaaaggccaggccttgtaaagatcgtgacagtattcaatcctattcttgttttttttgtttcaatgtgttgctagttatcttatctcagtgtattgtatttatataactgcatatttgattaagatacctaacctatgagacatattaacataatgaacacatgtaagcacacaacccaatttaagcataagaacagtatcaataattttgcagttatctttcactctttttcagtcacacagagacaactatactcttaattttgtgtttagagtcctctattttcttaatagacagattgcacatggttaaaggtctatctttacatcaagagagcctgtgtttggatcttgttcaccccgcttatgtctcttttgaagttatgcttaagctttattccttgttcctttatggaaatttgagtatttt

SEQ ID NO: 240034 - DNA, 429 bp, Homo sapiens
ttaattatagcgtgtgaagtcatcaaagagatgaaaaaggtccatctgcaaaattttaaaaaataaattaatccagcaaactccagaataacaactggcctttgaataattctaagtacaatagcttatgttctgtggtggtggttttcgagttcgcccaggaggtggagggcccccgcttctggatgcccagctctgcacatggctgcctgcttgcatgtgcccccttctccctccctgaactctgttttcttttttgtttgttttgtgtttgagacagggtattgctctgtcacccaggctggagtgcagtggcatgatcatggctcactgtagctgcttcaatctcctgggctcaagggaccctcccaccttagcctcctgagtagctctgatcagaggagcacaccaccacacctgagtaactta

SEQ ID NO: 240035 - DNA, 439 bp, Homo sapiens
ctgtcctgtgggttgaatacctgtgtaataagagtacagaaagcaacaaccgagaaaatagatgagagagaaccatcagtgaaataagcccaagaaatgcatcagaattaaagggcatgaatttaaagattaaaaggtatcaccaattatttaataaaagaaaacatagtgtcaggccaattaatatctcaaaatgtcagaacaccatgatcatagacaagatcctacaggcttccaaatgggataggaaaaatgttattttcaaaggtcaggaataagaatgacaccagatctctcaataacagcactagaagctaaaagggaatagagcaatgtcttcaaattcctgatggaaaagcactctcaccctacacaagtatatccagataaaacatcaaggaagtatcaggataaagacatttttaacatgtaaggacac

SEQ ID NO: 240036 - DNA, 465 bp, Homo sapiens
cagttgtatcttagaatagataaaagcctccctatttttcttaacaagttctagattagacaactcagactaagtttttttgtacttcgtttcattctacagggtatccgtggtgactaataataataacagttaacattactgagtgcttactatgagtcgggtacatgatcttacataattcttacattaatcgtatgatgtaggtactaccattacctatgttttgctgtcgagaaaatgttggaagagttaagtatcttaccaaaatttaacattctgggagacagaggtagactgcaaaccctaggaagtcttacctttgctccctaatctctacagagggaaatgcaaattagaataagtgtcccaagtggaagagaaagaacattttactgttcgtatctttaggttacacagctattatagctggaccgtgagtttgactctgaattttctatagca

SEQ ID NO: 240037 - DNA, 729 bp, Homo sapiens
ctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctg

SEQ ID NO: 240038 - DNA, 381 bp, Homo sapiens
ttcccatcccttaacactattccaaaccctccccacttcttcaagctgctaacacctcctattttcaaggttccaaacaggggtatgtggactaagtctggcctctgccatgttttgcttaatctacacatcccacctttattactggcaagagccaagaatctgtggtctcctgtttcctgaagtctccagcaccctctgttgtttcctactccccttccccactccctattgttcccgctccctgttgtttcccagtccttcctgtgttccacgtcttggtctgggtggtggtcagctaagtctgttcagttagtaaaaattcacagagcacttattttgcagttttctgtgagcatgttatataccaggttaaaaaaa

SEQ ID NO: 240039 - DNA, 372 bp, Homo sapiens
ctgtcttatcatacaaatcttcagaacaactttatgaggaaggtgctctgatcatcctcatagtatgtaaacgaaaatttagcaaccacaaatgaaagaacttaagatcactcaactagtaaaatatgattggtgcctaagaaatttgattccaagtctgcatgcttaataactactacttctcaatttagttggttggatgaattaaaagcctgtaaagagaccaaagaatgagtcaaaacgataggaaaataattttgctagcaacatccacaataatttgtggaaatggttctaagtttagtgaatcaaaaggttaaaatagtcctgcctatgggtcttccagagataaacaaaatctgtgtcattggg

SEQ ID NO: 240040 - DNA, 263 bp, Homo sapiens
tactagtgcccccattattctaattctctttttctttcattgtactaatcataattggtagggttttttttacatatatttgtttgcattttctaatgtctgtcttccttatgtgatagatacagtgtctgttttgttacccactatgacatgccaagaatggtacctgatagataattggcctttgctgtgctgtatgaatgaaggaacactaactgctggacataattacagcctttctagaaagcaagaattatcaagaa

SEQ ID NO: 240041 - DNA, 426 bp, Homo sapiens
gaaacacagcgccttaacccaaaagagtgacttatatggcagggatttcagaaattgtgacttgccagcagagaaaatattagaagaaagactctacctgcataggtcatattttatcctactttgtaacaggccatctctgcttttgtgtatcactcataagttcctcttcactctaggtcatcttctgtgtagttactgaaataatcacattcacatacagtttacagtttttatcatgttatctgtgtacctgaagtgtttattacatacttgtcatatcctatctaaactcctcgacctagaattcaaagttcattttaatcttgaagtagatattaaatatgtattagatgaatgaattatgaatatcctaatcccaccaagctgatctgcataaataaagcctgtccattcctctcttca

SEQ ID NO: 240042 - DNA, 398 bp, Homo sapiens
cctgggctcaagtgatcttcccactcagcctcctgagtagctgggacaacagatgcgtgccaccacacctggctattaaaaaacacttttctttcctttaagagacaaggccgggctgggcacggtggctcacgcctgtaatcccagcactttgggaggccgaggcgggcggatcacgagttcaggagatcgagaccatcctggctaacacagtgaaacccccgtctctactaaaaatacaaaaaattagccaggcgtagtggcgggcgcctgtagtcccagctattcgggaggctgaggcaggagaatggtgtgaacctgggaggcagagcttgcagtgagtggagatcgcaccactgcactccagcctgggcgacagagcgagactagactgtctc

SEQ ID NO: 240043 - DNA, 328 bp, Homo sapiens
cgtgtgaagagacctgtcaataggttttggggccaacaggtggtgtttggttatatcacattccagaattccttcctctgagagcgggacaggatcctctctagaatgttgatcttatgacctacagtcaaacaaggaaaatgggaatccacttgaactgtgaaggatacccaagatcacagggaggagaaccccagcaaacagctcctgtgatggtgtctgggtgataaaagatgaccgagcaagacggcccttatcagatgtagaccctcagtcttggacttctcagcctccagaattatgagccaaataaatttattttcattat

SEQ ID NO: 240044 - DNA, 244 bp, Homo sapiens
actgttatgaagattaaattaatttatatatgtaaataagacttggaacatagattttctgtaaatgttagccattgttattgctcctattgacctgaagtataaaaacagaaatgtgaccctggtccttgaccttgggtggcatcaccagataagcaatagtttagggaaaaatgtttgtactgggtattttcattattcaaaatattattaataatgtgctattaagataatgttacaaaat

SEQ ID NO: 240045 - DNA, 341 bp, Homo sapiens
attttgaggaactgcagaaggggttagggctttaacatatggattttgggggaatacacttcagcccataagagcagcattactggcagggcgcgttggctcacgcctataatcccagcactttgggaggccaaagcaggcagatcacttgaggtcaggagttcaagaccagactgaccaacatagtgacaccccatctctactaaaaatacaaaaaattagccaggcctggtggtgtgtgcctgtaatcccagctactcgggaggttgaggcgaacctgggaggtggaggttgcagtgagctgagatctagcctgggtgacagagcgagactctgtctcc

SEQ ID NO: 240046 - DNA, 284 bp, Homo sapiens
ctagcttcatgtcttaaacacactgaattcctttatgatttaagagaggaattagtgaattccttatctttgtaggaaataatactttcagttaaaagaataggtgtgctacctgaactatgtgtttttatctttttattctatagattttatcttgtaaatctaaccatttgacagcatttttctaattcactcttcagagaaaaaattttttaattggaatcgttataaatacagatgtttctaaagggttctacatccatgctagattttcatgctgactt

SEQ ID NO: 240047 - DNA, 672 bp, Homo sapiens
cgggctactggatgaatgtagcaaactcaactagcaatactcatctcacacgtgccacgcggaggattcgccagtcgaacagagaaggtgtagttttccaattcttcagtgctcgtacatacgtcgatattcgctattgcctcaatacactgactgggagtgacaccccgatacgatcagggaagttcctcaccgtggcacgtagtcctccggagatcgcgcaagtctcgacaacggatgatagctctccaagaagtcccatttccgagatgtaatactcaatgcatgcgcttgaaatctcctcagtgatcctcattggtgactaggtgtagattatgcctccaagctgctaggctccatcggaggtcgagatgcacgctacagtcctaatgacgaacggttgcgttgtcttctgccgcacagactggtcgactaggattttcggcaccagaaacatagagacagagttagaatacattgacagtcaattgtttccacagtgctgggaactctcaagctgtagcagggaagacactccttatgtatggagagtcagctgctacgtgagcacctcagaagtcaccaacagcctttgtacaaagtcatacagggatttgaacttcaactcttctaaggtcaaaggaaatacaccaaaagtcaatatttgcattc

SEQ ID NO: 240048 - DNA, 1226 bp, Homo sapiens
agcaggagcagcagcagctccggagcagagaagcgcacacgtgtgtgcgtgcgtgtgtgtgtgtgtgtgtgtgtgtgcgtgtgcgcgcgctgggggcgagcccagcgcaccgcggggaggagggtgcgcttcgcagggcgctcggtactcggtcgggtgccgcaggggccgcagaggctgctgaggcggcgcggatcctgctctgggagctgcgcgccgtggcctacaccctggcgggcgcgcgctgacccgcttggttactccacgttgctgccgccgccgcttgcaaacgcttccagcctccagctccctccttctcctgctcctccttctcttgctccaaacgccaacccagccacagacgatcagccgtcgcggttgcgttcaccccctgcggatcacaacggcagcccttgcgacaccctggctggggagttttattcctgagggggttgcgcaggggctcccttggactcccaccctttcccaacctctgctggcttctccccaacgtggaattgctcgcttagggtaggtaggcacttgccaccctaaaatagatcctctctgtctcctcctgtctgcagccgggcagcccctcagtttgttcctggatgactccctagaccgtcaggctaatattctccatccccctcccctgcctctttcacttgcgctctcgctctgctgtctctttctctctttctctttctatctctatctcaatctgtctttctcttgtcaggagcttctggagctccgctcggagcgaaccttctgctgccagcagataacatcacgatcttgccggggaggggagatttataagttctctctgaaccacgtgtctgccttcaacaaagtgacgtgctaggattacagtcagaagtcctctcgttacttagaccacgagctctccccgaaccgttgagggagtgtggaaatgaggaccgctgtggttactcaaagtcaacattttcatttcggcatgactctgcagccatactgaccagacagatgatttaaactggaaactctgttgaatgtactcccaaacccaagatctctatactgttctctacttcagatgttcctgagttcagaaaagtcacaaagaactttctatcacttttggaatttatacttcagttgtgtatggggcctaggttattagtagagcactgaataaataaaataataatagctaacatatactacacttagta

SEQ ID NO: 240049 - DNA, 665 bp, Homo sapiens
gtgtcttccgaggtgaagcagagagaggcattgcagctttttcctgattccttggattgctcactttgagagaagccagctgctgtgctctgaggacactcaggcagccatggagagctccccaggctctcactgtgccaggacctacttgccagtcctgtgagtgagctaccttggctcacctgtcgcgcatcaatcacctcgcatcatatggcagatgccctgctgcttctcatctcacctggaccagggattgctacactgctctagtgctatcagcttacttatgatctacttcacctaccacatctgtctctgtgcgcgctttcaatactatttttttatctgtcggctcgtgcctaatttcgtccccgctattattgctcatgtctgagatgctccccaccgctcgcattcctttcatcctctctctatggtttctatcccctctgcctctacccgccttttctcatttgcagacttctcttcccctcatctctcttgtctgcaccgtcgctatttcccatcgttttgtcttcccttttctctgtccttatcatccttctcctgcttccccattctcctctccttctccctctttctgctctcttctttcttcccctctagctatctctattccttctcctctgacctcctcacccccg

SEQ ID NO: 240050 - DNA, 413 bp, Homo sapiens
cgtgccaggtgcattccatctaggccatgtgcagaggcttgggtgagatgagttggcagagaggttgggtgagcaaagtgaatgtcaacttgatagatctgaaaagccgccctgggatccttgagtacaatgaaaatactaaaatcatggaatgggtacaaggagtgttttattaggttggttcaaaagtaattgtggtttttgtcacttaaaaaatgtcatggcaaaaaacgcagctgcttctgcatcaatctaatacaccgctaacactttcgtctcatccagggatgtttgtggggagtggccagtgttcagatacatccgtgcacagtagcagagttactccagatcctggaggctctgagtctccaccacatctctccaggccactgatggtccagacatctttgtgt

SEQ ID NO: 240051 - DNA, 516 bp, Homo sapiens
ctatacagcttaaaatgccgatagtgctgaggttgagaaatcctggtttgacatattattcctgtgttaaaattaatatatttaaagtaatttcctcggttgttaacatggcatttttgtcaagcaattttgttttctctgaaacatacctcagattgtttttagtttttccaggggaaactttattcattttttactagagaaaagaacatggcaaacagtgaatctgtgtttcaggaagggtaacgtcgtttttcttttaatttcccttttgaagctctcagggtgctaccaacatcttggaaatctggataatttgagtattactgagggaatattttcattctacatgctacaaatgtttaatcattttatttatctaaagttcctttcttggccaggcgcggcgtctcatgcctgtaatcccagcactttgggaggctgaggcgggtggatcacctgaggtcaggagttcgagaccagcctaaccaacatggcaaaaccctgtctctacta

SEQ ID NO: 240052 - DNA, 156 bp, Homo sapiens
gtatgtgacttagaaactaaacaaacactttgctatccaggaaaatcaataatgctaataatgcaaagaaaaattgcactgttcaagtttaacatgcaagggagactttatttaaaactactacaatagaggagagattgaactgaactccctcta

SEQ ID NO: 240053 - DNA, 1104 bp, Homo sapiens
atactattgatggtgttagtttgaaactattacatgtagtaggatataatgaaaatctaattatgttaatgtcactggaaaccaacattttcaacataagagaaaagagatacgaatataaaatcaaagaagaaaaaactactatcagtatagtcttggatttggaaacatctgtataaactcatgatgcttttttctctttaaaaagtattctctatttctaacttctaaaaaggcctgggaacaataactagccctgtgatgctgagcacctctagtacccgcttcaaaggttctaaatgtatttcctattaaaaggaacaagggcttcttggagaaatggctgattctgggttcgtggcaggaaatgcataagatgggttcagaatattttgtcatacaaaaagcaagttgtcagcactactaacgttgtgtttaaaggacataaaaaccaacttgaggactgtgctgcacaaagatggggtattttaagtatcaaaaagaataatgcctacgatggattgaaacatacaaatctgaaacttgtgtttcaatctatgagtttataatgatactaagagcaaacaaacaagcaaacgtgtaggtctgttctgtaggttggtagcttatcaatgtattattctgaaaggcaggttaaaaggaaaagaatctgtctttcctatacaaactgtatttcagagtaactaaatagacaccgaggaaaattcttctttactgaactccagccaataaatgaagaaggtatcacagaattaaatatcatcattttgcatgccctaatcaattaatgcctgtaggcctggggtgtccaatgtggcagccactacccacaagtgcctactgaacatttgaaatgtggcttatcggaattgatatgtggtataagtgtaaaatacacactagatttttgaagacttaatacagaaaagaaagattgtaaaatatcttggtttttatataatatttttgatataacagattaaataaaatatattatttaaattaatctcagtatttctgattacttttttaatgtgcttactttaacattaaaaaatatacctatatgctttgctttctatt

SEQ ID NO: 240054 - DNA, 491 bp, Homo sapiens
atactattgatggtgttagtttgaaactattacatgtagtaggatataatgaaaatctaattatgttaatgtcactggaaaccaacattttcaacataagagaaaagagatacgaatataaaatcaaagaagaaaaaactactatcagtatagtcttggatttggaaacatctgtataaactcatgatgcttttttctctttaaaaagtattctctatttctaacttctaaaaaggcctgggaacaataactagccctgtgatgctgagcacctctagtacccgcttcaaaggttctaaatgtatttcctattaaaaggaacaagggcttcttgtaaatatggtgttagtgtttgaccctactcctggatagttcccaacatcttccctgtggcaggtttcctggctgagcccgagcctccctccctgtttattgtggtcatgatcagtatgtgtttccatataaaacttttctcaacggaagtatgtagt

SEQ ID NO: 240055 - DNA, 378 bp, Homo sapiens
aagtattgtagaaaaactatatgaccacttctattggagtcatattttattttggactaaaaagctgtggcaaacattcagcattgcttgaaatccatttatatacccccaatttatttactatttgatttcccatggtaaatgatccatagtctcctctcttttctcaagccacctgaaacaattgcctcttcatcaacagataataagtctccattcacacaaaacaattgagaccagcagtagtgagtttcctatacttctttccagcactcctcaacattatctgtatctatactgatttaagtctttagtttagtcttcagtggtaaagtgttgctttcaaattcaggttagctttaattctttcattttccc

SEQ ID NO: 240056 - DNA, 352 bp, Homo sapiens
ccccagccagcccctggtcacacccctgcatcctcacaccttagagtcagggcccagccagccaccttcaggaccctggtcagctccgccagcccacagcctccgcgggtcaggaagggaaatgctgctgttttctttgctggcctggcatgttcctctctctgaagctgaaccacaggctgtctcaggggaatgtgtcccttgactcagccaggaggcacctcccaccctcatggtacagctccaccttccccaggctggcttctgataattgtgctttcggaatcttgcattggaggccagttatcctaatgtgttgggattttggaaaaaagcctcagcaggtgaaatc

SEQ ID NO: 240057 - DNA, 625 bp, Homo sapiens
cacaaagtaaatagccagtaaatggaagctgttataatctattattagttatcattgattaggtcttattgttctccagatatttcatatatgcatttcatttaatcaggcacttcaagtatagcatctcatttaatcttcttaccatccctctagatactgtttaaagagatgatgcttaaatcacatagctagtaagtgtcaaattttgaacatgatcatcctgatgcccaaagttcaaacagtgctcttttttatgaagccatcatcactatggcaatactgataccactaatgagtcaatcaaactggtattactgatcaccttccatgttgtgtaatccagtttaaaaaagggtgatatttcctctactgttcaggaacatagagcttaatgaggccatggaataacatccacaaaacaatatcatattaatataagctctgcgtgatgtgaagcatctatgatatggactctgagtgtcgcagcacttagcaagaatatatggagtggctctcgccaaaatgcctcatgcaatatggacttaagggagaaaaacaagttaattgcccatcttcatatttttcctttccagagttctttcagtcaacaactctttggaag

SEQ ID NO: 240058 - DNA, 344 bp, Homo sapiens
ggactcagtcctaggccccagggtccctctaaatccctccaggctgcagctctgtcaagagggatgtccagagggtctctaagaccctgaagcttgactttgcaattgcatgacaggaataaatatcacagctcctctgacatcactagtgcagcgtggctccccatcccactgctgccctcgttcagggacaggctgaaggggccaacgaacccaaccctcccagaggagggagccttgctccaccactgggcacacagagtcatccaccatgccactgccttccacaagggatgtgagccgttgcactttaaaaataaatgactgtatattcatcatacaaa

SEQ ID NO: 240059 - DNA, 334 bp, Homo sapiens
ctcccccatgatccaatcacctcccaccaggtctctccctcaacacccgggaattacaattcaagataagaggccgggcactcacctgtaatcctagcactttgggaggccgaggcgggcagatggcctgagctcaggagtttgagaccagcctgggcaacatggtgaaaccccatctctactaaaatacaaacaacaacaacaaaaattagcgggcgtggcagcgtgtgcctgtagtcccaggtactcaggaggctgaggcaggagaagtgcttgaaccctggaagcagaggttgcagtgagctgagatcgtgccactgcactccagcatggc

SEQ ID NO: 240060 - DNA, 214 bp, Homo sapiens
tcccaagccacaaccctgaagttaagcccacttctatgaggacagctttccaataacagccagttctaactgcaaccttgcaagtagccttacgaaactgcaagcttgcagtcagtgccgctcctgtgaagaccctctcctagtactggccagtgcacactttgccacctgtgataagccctgtaaccaataaacttttgtttcaaaacctgca

SEQ ID NO: 240061 - DNA, 543 bp, Homo sapiens
gagtgcaataaatgcttttattagtccttttattaatgacggttggtatttgttgagaagctgggacaatagttattccagtaagaggatattaagctccctcaaacaggccctgtatatctaacaggctctggcccccagcctcccctgacgcagctctgttacactgcagcacacccctggcctcccagcaactccaagaagggagaggagggatgggggaggtagggataatctggtgtcattaaacacacaggcctttgtggaggttaccgtacaccaacagcaggaagctttttcttccttctgagagcatagggagcctatgtgattttgttttttttttgtttgttttggtttttttgttttttgctacccctgtgctcctggctattttacctccagagctgctggtgataagttggtaaaggaggacctccttaaaccatttgttaaaccatttgagactgttcctagtacttgttttaagctattttacatgatttttaatgtaataaacacatttataatactaaaaaaagg

SEQ ID NO: 240062 - DNA, 517 bp, Homo sapiens
actatctcttgaacgtgaaaagttattgatgcagtgaggtcgaatgcacacctactgcttcctaagctctggaacatgaatctccttcctctgtcatctccccagaattggaacctccttaatccaaccatctcactattggtcagtctagtgattgagaaataggaaaagccacaggttgaaatgatgaaatgtcattacactgaaagataataccaaagtacaaagtcctaggcacagtcttgtcaattccctcttgtctaagtggtgtggcaaatattattgtcacttttcagagaaaactgaggtgtagagaaataaataaatgaagttttttacagtcattccacaagttactgagcaagtcttagaagccctgactccccaaaccacaaaatctcctttgataatcattgctgccataacaccttcttttactgctttcctccttgaatccagagaacacatatttataatcattttaagagcctgaggaaatgacttcagcctgtgcaaa

SEQ ID NO: 240063 - DNA, 431 bp, Homo sapiens
gctgcagtgagctatgacggtgccactgcactcccacctgtgtgacagagcaaggccctctctgaaagaaaaaaaaaaattgtcctagattaagaaccactgggttatttcaaggactaaagaagttgatttaggccagatgcagttgctcacgcttgtaatcccagcaccttaggccaaggtgggtggatcacgaggtcaggaattagagaccagcctgaccaacatggcgaaaccccgtctctactaaaaatacaaaaattatccaggcatggtgacacacacctgtagtcccagctaccaggaaggctgaggaatgagaattgcttgaacccgggaggcagaggttgcagtgagccgagatcaagccactgcactccagcctgggaaacagagcaagagagagcaagactccacctcaaaaaaaaaaa

SEQ ID NO: 240064 - DNA, 156 bp, Homo sapiens
ctgcaaaacctgcttttcttccttaacccctagcatttttatcctcttagctacagacaggtttccatggcgttggttaaaaattaaggcctattgagaccatagtatttgctttccagtgagtaagaagcaagaactttaggattaaattcagca

SEQ ID NO: 240065 - DNA, 698 bp, Homo sapiens
ctgactctaaaaataaataaataaaataaaataaaacatctacagtgaactctggtgggtaacagggtctttggtccaccgggcagtctgcttaggcagaaatgacctcacagaccgcctgagctcatcctctaccaccagaaactgcaccaggattagcaatttccaaagaatgtagatactcctcacagaagaaacagcaaccaatgtaagaatgcttccctggtgatacaggtactaagtcaggatctaacgtgatctctgatgctccctatgaaaagaatcactgtggaatatcccaaactacagaagagctgtgaggcagaagcacctctggactaatacgatcacaaaccctttgagctgctttttacaaaaatactagttttcagctgcttctttaatttatgctgcatacatgagtaaatatctttttaaattttttaaatgaacttttcaaaagtacacaaaaataaaacagtagaatgaactccatgaacccactggtcaacttcaacagcacatctggcttcttccatgatccccccccaaatacgacacattgtatccacagtttgtattgttcttcaaaaaataaggatttttaataatataaccactaataaagtaggaattgccttaattgcagatgtgcaacccgcagatatgaaggcccaactgcaatgtgacacacgaga

SEQ ID NO: 240066 - DNA, 575 bp, Homo sapiens
cagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagag

SEQ ID NO: 240067 - DNA, 285 bp, Homo sapiens
gatttatcattaatatgaacattattccaattttaatcttatattaaagagttcttagattcattgacatgcttgccaaaatgctaataggtaaggtctattaaaatgcattatcagccttttcatgatctgtgtagtgctgatgaaatatcacatttatgagaaaaatctccagtgctttcaagatccctaggcagctctgtcatattggcatcaactgggctgtgtgcttagtttccttgattattctgaaatccatacattcatacacttagcttgtcatgc

SEQ ID NO: 240068 - DNA, 646 bp, Homo sapiens
tccctagtcagtgtgtgtgttttgaggcagggtcttgctctgtcgcaaaggctggagtgcaatggcacagtcatggctcactgcagccttgatctcctgggctcaagtgatcttccgacctcagacccctgagtagctgagaccacaggaatgtactaccacattcagataattttaaaattttttgtagagatggcatcttgctatattgcccaggctggtcttgaactgctgggctcaagcaatcctcctgcctcagcctcacaaagtattggcattacaggtgtgagctactatgtttggccgtgtgtgtgctttctaatgcctattgaaggtgtgttttaagtgcttatggcagatgtctgccatgcaatctaaatggcaaaccaatcagctggatcagtcttacttacaacacacctggcctgtccctcaacttttctattctttcaccaaaatggaagttccttatgttagagaacttacagagaaaaggaagacaaaggaaatgattaggttcagtgcttagaacttcatataatgagatacaaaatctcattactgacccactctgccagctagaagagcacttgtagatcatggacatttaggtggggatatagccacctttgatcctttctgttca

SEQ ID NO: 240069 - DNA, 462 bp, Homo sapiens
gtagtaaagccacaatgaatgtgtgtagaacattaaaaaaaattaagatttctttaaataactgtttggtaataagtgagaagactttttttcctgtaatttttcttcgatttttttttctttagtaacagaaaaaatgttgatctaggcaactcaggcaacaaagtgatgtcctcttccccaccccacaacctccaagtgtcccttcaatattacctcaacttgttgtttgctttgtctgtgggattgtgagcatttgtcctttctatttaaggttatgtgtgatgattttcttctatgaaaaaaaaaaagcttctcgcaagaaatggtttgctgaagctggtgaaatggactggttttgttgacaaatagtcttggtctgaattgctgacatttctcagccttttgctgggttgcacaacattgtgcaactttatgtggaaataaatgagtttattagca

SEQ ID NO: 240070 - DNA, 1398 bp, Homo sapiens
tgaacaaataattcaaaatgaaactaagaaaacaattttatttatttataatagcattagaacaaaatacttatggataaattgaaccaaagaaatgcaaaacttacactccaaaaacttaaataattgttgaaagaaattaaagaataagtaaatggaaagaatccaatgtttatggtctggaaaagttaatattattaagatggaagtagtcctaaattgatttacagattgaatgcagtccctatcagaatttcaggtagcttctttacgtaaattgacaagtgaatcttgaaattcatatggatgttcaagggacttagaatcacgaaaacaatcttgaaaaagaacagtgttataggactcacagttcttcaatttgaaaacttactgcaaagctacagtaatcaagaaagtaaaatactggtgtaaaaagagacataggttgatggaatatagctgaagttccagaaataaaccctcacatgtatgtatggtcagttgcctttcagtgtgaagaccatttaagatagtcttttcggccgggtgcagtggctcacgcctgtaatcccagcactttgggaggccgaggcgggcggatcacgaggtcaggagatcgagaccatcctggctaacacggtgaaaccccatctctactaaaaaaatacaaaaaaattagccaggcgtggtggcgggtacctgtagtcccagctagtcgggaggctgaggcaggagaatggcgtgaacccaggaggcggagcttgcagtgagccaagattgcgccactgcactccagcctgggcaacagagtgactctgtctcaaaaaaaagaatagtcttttcaacacgtgctgggacaacaggctagcaataataaaaagaatgaaattggatacttcctcaaatcatacatagaaatgaactaaaaatgggtcataaacctaaatgtaagagctaaaactataaagcacttagaagaaaacataggagtaaatcttcatgactccgtgttagttaggcaaggccttcaaaaaaagcaacaaaagcacaatcaacaaaagaaaaagtagataagttggatttagtcaaaagaaagaacttctgaaatttaaaccatcaaaaaagtgaaaggtcaatcgacagattgggaggagatatttgcaaatcatatcttaaaaaggatttgtacccagactatgtaaagtactcttacaactcagtaataaaaaggcaacccatttttaaaatgagcaaaggctgtaaatcagtagttcttcaaataaaatgttcaaatggccaaaagctcatgaaaaatgctcaacagcactagctgtcaaggatatgcaaatcaaaaccacaaggaaataacacttcatacttactaggatggctataata

SEQ ID NO: 240071 - DNA, 450 bp, Homo sapiens
tccagctactcaggagactgaggcaggaggattgtttgagctcaggggttcgaggctatgtagtacataatcacacctatgactagccactgcattccagcctgggtaacatagcgagcccctgtctcttaaaaaacaaaagatgtggccaggcatggtggctcacacctgtaatcccagcactttgggaggctgaggtgggcggatcacttgaggtcaggggttcaagaccagcctggacaacatggtaaaaccctgtatctacaaaaatacaaaaaaaaaaaaacacaaaaaaattagccaggcatgtggtggtggcaggcgcctgtaatcccagctacttgggaggctgagccaagataattgcttgtacccaggaggcagaggttgcaatgagctgagattgcgccactgcactccagcctgggtgacagagtgagactctgtctc

SEQ ID NO: 240072 - DNA, 215 bp, Homo sapiens
cattagaagaggtaaagcttagtaatggattacctgctttttcatatgaaaataaattttaataaaatgagagtgcagagtaaaattcctgaacttgaattattataatattctaagttgtaatttgtttagtattttttatttcaaagttacattctatttcaaagggagagaaaataattttcaaataaatatactttaagtttcttcattta

SEQ ID NO: 240073 - DNA, 909 bp, Homo sapiens
ggaagttggaagactagcaaatgggccaatttgaagggagcataaagtcaggagatgagaatagtagggtggtgggaaggataggttttgaggccattaaatataagttgaaaaatggggccccactttcataggcccaatagtgcttcaaaagggaaatattggtgggttttgcttttcaacaagaacttaatataactagttgtgttttatagagataagcctggaaggggggattggaggagagcaatggttctctgtacattagaatctcctggagggctggtgtctgagtggcaccaccaaagattctgattcagctgttctggatcagaatctacagctcacacctgtaatcccagcactgttggaggcctaagccagaagattgcttgagcccaggagttggtgacaggcctgggcaacatagcaagatcccacctctacaaaatgaataaataaataaataaataaataaaaaacaaaatttgagttggtaatttataaactatggtgtctacctaccagagatttttcgttataattaaaatgtgatatggaataatgtattgtttggcaagctggcttcagggttcccaggtaaatagataaataaggaagtgcataatgtaagaacagtggctgacagtagcagtggcattttttatttttaagagcagacatggggtaactggttaaggtattgcagtaggtcagagaggataacagggacccaaactctggaaccccagggatgagggagaagtcaaaggtgctaccagagtttgtgccacagctccactgtcccatggttgtagtttcatctactgataaagcagtgcaaagaggaagcgtgtggtggctgagatgggagtgagatttgaggaaagaacgcttatgggtaggaaa

SEQ ID NO: 240074 - DNA, 343 bp, Homo sapiens
aaaatcagtcttccatatatgtgtgggtctgtttgtggattttccattctgttccattaatctatttgtcctgataccaataccatattgtgttgaccttctgtggccttaataataattaatgcaatcaggtagtcttaattctacaactttcctcttattcaaagtttttataactactctaggtcttttgcattttcatatgaattttcaaatcagttcgctaatttcttcaataaagtttgctaggatgttgattggggttgtgttgaatatatagataatttcagaagaattgatactttaactgtattgatttttggacccgtgcacatatatctat

SEQ ID NO: 240075 - DNA, 223 bp, Homo sapiens
tttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgattgtttattacagtaaaatttct

SEQ ID NO: 240076 - DNA, 360 bp, Homo sapiens
tcatagcagtaaatagtgaatattgagcacttagtactactttttaagcactttacatgcactgtacatgggtattataatagcttagtctttataatctttaaaatatgaggttaaagagaattttagagctgaggtaataaagacatagaaatgaagtaatattccaaggctaagcagcaaagggcagagttcacacccctgactattatattaattgactgctagtaccgtaacttctaattgctacagtaactggtttctgccgtttgtttctttctgtttgctgtgtatacacaaagatgaaatggtctggttccttcctactttcagcttcatcacacttcactgaaaaaggtc

SEQ ID NO: 240077 - DNA, 442 bp, Homo sapiens
ggcagactgaagccaacagtgtgtgagggtattgagcctgatatgtaaactattttgatgtcacttgtcaaaaatagccatctgtactctgatatcctgtaaggggaatgactttggttataaggttataaaaattaggagtatggctgggcgcagtggctcacgcttataatctcagcactttgggaggccgaggcgggtggatcacctgaggtcaggagttcgcgactagcctggccaagatggtaaaaccacgtctctactaataatacaaaaattagctgggcgtggtggcacatgcctgtaatctcagctacttgggaggctgaggcaggagaatcacttgaacccgggaggcagaggttgtggtgagccgagattgggccactgcactccagcctgggtgataagagtgaaactctgtctcaaaaaaaaagaaaag

SEQ ID NO: 240078 - DNA, 363 bp, Homo sapiens
tgaaagaatttaaaattaagagaaacttaaaatatacatatacaataattttgtaataaatttatataaacaaccaacttgtaacataaagcatggtgacctttgtttttataaataggaagcaaagctctgttgagtccagagaagaaatgatgaggaactggcatttgaggtggatctgaaataatgtgtaagatttggacagatggagaagtcaacaagtcacatggtgacctatattatgaagttagcagaatctgaggattgggagctgaccaagaatgtggagtgggttgttaagttagcagagaatatgactaaaatagagaaagaagaattaaagagctatgctgcactgaatat

SEQ ID NO: 240079 - DNA, 591 bp, Homo sapiens
  misc_feature (354)..(354): n is a, c, g, or t
cttttctgtttgttggccagtccccccttagatcatgtgtttttataaaatgtcacttgggtttcttgttgaaagaccaggaggtgacacagctatattatttgctgtctgagctcttctgaactgaagaagagatgcacagtgggcattcactgatagacgctggaagaaatgacatgattaatcactgatcttgatgtgcatctgttatttatgatttgtgggttgaaaagctagcagtaaagtttgcattttatgcagttacagttaatataccatggttgttgaaatttgaaccatgttgttgagagactggtgtctttaagctaagctaactgaaatcagagcatattngagcagagcaaaagaaggaccgtctctacttccatttccccttcttagccattgtgctattattctcaaggagaaggagggaatcattttatttctacatatgttataaatcttacaatatgttgttattatttttgctttgaactatacctttaaagagatctgaatagaaacaagaaaagtctttatatttactcacataattactatttctgcaacatagacctcatctctact

SEQ ID NO: 240080 - DNA, 476 bp, Homo sapiens
cggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgc

SEQ ID NO: 240081 - DNA, 734 bp, Homo sapiens
aagtgatcctaaaaattttcaggaaaaacatctaacaatttaaccataaagagctttggtgaagtctgacacccagtatttagctcttttgctattattcttttttttttttttttttttttttaagatggagtctcactctgtcgcccaggctggagtatagtggtgcgatctcggctcactgcaacctccacctcccaggttcaagcaaattctcttgcctcagcctctcaagtagctgggattacaggcccaggccaccacgcccagctaatttttgtattttgtagtagagaccgggttttgccatgttggccaggctggtctcaaactcctgacctcaggtgatccactcgcctcagcctcccaaagtgctgggattacaggcgtgaaccactgggcccagacttgttttgctattattctttaataactgtttgcaaactacaaatattgaaaggtgagcatatgtacaaagacaaaattaactagtagtctgagctgaaatattgtagcttaattctagtctatcaattttgatctgaaataataactctgagggcagttttgtcaccatcagcactcattccaatattcaaaaggaaaatttttgtttaatttatataacatcttacttatagatgctttacttatagaaagcacctatcaattataattagcaaaacaggagtcaagggcattgttttattgtgttacatgtcaaggaaaggaga

SEQ ID NO: 240082 - DNA, 383 bp, Homo sapiens
tgcatgttaattcttccataaattatatagtacaggataaatgtgtcaatactgctttcattaaataattttaaaattcatttgccaatgcaaaaaacaaagatcttttttaaagaaaaaaaagttatgcaaagaacaaaatccattttccaataaagatgttaagaccacagtgaggaaacaaaaaatattaaaattatttgtcaatgaaaatctggtattcactatatttttctgttaatatgaatgtctcagcatcagttttgttggctcacaatatattcatgcaatttcacaggatgtggcctacaagttaacttttattttttaccaatgaagaaaagacagaaatctaatattaaataaagaaattcgtactaata

SEQ ID NO: 240083 - DNA, 385 bp, Homo sapiens
tcaaagcaaatctagaaaatattcttagaatatggagtcggatgttgttttctacgggccataccattactacttattttataagccattttatcttaacaattttctgaagttttttaatgtttccattcccactaacaatttcatgtcttgtaaactgttcaaaccagtaatatatgtactattttgtatctttgctaatatcacttagaaaaaattagaacctgataagctcaagtttcataaataatgtaaacacaagataaaatgtcacagtgccaggctgagacaggagaatggcgcgaacctgggaggcggagcttgcagtgagccgagatcgcaccactgcactccagcctggatgacagagcgagactctgtctca

SEQ ID NO: 240084 - DNA, 1393 bp, Homo sapiens
tatgcatgttttttgacagttgtagtcagaaagcagaattaagtttggggattagatcataatcccaaaacatacaatcacaaatgttgaaatcctgacatccaaattctggggaagtgattagtgtgttttgggttgcatgcaggatagttgcatcatgtcagttgtatcatgttaggcacaactattaccatgttattgtctttatttggaaattaaatatggcttaaggagatgcgtatgagtgccaagctgacaaggggtggacttgtggacctaattttaggtatcagcttgaccagattaaggaatatcagaaacctggtaaaacattgttttgttttacacattgagggtgtgtctatgagagtgtttccagaagagattagtgtataaatctgagtgtactaggtggagactatctgccctcaatgttggcgggcaccatccaatcagccagtggccaggagagaacaaatacttaagacaaaatgggctgggatcggtggctcatgcctgtaatcctagcactttggaaggtcgaggtgggtggatgacctgaggtcaggagttcgagaccagcctgaccaacatggcaaaaccctgtctctgctaaaaatacaaaaattagccaggcgtggtggtgcacacctgtggtcccggctacttgggaggctgagacaggagaattgcttgaacccaagaggcagaggtcgcagcagtgagccgagatcacgccactgtattcagcctgggtgataagctgagactctgtctcaaaaaaaaaaaaaaaaacaaaaaaaaacaaaaaacaaaaaaacgcaaaatagcaaaacggactctctgggttctgctgcttggatatcagaaatctgactccatgaaagtgcattatcacaatactgactttgtgtataagcattgagtgtgtacataaaatgttgaaacttcctcgataaatgagatatccttttcgtacatctgcatttgtgaaagataaaatttcttgagatctcagctctttgggtgactgcatatgcagtggtgacccagcacagtttccatcaatctcatcaaaagacttgaggttgttgggcacagtatttcagatgaccagagttaaaaagctgggtatacacaattaacaaccaaagtgatatgcatttatacctttccctttatgaccaatttctttataaatatggctcatctgctcataactgttagacccacccaaatgttattagtaacctgagtgtttatgcttgcaaaaatgtatgttattattgtctgttttattatattaagtggtgtataaagtattctgttgtgtttttatgtttctcaaataagttcccctttaaaaaataaatatctttaagtttttaaaact

SEQ ID NO: 240085 - DNA, 2291 bp, Homo sapiens
cttatctcccttgatcttgtacttcccagtctccagaaccataagagatgaatttctgttgtttctaagtcacctacctacattatggtattttgctagaacagctcaaacgaactaagacatatataatggacttatgtaatccatcgcctattactaggtattttgatttatagtttatttgtcctctgttatatcagcactgctgtgaacttcatctgtaccaaaatatttccatacagtctcaatgacttgtttgggataattttttgaataatatcaaagtgtgacatttgaataagagaagaggcacagtgttccaagagctagaaggtgaaggtaagccttgcttccatcctgcgatgtagcttcgtgtctgtgaatagcaagcaacttcagatgaataagctatcaacatactggaactcggtggtgcagcttccttgtggggatgactcttaggaatcatctggattttctgaagaaaacaaatcatttgggttctggccttcattgccctgcccagcgggagtccccgaagggctgtgctagaatttcagagcatggttggcacagcgttggtgaaggttacaggattgtctagacaaaagggcccaggggaggcacagaggctctgttagtgggtggaagggatgatgctgtgtgtatgtattgagccacaccctggatttcagtaggagccagaataattctgaggcttgggtgtgggcagctgtgctaaacagggaactcagggtggtttcaagccagtacagagctaggacctgggatctaagattggagcagacacacatggagaagcagatagcggaatcaggatcagctgtctgagtgggaaggtcttagagaacccttgctaggtgttcaccaggaagatgcccacacctgtacactggatgggggtgcatgttcctgggccaggagggaccacgctgggtgttctgcttgctgagacagtggtttgggtggaggttcccattcctggaatgcctagaactttgctgcttggcccagtatgttctgggctcccccatttaaggcaactatgaccactttcattgccaccacctcctcctagcttgaaacaacctcccctgctttgctctatctgtgccacaattaaggagcttcccattttcttcattatattgcgggtagttatatgtgtatcttaggaaaagtagtatggtgtgaggaaagcacccaaggactttgagtccactgcctcttcacttaatgttctggctcctccaattgctgcatcacccttgggtaagctaattaacttctctgagcctgagcatccgcatttattaaacagggattagatacttacctcgcagggtggttgtaaggattagaagtaatgacatataaagcacccctcccacaatttagtgtctggccagatggtgggtgttgagattgtccgttattactgaggacttaatgtggtctagtctgtaagggttgacagatcattgtggcagatcccagacatgcttattatgttagcagtaggggccctgaggtcaaaaggcttaggacagctatcctgcctcccagacctgggaggaaaagagagagaaagaggggctccagggcagttgtcagagttaggaaggtgctgagtcgccacaggcatcagaggaggattttctgaatgggtacagtgaggacccagtggtgctctctcctcaaacctacctgttgggaaccagatcagcccagcaggctggtagcagagccatggcctgggaacctgggtcagcctcactgtcttagctccagactcacccactccctttgcaatgctgtgctgtgtagtggtaaagcctgcacacgctaggtcccattcctgcgccattcttcctgcttgtgtgacctcaggcaagccccaaacagccttgtgactcaatgttctcatctgtacaatagggattatggcacctatcgcatagggtccttgtgaggatcaaatgtttatttatgaaaagcatttagagactgggcacggtggctcacgcctgtaatcccagcactttcggaggctgagtcaggtggatcacttgaggttaggagtttaagaccagcctgaccaacattgtgaaaccctgtctctggccaggtgtggtggcacgcacctgtagtcccagctatttgggaggctgagtcaggagaatcacttgaacccgggaggccaaggttgcagtgagccgagatcgcaccattgcactccagcctgggtgacgaaagcaaaactccatctc

SEQ ID NO: 240086 - DNA, 506 bp, Homo sapiens
atcattctgtcaacatcatagagtgtacctacaaaaacctaaaggggatagcctactacccacctaggctatacagtgtagcctattccttctagactacaaacctatactggcaagttacaatactcaatacagtaggtaattgtaacacaatacgtatttgtgtatctaaacatagacaacatagataaaactataatcttatgggaccattgtcatatatgcagtctgtcattgaccgaaatgtcattatgcggtagatgacagtactgctttttagatgctgctttttttcctgtttgtattctgctctaaccttcctaaatctcataaaattcaaagtacacagaatggtttctaagtactaacttttaaatttttcaagtaaatgaatctgtttggctaggtaccatcccttcggttcattcaggttggcttatttctgccaccaattctcaaattcttattttcctgttctttcctgaagtgccccgccacactcctgt

SEQ ID NO: 240087 - DNA, 200 bp, Homo sapiens
tttttttgagatggcgtctcattctgtcacccagtctggagtgcagtggtgcgatcttggctcactgtaacctctttcttaatctttttctctttctctcattagcacctggggctgatggcttatgaggaaattgttatagtcttttagtaggtaagttttgtccctatagtccccttctgtcgtcttgctttcttttt

SEQ ID NO: 240088 - DNA, 442 bp, Homo sapiens
cagtgtataggagtgcttattcctcacactcataccagccctgggtgttactaacctttatatatttgccagtatcatattcagacatagtatcttgttttaatatgtttctctgattactgatgaagttaagcaaattttcacgtgtttattggccatctgtctttcttttttcatcctttctttcaagatgggagtctttgccatgttgcccaggctggactcgaactcctgggctcaaatgatcttcctgcctcagcctcctgagtagctgggactataggcgtgagccaccatggctggcttgcccatttgtatttcttatgtgagtattttttctttttttttgaagtggagtctcactccatcccccagagtggagtgcagtgagtcaagattgtgccagtacactccagcctgggcgacgaagcaagactgtcta

SEQ ID NO: 240089 - DNA, 244 bp, Homo sapiens
cagatccttaatattgtgtgattttccaaccttaacatgtctttctgaaattgtctattaaagcagaggaaatacctgccaaaggaagtatgtattgcattaatcaggacataactaatattctcctgttcagaataatacttatttatgtgtgaaagcaacagggatgtgatccccaacacagaattttcatgaccttctattgtatacaaataagtacataacagttacttggttagacatt

SEQ ID NO: 240090 - DNA, 276 bp, Homo sapiens
ataaagtattttataaagtgtattttcctatcaccttctcaaagaaagtaggtggaacttgagcttgccaaatcttctcagttccttagtgtaattaccaaagtacattgtttttgagtccagagtagtagtatacaaagttgttagtgtctgagaccagagctttagaccactttcccaggccctctggcatccaactggtaatcacattataaaagatggataaaagacttaattgattgagcatgaaaacttctcttgaagtacaaattctaa

SEQ ID NO: 240091 - DNA, 1704 bp, Homo sapiens
gtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatggtggcacatgcctgtaatcctagctactcaggaggctgaagcataagaatcgcttgaacctgggaggcggaggttgcagtgagcagagattgcaccactgcacttcagcctgaatgacagagagagactctgtctc

SEQ ID NO: 240092 - DNA, 1403 bp, Homo sapiens
  misc_feature (580)..(580): n is a, c, g, or t
  misc_feature (646)..(646): n is a, c, g, or t
  misc_feature (770)..(770): n is a, c, g, or t
gtttgccctaagcagttcccaacttgacttttccctttaccttaagtgattttggggccccaagttattttcctttcacagcctactttcttccttccagaagtgactgtggacaattccacagggtttggacttgatcagggcagaaggtgaagctgcaaggtattagatgtgggaatggagaaaaatacaggctggagctgtgggtttgagtgttgtcctcataggaggtgatggctgaggggtaggtaagtgagaggatgagatccccgaggccgacagcacagagtgacaggagcatagggcaggactttgggtcacccaaggagacagtgatgcttttgaagaagtcagaggaggccccatcagcaatcagaggattgctctgattggcacctcagagctggaggacatcaaaaaataccgctgtaagaaagagacctggaaaagtctttagagattgtctatcccaccctacccatttgacacatgagaagatggaggccaagagatcactgagaaaataaatggtagagcttgggcaaaatcagtgctgcccaaaatggtgtttttccaacanagacatttaaaaggttccttccacaaggatcaaacaccttggggttttgatttttatcttaaaaanttatataaatttagccttctacaggccaggcacggtggctcacacctataatcccagcactttgggaggctgaggtgggtggatcatgaggtcaggagatcaaaaggatcctggctgatatggngaaaccccatctctactaaaaatacaaaaattagctgggcgtggtggtgggcgcatgtaatcccagctactcaggaggctgaggcaggagaattacttgaacctgggaggcagaggttgcagtgaaccgagatcgcgccattgcactccagtctggcgacagagcgagactccgtctctaaataaataaataaataaatttagccttctactcaagaacttatctggctttgtcttaatgtaaaaataatttctttttgctaaattattgagagaaatttactatttattagtgtttatcagttttctttaaactcaccactttttgatgaatatgaaaatctaaaaacttggccgggcgcagtggctcacacctgtaatctcagcactttgggaggccaaggtgggcggatcatctgaggtcaggagttcaagatcagcctgaccaacatggtgaaaccccttctctactaaaaatacaaaaattagctgggcgtggtggtgggtgcctgtaattgtagctactcgggaggctgaggcatgagaatcacttgaacccagaaagcagaggttgcagtgagctgagatggtgccactgcactccagcctgggcgacagagtgagactctgtcct

SEQ ID NO: 240093 - DNA, 570 bp, Homo sapiens
actactggcctcccaaaatgctgggattacagacatgagccaccttgcccagccaacattttcttaaaacctaaacatatactacaatatgacctggtagttgcacctctggacacttatcccaaagcaatgaaaacttaggtctgcacagaaacccttacataattgttcatagcagctttatttgcaatagtggaaaactggaaagagcccagatgtccttcaacaggtgagttgttaaacaagccagtacatccacaccatggaatactactcagcaacaagaaggaataaactcttgataaacccaacaacttggatggatctcaagggcattatgctgagtgaaaaagcccattttgacctaaagggtgtaattgcctttatataacattcttgaaaggacaaaatttttggagaccagattagtggttgccaggaattagggatggtagggagaagagggtgtaggtgtgactataaaggcattgctcaagggagatctttgaccacagttgtggtcaccctgatctacctacgtgatgaaatgacattgaactatacacacta

SEQ ID NO: 240094 - DNA, 259 bp, Homo sapiens
gagacggagtctcgctctgtcgcccaggcgggactgcggactgcagtggcgcaatctcggctcactgcaagctccgcttcccgggttcacgccattctcctgcctcagcctcccgagtagctgggactacaggcccatgttcttgattgggtatgaggactggctaaccctctctgaccactgatgttgaaatcagacgtgtaagttcaaatcctttatgaagaactcctgaccttgagcgaatcccttcacatctctg

SEQ ID NO: 240095 - DNA, 1944 bp, Homo sapiens
  misc_feature (5)..(5): n is a, c, g, or t
  misc_feature (8)..(8): n is a, c, g, or t
  misc_feature (480)..(480): n is a, c, g, or t
  misc_feature (829)..(829): n is a, c, g, or t
  misc_feature (1048)..(1048): n is a, c, g, or t
caccnaanacacaggcatgaaatacactcatgggcttgtccacatgcacacctgccacaaacacccatcataagcctccaggtaaacaatatgggcatgcgcacttatacacacacttgcacacacatacacatttttggaggcttgaatgcacacccacgcccaacacacaccccctcaggcaggcacacatgggtcccctaaacatggactcagtcttcctacaggagaatttctattctgagcaaacacccagcatctgcagtcaatggcaaacagatgaatgggacaaaattcactcatgtgtcctggtggccctaccaatacagccctgaaggagcaggcagcaggcttatcccttcaccagcaggccttcagaagggcaagaccagggtggggatcaggtttggccaggagaacactcagagcttctgggtactgactcaaagccaggggccgacagccttgtgcattcctganaagtaggtcaccatgacaaggagcactggctcacatgctgggacctacggtgactggaaaagacttggggaaaatccagctgttgtgagacagccagtgttagtaggtgctgccttcccataccagtgagttaggttgggtctatgcagcaccggagctatggagtgtgtgtcagcggcaagggctcctgctcagcacagcaaagactaggagaagaagagggcagtggcttaccagggactgtagcgctgggaaggacgggtgaggcaggggacacattatgaatagtgttattttttagcacaccagtgtgttaggcactgtgctgggtgtttttcatgtattatcntgcaagatacagccctgcaagttagattttattgcctccattttacagatgaggagactgaggctcagagggcttaaataaattactctaggtcttcagctaataggggcagagctcagatatgagtcaaggcttgtctgactccagatctcagactttctcaacatcttcatgttgaagctaaaacttgcattttaaactatcaaaagcaagaggganctaaggagacatggcaactaaaggtactgtggtatcccggatgggatcctgggacagaaaataaacatgaactttagttaatgacaattttaattgtgatacatgtactttactaatgcaaaagtgttaataatagaggaaactgggtgcagggtatacaggaactatttatactatcttaatgattcttcaaatctaaaactgtcctaaaataaaagacttattttttaaactttgcatttttgccagcagcaggaagcagtagataaccaacattccaaggtgcagcctgtgtataaggcctgaagaggccagggcccctggaaagtttctcaaaataagaggccattctggactttgtaccactgagttcccatcacctacataacttgaaatagagacattaattgcagggctgtgatcacagccaacaccaccttcctaaatggggcaaaagggcgctgaagtcgggcagagcagctgcaaactggcatgaattcccaaggctgtgacagagaattcttgctgggtgtgcctgtacctccctgacaatgtggcctggccaagctgacgtccctccattttctcaactgttgccactagaatgtagtaggaacaatgtataagtcttatacttcttttattaaatttattcttagatatcttattcttagtaatactactataaatgtagttgctttcttgatttcattttctgatattttatttctagtacatgaaaataaaattcatttttgtatattgatcttatgttttgtcaccttgctgagcttgcttatcagtcctaacagttttttagtggattccttaggattttctatatactgcaagattatggcatctacaaataaagatagtttaagttctttctttcc

SEQ ID NO: 240096 - DNA, 747 bp, Homo sapiens
ggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgca

SEQ ID NO: 240097 - DNA, 617 bp, Homo sapiens
ctggtgaagcctttggggtctttctcaaaataatgttttaaaatttatgaaataaactacatgtgattacaaaggaaactacttatattgaaatatacttagaatattaataaaaaacaaacatgctgcagtaatatatgtacttctctattaacacatcaaataacattatatagtaacaaggttcttcaactacagtaagtttgaagtaatgacggacaaccatttcaggatatctgcaacaaatgtaattggatatgaaaatatctgtgatttttaattgtgaaagtcacgggtactgctgctctactgtgggttttttgtttgtttgttttttgagacaaagtcttgctctgtcacccagcctggaatgcagtggcgcgatcttggctcaccccaacctttgcttcttcaggtataagcgaatctcctgcctcagcctcttgagtagctgggattacgtgtgtctggcaccatacctagataattttgtatttttagtagagacagggtttctccaggttggtcaggctgtcttgaactcccgacctcaggcgatctgcccgcctcagcctcctaaagtgctgggattacaggtgtgagccaccacacctggc

SEQ ID NO: 240098 - DNA, 403 bp, Homo sapiens
aaaaatatttcttgataattatggcatgctcttttttagtcaatcaagtaagaaacttttgaagagacatatagttaacagtttgtgggaagggagttctgaaaggaggcatttggggtgactttttaagtaggtttgcctgacattgctctactttgtgaaatgaccaacttaaattaatgtatacttttagcccccgaacctagtattccttattacttgtaattcaaaggaattgtgctgttttactttgcatgctttctttaattacaaaattgtctacagtatcttatatatagttgttataatttttacatatttttttccatcttgaaaatgattttgttttcatagtagtgtttagcattcagtattttactgtaataaagtgtgatatgctata

SEQ ID NO: 240099 - DNA, 494 bp, Homo sapiens
ctactcttccagagtgaggggccctcttcatttgtagccagttggcagagtgtgattctggcaccgggcttggaactgacatcacccataaccttacctaacatggggaccctgccgttcaccagtaagagatgtgccaggaactttacactcattattgaattctcacagcaactaagagtgacttgcatttgccgtatgtagaaataggctgataaagaaagggacttgcccaaggttacagagcaagtaaatgcggggtgtaggacctgaactactgcccaaattcaagtcctgtattttatccaactataaaagacttcccaaatgattcatttatatttatagggtactttactgtttaccaagcacttttatttcatacacattttctgattccttgaaaatctccacacaatatattttaaacatagtcacccaaacttgtgtgtgtgagttggcacacaccctaataataaaaatcaccatctttt

SEQ ID NO: 240100 - DNA, 379 bp, Homo sapiens
ggcgtgatctggctcactgcaacctctgcctcctgggctcaagcgattctcctcactttgtttttgtattttgtagagatgtggttttgccatgttgcccaggctgggctcgaactcctgagctcaaatgatccgcctgccttggcctcccaaagtgctgtgattataggtgtgagccactgcgcccagccatgcctaaaatatttctaattaccactttcaataaataagaaatgaaccataaaggataaatgagattttacaaaattcaatcatttaaggacaaatttgagttctgaatacaattttcatacaaatagtgtttttgcaaataatggccagctccatgttattagtacattgcattaacaggcttttg

SEQ ID NO: 240101 - DNA, 1718 bp, Homo sapiens
  misc_feature (115)..(115): n is a, c, g, or t
  misc_feature (565)..(565): n is a, c, g, or t
  misc_feature (725)..(725): n is a, c, g, or t
  misc_feature (1000)..(1000): n is a, c, g, or t
  misc_feature (1015)..(1015): n is a, c, g, or t
aaagattatattattttgtttccatatatggtatagtaaatgtgtcaaagatagaagcaaagtgttagaaatccagaggaagaactaacaaattttaatagttttctatttttgngtatattaagcaagataaaacagactttttactgcgaactgcgatacatgtaaggctaatgcgtgattaagaatggcatagggaagcatctgtacctggtcttggctttcttgtgacttcatcttcctcagctctgtccttcatatctaggatgcctggacattagcagcagttaagtcttaggagctaaaatcaagtagaagtactctaaggagaatcctgtaagcgaagctaagaaacctgctcttacttccttaggtggactggttgtagcattctaataatccttatacctaggatgctgttgatcatctcttcagccatttaaagtcctttttgcttctctcttagtattctgaatcttcccctgagtaccaaccagaacccagccatagatggggaaggcagaagaagacaagaagggagaattaagctacagtagaaagatcntagggttctggagtcagacctcagtccaaatcctacttccgccacttcggacaagtgacttaatcagtcttcagagtgaacatgaagtatctaataaagggtctgaacatagtgatacggtttttttttttacttaatattacttccctcttctctcagncattttcactatgtaaatagtagagcattctttagtctctgccactgatctaccttaccacaactagtctgctgaacctcaaaaattaaatggatctaagcggggtgtggtggttgcacctgtagcaccagctacttaggaggcagaggcaggaggatcacttgtccaggattttggggctgtaaagtgccgtttgtgcttgttaatagccactgcactccagcctgggcaatatagcaagaccccatctctgaaaaaaaaacagatctatattnaagatctgcaaactnttcccgtaaagaatcagatagtaaatattttaagattcgctggccctacagtctgtgtcatcactactcaactctcttggtgaagggcaaaagcagctgtggaatgatatgcagaccaatgagtgtggctatgttccaatataattatttagaaaaacaggtggtgggctagatttggccccacactatagtttaacctctaatctttgtctttaaccattaaaggtagttccattttgagatttcatagtcaaaatacagcccccttaaaaaaaataaactaactgaaaaagacctcattatgagttggacagtgaatggagttacaagatgatgtttcccaaaattgatgacatatattgtggaggagaatggtactataaattaaagatcaggtcccaccaaaagaactcacatgaacagtggtcaaaagccgggtgtggtggctcacgcctgtaatcccagtactttgggaggctgaggcaggtggttcacttgagtccaggagttggagaccagcctggccaacacagtgaaatcctgtctctactgaaaattagctgggcgtggtggtgcatgcctgtaatccaagctacttgggaggctgaggcaggtgaatcacttgagcccaggaagcagaggttgcagtgagctgagatcacaccactgcactccagcaggggcaacagagcaagactgtctc

SEQ ID NO: 240102 - DNA, 2116 bp, Homo sapiens
  misc_feature (620)..(620): n is a, c, g, or t
  misc_feature (801)..(801): n is a, c, g, or t
  misc_feature (1105)..(1105): n is a, c, g, or t
  misc_feature (1615)..(1615): n is a, c, g, or t
acgcaatggaattctactcagcattaaaaaggaatgaatcactgatgcaggcagcaacaaggaagaatcccaaatagccaaggccacagcctagaaacttctccttggaggctaagcctgcagcacccagctgagcacagaggacaatctgaggagctaagtgaccggctggacactccattcacagaagaaaggccatgtgaagataagatgagaagacagccatctaccagccaggaagagaggcttcaccagacaccaaccctaaaggcaccttgaccttggacttccagcttccaggactgtgagaacgcaaatgtctgtggtttaggccatccagtctgtgataccttgttatggcagtccaagccccagtgaagtcagacagtccggctgggttctaatctctactctatattacaggagttatacggccttgggaaagtcacttaactgctctgaaccttaactttcttatctgttgaaagggcccgcttcacagggctgctgtgaagatggaatgccctatggcagggaccctgcatagtgtccagcacagagggcaccacagagggctcaacaaccacatgggccctctgaaagacttattcattaaaaanatgaccactctgcactttgggaggccgaggcgggtgggcagatcacctgaggtcaggagttcgagacaagcttggccaacgtggtgaaaccctgtctctactaaaaatacaaaaattaactgggcatggtggtgggtgcctgtagtcccagctactcaggaggctgaggtgggaggattgnttgaacctgggaggccgaggttgcagtgagccgagattgcgcactccagcctgggtgacagagtaagactctgtctaaaaaaaaaaaaattactctcctctcaaagacttacaatctctgaagacagagcaggcctgcaattgtaattgtgagtaatagggccccaagaggtgtttttctaaactctgcttgcagttagtcgcattcccagagggacatttggcgttgatgcatcccgtggcatattcctttgtgaaatgtttggctttgtcttaaaaccacatcatgctccaaagtggagccncgctctcatgtttgcaacttagttaccagaagcgctcacaacctgaccttttagaccatgtgtgtcctttctccaaactaaaacagcctaagctctattctgtaactgaaaacaagaagccaatcttggctgtccattctgtgagtcagatgctgccaggcttagtggcagcaccaggggccgctgcgtagtgaaggtcctcctcgcagcagtgtgctccagcagccaggaacgatgtcctgtgtggctttgcactcaggaggagaacattcggggcattttcttatcaaagagcacttcgcagcactgtcctgctctcctggactctgtagggcatggggcaagggtggaaatgtggagggcagggaaggatgcacaggctggtttggggcctctgctctctgggctcaccagcctctgagctctccaccctgcactccccgccgccaggcttctcaaggcctgtccctgcctcccagggcagggcagttccccagggtctgttgattngacagtaaatgcaaaactcctctgctttcttcctgtggaggagccatctcttggccaccggaacacaggaatatttgttgagtgaagggaacacgatgcagagtccaaaggggtgattcagacctgggtttcagtcctacccatgcccacagttccccagttccctgttttctctgggggagctcccggcaactgccgcaatgaggcaactgggaaatccctttgttggctgggcaaggtggctcacacccagcactttgggaggccaaggctagtggattgctttgagctcaggaattcgagaccagcctgggcaacatggcaaaaccctctccctacaaaaatacaaaaattagctgggtgtggtggcatgcacctgtggtcccagctacttgggagactgaggctggaagatcgcttgaacccaggaggcagaggtcaccgtgagctgagatcgtgccactggactccagcctgggtgacagagtgagaccctgtctg

SEQ ID NO: 240103 - DNA, 1016 bp, Homo sapiens
aaatccaaaatattgttctgtttctcatagagggctcattctcatttctacagtcaagtatgttgatgctcatttacttatgcaattaagccagatataaaaatgtaggtgcaagtataaacctgttagccgcccttaagtttgttatctaggcctctgaaatcctattggctcactttaatatttttcctatgcttttactgtttgcctctggacaagttctggcagtgaattttatgtttggtcttctgatcttcaactatcaaagggaagagatgaaaaagatggacaatcttttcaaaactgttagcagtaggcaattctgtttaagaatgagcagtaatacattacattatacatttaagaatcttattgaaaccttaaaaaaattatatttttatttgacttccaataaactagttagcgttctaggcagcatacaaagtttctgttaaattttaatgggtgttatttctaataaaaactatgtaaatatagataaaatagagacaagcttaagatgactgaccacaaaatactatttttaaatgctaacaggttaaatccattcaggaaaacttaaattctacttttgctgtttcttactccctgaatggcactttttttgctgggggcagggagtagcagtagatagttgccattgtctctacctcctcatactaattctttttaattaaaatgtccagtaatgctctgaaaatcatttttggaacatttaactattcagtaaaaagattaaaaatgacttaataagtatacttttctaaatgtaataaaaattatattctacactgtactttcatagcacttctagtttaacatgaaaaatttcagggtgcttgctgaaatgacaaagcactttggtatggctatcctatgctaaaattctttcctttgaaaattcaaactcagtatttctaaaaaatcagcaaaagaaactatcatcagaatgaacaggcaacctacagagtgggaggaacttaaacaaattttca

SEQ ID NO: 240104 - DNA, 219 bp, Homo sapiens
acagggacccgggtgcctctcaggttgagaggggtggtcaccatccccacactcaggccccctctgtctccaggcctgctgcttctgaacaggcctggggcagtccatttctattgggaaaccctatcaaagttagccccgggtttcagccaagttcacctcactgctcacagacattcattattaacagactgtttgatagcactttgggctcttttt

SEQ ID NO: 240105 - DNA, 422 bp, Homo sapiens
catttgttgtttcctgactttttaatgatcgccattctaactggcgtgagatggtatctcactgtggttttgatttgcatttctctaatgaccagtgatgataagcatgagggatagcattaggagaaatacctaatgtaggtgacaggttgatgggtacagcaaatcaccatggcacatgtatacctatgtaacaaaaccgtacattctgcacatgtatcccagaacttaaagtataataatttaaaaaaaaacttgatagatgtagacaaactgccctccaaaatttccatattcatttacattcccattagtactctcaaccaatataaaatatttaaacttgtatatttttctcttttattatattttaaattttatatctttaatttttccagtgaaaaagattaaagtgatttatt

SEQ ID NO: 240106 - DNA, 477 bp, Homo sapiens
tgtgcccggccaagattctgcattttaacaagtttccaggtgatgctgatgctgcttgtccaggaccacactttgctgagcaaggctttattaaagactcaaaaccaaattctttcccccagcccttccttttgtctcctgcctatgttcagcacctgtttcatatgtggtcagaatagcagagtttctcacaacccagctccagccctcggccaggatccctggtgaccccggcaaacacacacttctttagggtcacgggcaggttactgagtcaagactgccaaagcccaacaatgatattttccttcactccccatcgtcctccctctctagccaccccaaacccgggactaatcttggagctgcttaataataacaaagccagcagcagagtaaggcaagatttcaaagcagagtttttcttgtttggcaattacctaattcaggatgcgattcacagatttgcaaaaccca

SEQ ID NO: 240107 - DNA, 643 bp, Homo sapiens
gtaagtgaggaaatacaaagttccaggtgcacagatgggacctgtcaatgtgtcagacctcatggtagagggattgaaattaaaacatcaacatcaatatctgcagatcttctcccttgagataatcagtttccataaaaaggcatcttcctagttgctgctttggtggtgtggggtggagggtgggtacagcaacgaagtctgtctaccagcatttagtacactgagtgagggaagaccatcgcagggtgggaagttttcagcttcacttcgcaacccaggctctggaagtatgtcatcttccaattgcttcatcattgcctactctcctaaccacaggcatagcgcgtcagaagactgaaacccaactcagccaaccatctattcacatgccatcatccacgagtttgttgacatctctcatttgctgttgtctctcctcattctttctgtcctcataggtttataagttttcattttctttctttaaaaactcattttaaggacaccattatttttaaaaaaagcaatagaaaataacaagtatgggcaaagacgtggagaaattggaaccgtcgcacactgctggtggaaatgtaaaatggcagagttcttcaaaaaattaaagttccattatcatatg

SEQ ID NO: 240108 - DNA, 321 bp, Homo sapiens
aacagaccaataaagtaccacacttagttcctaaggctgactctgtagttatttactcaacaaaaaacatattgagtatacagcctgggcactgggaatacagcagagaacaaaacgaagtgttagtccttatgaagtttcagtctggtgggggaaaataagtaatcaaaaataatatatttactacatcagctggtgataaatgctatgaaaacaaaaagcaaaggtggaaagagacagcaatagggttggtcctattttattagagcctgaataaggtgagagagtaaaccatgatgttacctaaaagaagtatgatcc

SEQ ID NO: 240109 - DNA, 485 bp, Homo sapiens
gttttgctctgtcatttggagaccagactgaataggcacaagcaagattctgggtgattttgctgcctcgtattagctaggtttttctccctcatgcaaaaataaaataggaatctaatggtacttattcctgtggctatgtctggacgatacgtaaagtatcagagtcccaggtgaggccaggactggctggtccagaggctggaggggaggatttcagaaacagcactgtcatcctttcatatgccctacctcctctgtctcaattttaggagtataataaatgttctcttaaaaagcatgctgggcagaggaaataaaaaatgtggtatggatggtggttaaatatctgccctctaatacatatagaatcgtttttacatttaaagtcaaatctgaagctgatttaaaaattcctacagtgggtaagagctaagaaacctttcccatgaaaatctgacctttggttaacttcccagatctgt

SEQ ID NO: 240110 - DNA, 127 bp, Homo sapiens
caaaatgaactgaaaataaaccacagacttaaatgtaaaatgtaaaactatacagtcttttagaaaaaaaataagaacaaatctttgggatctataggtaggtatagagttcttagacttgacacca

SEQ ID NO: 240111 - DNA, 354 bp, Homo sapiens
caggtcttaaataatacggaagaaaggcatggtattgagaggatgtgtcctcccacagacagactacaatgagtgtagtatcactgttttaaagtcacttctcactttgtaagatgagcatgggaggagtcaaaagtagaagatagaaaagaaataagagggatccccataagactgcaagaaaagttaaaaagatgatgagtataaatgaagttacttttgaggcaagcaggaagaggtggcaagaggggccagaaaaatcaaagattatacctgatgacctggttttttttgtttgttttgttttttgttttttgttttgagacagagtctcgctctgtcacctaggctgga

SEQ ID NO: 240112 - DNA, 440 bp, Homo sapiens
gctctccgggactcctctggagcagcctggggggacgcggggtcccgtggggacattcgtgaaagggcgtggaggaaaccctgagccgcacacgcccacggccaaccaaccctgcagccagacaggcccaggggccactccagaggctgtgtcaggccctgcgggtgcgcgccacgtttctgagtttattgtttgcgagcctctgagctctgggccttgaagccccccgcgtgcccccgctcccggcaagctgagcccagcgtgggtgattgacaggccgccctgggaaccaggagcgacaggtgccgcgacctccctgtggtgggcacggcccgtccgcccatcgcccctctcagcgccttttcttccccattcacttttttacaaagtcacaggctgcgatttccaggtgcgacgcctcgaccccccggatgcagccg

SEQ ID NO: 240113 - DNA, 239 bp, Homo sapiens
aacagggcttccaagggacagttatgcatgctgcctggatcccggcacctggccctggcgcgagcctatggcccacttacacatcagctgaattcacacctgaccactgcagtttgttctcttgaatttcttggaatttccttatggaggctagttcacttttgtaaacagaaaaagttgtatttttgccataggtataaagtaatatttaataaatgcagtggcaacaaagcaaagct

SEQ ID NO: 240114 - DNA, 692 bp, Homo sapiens
gtcttttgtgtctgctttctttcacttaggataatgctgtgaagtttgtagcatatatcaatacttcagtactttttattgccaagatttgttttttaagattattttatcattttctttcccttgactccattttttctcttttcattgtgaaatcaattctaaggtctcctgtcataattattatgatttcaaggagtgaaccagtatatttttgtgatctacaagcaatcatctgtatgatctagagcatttcacagttgatctacatgttagaagagctttttggactttaaaaaatgtttttagaaagtgtgatgttagctattgccagtggcaagcccagctgaaccaggtacatcatcatgaccacagagtagtccatttcaatatagtttgtatcattaacattttttaacatctaaaaaagtttaggtcatttctatgctttcattagtgattcttcactaggaaggaacctagtgaagtgccagtatgttatcagaaataaaattcccagtctatccattgcttatatatttgtaaacaccaaaatgcatgaaagatgaagttctggtatcagttacagggttgacatagcttgatcaagaaaatgtacatgtgctatgttaatcttctttctttttgtttgttatttttgaatttttttttttttttatttcaggaccctt

SEQ ID NO: 240115 - DNA, 331 bp, Homo sapiens
aaaagatagatgtggtgattagtaaatcatggatgatcatagagtaatttcagtagatggttgggggtcaaactggagtataatgggttaagaagtaagtcaggaagtagagggctcttcctggtgttagggacaatataaatgaagacatggagacaggagtgggcttggcgaacacaggatgatgggcatcagcctgagtgaccaggtgttcgtagctcagagtggtagggagttaggttggatggacgaggttagagtcaagatgtggaggcctttgaattccaggatgaattgttgaaacttgacctatcagggaattaaagaaggt

SEQ ID NO: 240116 - DNA, 388 bp, Homo sapiens
cccacaaaggcctttcccaacgcctccccagccggcactcgggggcacggccccgcgcccgcgcctcgtcgtcgtcgtcctcctcctccccgcccgcgcggtagtagctctgtccgcagctgctgcagaccgagggcgcgcccaccgcgtggatcttcttgtgtctccggagcgcggcgccctgcacgaagccctccccgcactccacgcagatgtgggccggctcctcgccccccgccgccccgagcccgtccccgtgctgggcccgctggtgcgccaggagcccggccccgtgcccgaagcccttcccgcactccagacacacgtacggcttgggggccggggcgcgccgcgaccggggccccgcggcctttgcccccgcgcccgc

SEQ ID NO: 240117 - DNA, 2895 bp, Homo sapiens
  misc_feature (2313)..(2313): n is a, c, g, or t
tttaagtgcaaagttcagtagttaagtacattaatattgttgtatagccatcaccgtcatctatctccagaactctttctatcttgcaaaactgaaattctgtacccgtaaacagtaactccatttctcttctgcagcattggcaatcaccattctccttcctctctctgtttttgactgttctgcctcataaaagtacctcatgtgaatggaatcatacagtatttgtctttttgtgcctgatttatttcactcagcataatgtcctcatggttcatccgtgttaatagcatgtgtcagaatttctatcctttttaaggctaaatgacccattgtatgtacgtatcactgtttatctattcatccattgatgaacacttgatcacatatttttatttaaaacatttttaaagccaggcacaatggctcatgcctgtaatcccagcactttggaaggttgaggtgggcagatctcttgaggtcaggagttcgagaccagcctggccaacatggcaaatcccatttctactaaaaatacaaaaattagccgggcgtggtggcaggcgcctataatcccagcttcttgggaggctgtggcaggaaaatcacttgaaccccggaggcggaggttgcagtgagccaagactgtggccactggactccagtctgggcaacagagcaagactctgtctcaaaaaaaaaaaaaaaaaaagataaaagatgtttaaaacctcttttcccggctgggcgtggtggctctcgcctataatcccagtactttgggaggctgaggcaggcggatcacctgagatcgggagtttgagaccagcctggccaacatggtgaaactccatccctactaaaaatagaaaaattagctggtcatggtggtgtgcgcatgtaatcccagctactcaggaggctgaggcaggagaaatcacttgaacccagggggcggaggttgcagtgagccaagattgcgacactgcactccagcctgggcgacagagcgagactgtctgcaaaaaaataaacaacttcttttccttcaggagagtcaagatggttaggacacttttcagtcagagggttgctgtgtcacgactgttgctctttcttatttcattgcatttattacagctctttggtttttgttgttgtttttacgtttttcagagacaggtctcattctgttgccaaggctagagcacagaggcacgatcacggctcacggcagccttgacctcctcctgggctgaagcagtccaacctgcctcagcctctgagtagctgggactaaaggcatgtgccactgggcccggcatattctgttttgatctcagtatcagttaggatgctttcactgacaggactctggctctgtttctgtctcccatgtcatgacatcctggtcaggcaggactggggctctgctgtgcttctctgagactctcttgtacccagctggcctccatggaggtggcgtcatcctcagctcagtttgactaattctaagatacacttttttccttcacatttgctcctatagttgggcttcattgtacattctgtggtgtggttataatttattggctatattttatcctttctcagtgcacataaaataacagtggatcttacaatgaatgaaatttagcaagtgttgagaggaagaaagaattggacttcttttccccttaggagcaaggaaaatttccccagcaggtccccagtagacccacatattgttgccatggattgggtcatgtgtctatttctaaaccatgaggaaagagtttaacatgattagcacttgagttggaatggatgctggggaatccacagctaaggccatcatgtctaaagacatgggatacaggcagcagtgagccttggaagtgcatagagatttcagtcgtctgtctagttattatttctgtctagattttgagcatttctaaattgtgtgtcatttacatttttaaataacctattttaactctgtaatgaaagaacttaagaagtgaaggagttatgaagtgaagtgaacacaaaaactatcagggtcacatagtttatagaagatacttctcatcccagacctggggttataactgatacagactgaaagaagctgcaggaggacagtgtctgcttgttcaagtagagtcttttgttggtgtgttccattaggtgggcctgactgccgcctcggggctgtattttcggtctgggaacctgatactcaacctaatgccactcagtttcgtctcccattctctactttctcttgcactgtattttactacccantttttccctctcactgtgtatttccagtgtcttgagatctttgtaccagacttttattttatagattttttttttcctaccataaaagaaaatgtagttcctaaggaaaagatgcttacattcttggaaaaggagcaaatttactgtgattggatttttgtataccaccatttaaaatcagatgtttggttttttacatcagattttaaatgtattctgtgtgcttcattttcaaaaagaaatgttttggagcaccaaaaataataaaacttttaaaaatgaattggcaacatttacctttttaaaatttttgacttttggctcacgcctgtaatcccagcactttgggaggccaaggtgggtagatcatttcagctcaggaattcgagaccagcctgggcaacatggcaaaaccccatctctacaaaaaatacaaaaattaggtaggcatggtgatgcatgtctgtagtcccagccactcaggaggctgaagtgggaggattgcttgagcctaggcggttgaagcagcactgagccacgatcacaccattgcactccagcctggtgacagaaccagtcttt

SEQ ID NO: 240118 - DNA, 771 bp, Homo sapiens
tgccgctccttggaactggagaagccaaatgaattccctctcacatctcttaccctctttccaaatgcccttccttatcaactttgtctctaaattcttcccatcttacatggcccggttggaagtataacttcatttctccagtccaccctggtgggttggtgggttggttggttggttggttggttttttgggttaactccttacatcctattctgaagtttgtctttgtttttgtctccaaaactagtcaaaattctcaggtcagtagccgtctcctgtgcatgtcctccctgcacctagctcaaggctggatgcacaggagacatcctatctgctttctcaggccactggctttcctccctgaatggctcttgctttagcagggggcagtctcaactagtagaaattttaccattgggaatgatatcaatgaagtttttatagactgtgggctttccatagtggatggaagagtaacagcagaaagttacgattgagagtcccagggtaaactagagacaaaagataggggcagggttaaaaagtagaaccccaggctagacaatataacaagaccccatctctacaaaaataattttaaaaattagctggatgtggtggcatgcacctgtagtcccaggtatttgggaggctgaggtgggaggattgcttgagcccaggaggttgaggctacagtgagccatgatcatgccactgcacttcagcctgagcaacagagaaagaccctgtctcagaacaaaacaaaac

SEQ ID NO: 240119 - DNA, 494 bp, Homo sapiens
cacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatggactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaa

SEQ ID NO: 240120 - DNA, 440 bp, Homo sapiens
cacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatggactctattaaaaagtggagaggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaa

SEQ ID NO: 240121 - DNA, 344 bp, Homo sapiens
tgctttctgccaggtctcggataaagagatttaggagaatgttattaagcagtacactatatgtcattttgatcaggtggtatatgtttttcctctcagtgctagttgatcctggaagcgtcctcactgacaagctggtcagggtatgttgagtgtaatttgaggtctcattaggaatgtagtgagatagctttgtgacagactcacagcacatagtgaaagacacacaggtagatggatggcaagctgtggttgttgcctgctcttcatttctttcacaattagaagttgagagtgggccgggcacagtggttcatgcctgtaatcccagcactttgggaggc

SEQ ID NO: 240122 - DNA, 331 bp, Homo sapiens
tgggagtgagagaggagactagtgcacaggtaatgctagccaaggtgaagtgttgagcagcaaccactttactctttagaagctgtggaaaattccaagctcccacactatccttcttggtcttttcttgatatagagcttttgcaatgtgcaagttcctttcagaatattcataaaagtctacaagggttgtatcaaaagaactccacatccatattgaataaactcccactagccaaaaattggataaattgaggatcaataaggatcatgactacagtgtgttgaaacttcttaagtatatttagattcatgagcttatgggatacta

SEQ ID NO: 240123 - DNA, 517 bp, Homo sapiens
ctgctgtgaccctagaaatttaggaactttgactaagctccgttgctctgaggggaggggatgcggacatgtttttgacagccatggtaccctgatgaaaacccttccagcaccctgcttgggttacagctattggaagcctgggcacactgggcctggcagaggaggtggtgctcagaaagggccacagagcaagagaggcaagatgcttcccccactgccacccatcagtgagaggcccctctctccagggttaacacttcttaccagaatagactctattttgcccagaaataccttcactcagtgtaaaagatcagggctaattttaaagccacccaaacttccctgtgtttatatatttatgagtgcctctgatgcagctcattttgagaggtgatgttgtcactgcttgttgttaattcattcactgtggcattagagttttactgacactgtaacagttagttgagacagtctgaggtctcagttcactctgccttaacagattgccttc

SEQ ID NO: 240124 - DNA, 508 bp, Homo sapiens
aatccttacaaaaataaattttttacattttacattaaataattaattttttatatttttacattaaaataacattttaccttcaaggcattgaacaatatgactaaatcaattatagtttattgtcccaagatcctggctcttttctgagtttttatggacagatataaactactttcagaaaatggcatatttatcagttcaaatatatttctattattcgttgtctactattatcttttttttttaagaaaaacttgtatgtgtgaaaacagcttgaaagagaagagaaaaaaggagagggttcaagtggttttgaaatttctccagggtagcagtgtcaatgaaagtgttgcttagtgaggaaatctttcaatgggccaatattttcttaatctttatttcaaagttacctaggttcactcaaaagacaggctggggagacacgtggactcagaagatatcaagtacaaatccctttattacagtattcttataaaggaaaatc

SEQ ID NO: 240125 - DNA, 590 bp, Homo sapiens
ctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcaccc

SEQ ID NO: 240126 - DNA, 638 bp, Homo sapiens
cttacttatttgtgggatctaaagatcaaaacagttgaactcatggacatagtagaaggttgattaccagaggctgggaagggtagtgggggataggtaggggagttggggatgattaatgggtaccaaaaaatagttagaatgaatgacacctactatttgatagcacaacagggtgtctatagtcaataataatttaattgtacattttaaaataactaaaatagtataattggattgtttgtaatacaaagaatgatcacttgagggggtggataccccattctccatgatgtgattattatacattgcatgcctgtatccacacatctcatgtacccataaatatatatacctactatatacccacaagaattaaaaataaaatttttttaaaaagtagaaagacttcaaataaataacccaatgatgcacctccaggaactagaaaagcaagaacaaatcaaaccctaaattagtagaaagaatgtaacaaggctgggtgtggtgacacctgtaatcacagcactttgggagactgaggcaggatgattgcccgacacccacctgggcaacaaagtgagactgtgtctacaaaaaaagtttgaaaattagccaggaatgatggcatgtgccta

SEQ ID NO: 240127 - DNA, 635 bp, Homo sapiens
tctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgactgatttgtgatttgcttttaatttcttaaaatgttaccacataattcatctaaagtataaaaaggaatagcaaattttagatgttgtgcagatatataatgcttgtgtcagaattattataatattgataataaactttagatattgcttc

SEQ ID NO: 240128 - DNA, 407 bp, Homo sapiens
ccaaagcaaaaactgtgacgatatcttcttatgactttttgataaaaactctaaagctttttttatattctattgtttctttaaataatattttcaataatttttttttctaaaaaatgacacctgccaaaaattcaagcttagggaaatgcaaattaaaaccacaagatattactacacacttgttagtataactaaataaaaataataactgggaatattaagcgatgatgaggatgcagagcaagtggaaatctcatacattgctaatgggaatgcaaaatagtacagcccctttggaagacaatctggtagtgtcttataaaattaaccatacccttaccacgtgaaccagcagtctcactcctgagtattttttcaagagaaataaaaacatattcacatga

SEQ ID NO: 240129 - DNA, 451 bp, Homo sapiens
accctcagattcacactgacaaaacttctcttacagctatgcacattctgacatacaaaggccacaaactcagtgctctggtgctacagctggtggagcctgattaaaggcagagttcccgcccatgcatgcagacaggaagatcaacttacagaccccttcaacagtgtacagcagggctctggaccaaggtgattcattttagctatcctaaaaaggagatcacccacagagcacagaattaaatctgtgttattaaaaaaacaaaatatcaggcccacactaacaatatcaccacaaagaacaaatatttctatacaagaaaaacaacaagtcgtttctgttcacatgtcatattctcattacagccagtcctaaccatcccatttaaaattgtaatcctttccctagtactcctagtccttcttaccttgcttatttttttccatag

SEQ ID NO: 240130 - DNA, 252 bp, Homo sapiens
tgcttgaattttctcattgaaataagaatctgggtcataaatcgagagtgaggattaaaggttgaacataaagaagaagatgtgaaatagttatctccgacagtggaagaatgattcagttagggaaagaattactaggcaatccacttgaggttgggacaagggatttaaacaggaacaggtcagcatgttgtgtgcatatattgagacatcatcaattgtgaatttggggttttgaatttaaccatgggt

SEQ ID NO: 240131 - DNA, 425 bp, Homo sapiens
tctgtacaaagaatcttaacattttaagtaaattgtatttgcctttttatgtttaatcataaaagccatctaatacattacagaataaagaagtagtcgtcatcttggacctgctacccctacacaaccaaacttagccagtgaaggacattttcaaaagtatttatttgtaatctcattatttttagattttctatttttaaatattccatttcagatattcttcacattttttacacaggtgtttcaaagtcgtatctgtaattagagtgtacacagtattctcaattaatatcatataaatccacatgagtctatgttgcttaattttctaaacccttaaatatggatatttaggatgtttctagtatttttaactgttatagaaatttgtaatgaataattgcacttatgacttttttata

SEQ ID NO: 240132 - DNA, 357 bp, Homo sapiens
gggacacatttccccctgcctcgcggcagccccgaaagacccagctcctgcctcctgatggcctctttaggctcatctcatgcctcactgcagcctcccccaggccaggctcctagctttcggcggcttcgcaggtccggctcctgcgtctgacggcctctttaggcccggctcgtccctcacaatggcctctttcaaaggcccagcttttccttcgtggcggcctctccaggcccaaattggcaagcctcccctgtcctggtggctgtctcccggcctactctccaggcccagcacactctcgcggctgtacctccagcccagcccctgcctgcagacagccgcttttgactcggt

SEQ ID NO: 240133 - DNA, 341 bp, Homo sapiens
tatgcgcctgtcactcttctgagcacttgatatacaataagtcacccacttcctttctgacacagatgtcctagtcacatgtgaggtaagagtctttcaaactgggcgtcacaaatggattttctccttgcagaatggcttcctccaagttagaaaaaattctttctcttactaatgtgggaagttccaccccctctaatatcagatgaccacaagaagccctggcatctccactcacgctggcctgagcatggctatgccctttgaactgtccctcccgttgtagtctctgggatatcatgcaatcctgtgactgctgtttttgattcattcagatgggt

SEQ ID NO: 240134 - DNA, 389 bp, Homo sapiens
ccaatggcaagcagaaggcagtggactcagatgagaaaaaagagagaaaagttttctcaaaagcttttactatatgactattagcttcttaaaaggttcagggatatgtctatgtatggtagaagttaaatttgaaaagaagcttcccgaattctgaatatttgttccatttcaattacaatgttgtttgtaagaataagagtaaataaactgtattgaaacatgaagtgcaaattcctcttggactttagtctcccatattcttctctaaaagaaaaagttgtacaaactggattagaacaatcaaccctaattatttatgtgcaggatttgtttctaggacacccctgtgagggatccagaaacagcacatctcacccaaacatttt

SEQ ID NO: 240135 - DNA, 357 bp, Homo sapiens
gcctcttgcttgccagtgaccactgctaataataatagtagtcatcattcactggaatcctgggtttttagggtttacttggtttatttatttgcttagcttgaaggaataaaaaaaaaccttgagaggaaacaaggaggcatttcacaaaggagaaaaatatatatccctttaggaaaactgagtggctcctctgatttctttgccgctcttgtccctcagcagcacttagctgttttcttctagctggaggtgagggactgagcacaggggtggtgctcagttagtttaaagggagcttctcaccttggcgctgttcaggccttgggttggttaattctgtgtcctgtgggaatt

SEQ ID NO: 240136 - DNA, 428 bp, Homo sapiens
ctgacaatatcacaattgcgtttgctgtcaggacaacctaacccagattctcagtccatgacatagcatgcaaatgtcatgctaacactcagatacgaacacatagccaatcctacatcaatgctatcctattcctggatagcatcgtgccataaggaaccagtttgcaggactcatcattgaagtttggcatttcagaagagaaagattagtgccttccttttttatataaaacagccttatagatttccatctaaaaataatttcttcatcaaatatattctaaaaaaaattttgcttactgcttatagctccctcttgagtattcaaatatatactaacatattaatagctctgagaagtcatattgcaaaaccaactctttaactttacttaaccagcattgcccaaatctgtttgaccacaga

SEQ ID NO: 240137 - DNA, 401 bp, Homo sapiens
gcaggcttttagataaggctggtctgatcaataatctgtaactgttctaaaggaggagacaaggtgagaacagtctgaagccttactggtttaatctttcctactgtggccaagtctgcaggtctcatctaccccttccatgatcaggacatttcacgcatcctagtctgtcaggcagtttttccagttgctgtcacttgatctcaactttcacacttttcactgggtcctatactttaagtcttctcaggctcttcctcttggaccatccattgttattaaaaacatctctagatagttgtatatttgttttaattctgcatgaaaatattaaaattatccattttgttttgcaagtaacatgtaaagttccagaaaaatcagaaaatgtgtgtcataaa

SEQ ID NO: 240138 - DNA, 388 bp, Homo sapiens
gcactggtgaggcagagagcaaagtgatgaacaggacatgtagaaaatggagacctggagagtaagaagagaaaggacaatgagactcaaacatacagaaggacaggggcatgcactgacaaaaacatcagaccctcctccaagagccacgtctccaatgacagcagcaacagaacgacctcagacaggctgtgggtggaggtgggaaacaggtccatcttaccttgcaaggggacagggcttgagtaaagaatagaagatggaaaattaactccgtacagaacacacgttggaaacgagcagcggagagaatgcctaaatccagtgctggggatctgcattcactctgcccagaacaattccaccactcagctaagggcccgttctc

SEQ ID NO: 240139 - DNA, 119 bp, Homo sapiens
gagtagaggccagttatgttgttgaacatcccttaatttgggcttctctggagctccctcatacatatttggtggaaacagtgcacaggcaatgctgggcccttctcagtgcatcatag

SEQ ID NO: 240140 - DNA, 638 bp, Homo sapiens
agttttccttataatatgtgcttttctattctgtgtttactacttatataggtgtttatagaactataaacatcttgagtgtacttttgtatttcagtggttttagctagcagttggcatttttggctatatcttattgtaggtgaatctgtctttgcttgaatctaaaggttatctcttttcagctttatctttatgagtctttttttgtaatgacattataacacatttttaagaagtagcttctaatatggtgaaatgaagcaaaacgatttagaaatatagtttaaactgacatgtagacaagattttaggttctaagtaggctctggttgaataaaaatataaaaagataataggtttttcacaatatgctttctatgaattattcagccaaattattttctgcaagctaaagtttttatgcccatttcatatgaaatcagctgagtctaggtctcagttgtctgttacttggggaaggattttcttgcatgacctcaggtgatctgcccacctcaacctcccaaagtgctgggattacagctgtgagccaccatgtccggcctcagatttctttttgtttacctctcgtagggacttatttaccctatgctacctactgaaagtcagttggg

SEQ ID NO: 240141 - DNA, 427 bp, Homo sapiens
cctttcttccctaagcttcagcataaataactcattaattgatattaccacctttaacaaggactctttacattttatagtactaataccagaaaattatggtatctgcctatgatgttgttaagatataaagtagatgacaacagaacatgattgaaagcaatgattagaaaaaatagtttttttatattaatattccaatgagttgaggcttcaatgaacctgttctcatctactatctcatcttcaaatctaccttgtgaaatagtcaagacagggattaatcatagcatttagaagtgaaaaagtgaaaataatcataataggaatgtgctcataacattcctgcttctcctacattttacttataaataaactgttgaacagagggagattagtgactgataaagccaagaacagaactaat

SEQ ID NO: 240142 - DNA, 345 bp, Homo sapiens
gaagctttttggagtcaactgaccaagttttaaatcaaggctctgtcatgttcttaatgggtgacctaaacaaagtggatgatgatgtctgtcatttacagttggctgtgaaagtcaaacaagataattttttaaggcatttgcacaattgtctggtacctagaaattatttaataaatggtgactattgccattgtcatccttcctatagtatctatactgggaattatggtgcaagccataaggttcattcccattgattccctattttctaggttgctatcaaataatgaagatatttgtgtggcaggaaggttggtgccaatattcccttagggacttctc

SEQ ID NO: 240143 - DNA, 336 bp, Homo sapiens
ttttctgaggaccctccagtgcataggtccaagtacttctgtctatttaaaaaaaatcaagaggaataagtttctgagctattatcattgagtacatatggaaacaaataagagaacaatagttactggggttcacttgaggtgggaaggtaggaggagggtgaggatagaaaaactacctgtagggggagggtgaagatagaaaactacctatcggtgactatactctctacctaggtaatgaaatcttttgtatatcagacccagtgacatgcaatttacccatgcaacaaacagcacatgtaccccctgaagtaaaagctgaaaaagaataaa

SEQ ID NO: 240144 - DNA, 408 bp, Homo sapiens
gactagcagtggaaagaagaggagggggagggaagagaacttagacccgactttaagaagcgttgtattaaagcaagataagaacagtacctttgagctggagcaaaacctggagtaaaaaaaagggtttttgcgaaagtggcgcgaagataatatcatgtgatccgaccccagggcgtctccttccccttttgccaaactcccctcccctcgaaaaaaggggggttgggggagctacatccgctcctcacaaactattagcataattaattgtgtcctacagctgcagccagagctcccgggtcaatgagtaaacatatcctcatcctcttcaacatcagaacaaaaaaacccattaccctgattttggaaaatgttcccaaataaatctcattatcttcaaaagtc

SEQ ID NO: 240145 - DNA, 695 bp, Homo sapiens
tgaaacatcccttggatttcaagtcagaatacttgatggaaggcaacgttacagacgtgttgcaggcagcgctaggttctttcagcaccctgctccacattttgctttgcattttgctttatttcggccaagtcattctttataagcagaggcaaatatcatggtcttcctttcagcaatgtggtcagtaagcaatccacagaaagcatgatttctagtgacaacgacagcatttctgaaggggttattctttgttagcctctctcccttttcctcaactagactatgcagtggatttaatcatcttccatcagcaacctccattaacatagtgctttacagtttgccccctgcagcaacccatggagatacatgtcatttattagcccatttttccagtgaggaaactgagtttagaaaagttgaatgacacacatactgctctaattgcccgagaacgttgaaacaaagagttatttgaatgacacaccattactttctgtatgtacacagtatctagtttgtggtttataaagggtctcaaagtatattgcaggattttatgatagaccggatttgtttattgccggcagttgctgtctatttccggtgacattctttaggttctagtaacctttggagagtgtttaaaaggtgcaaagtgatatgcctggaaagtttagtttcataactac

SEQ ID NO: 240146 - DNA, 436 bp, Homo sapiens
ccccgagacggagtcttgctctgtcacgtaggctagagtgcagtggcgcaatctcggctcactgcaacctttgcctcccgggttcaagcgattctcctgcctcagcctcccgagtagctgggattacaggcgtgtgccaccacgcctggctaatttttgtatttttagtaaaggcggggtttcaccatgttggccaggctggtctccaactcctgacctcatgatccacccgccttcacctcccaaagtgctgggattacaggcgtgagccactgagcctggccgatctgtttattatcttaactgtagtgatggtttcacaagcataaacacacatcaaattttgcactttcaatatgcgcggtttagtgtatgtcaatcatccctcaataacactgttaaaaaaagaaacattaaaattaaattgtaaattatc

SEQ ID NO: 240147 - DNA, 364 bp, Homo sapiens
ctttttgaaaagtgataacagttgaagaattttgaggccaacctcagacctttcagataaaaattgcctttgttaaaagatttgtcagtacggtggctcccacctgtaatcccagcattttgggaggccaaggcaggctgatcgcttgagctcaggagttcgagaccagcctgggcaacatggtgaaaccccatctctacaaaaaacacaaaaattagctggttgtggtggtacacgcatgtagtctcaactattcaggaggccaaggtgggaggatggcttgagcccagtagttggaggttgcagtgagcccagatcatgcccctgcactctaccttgggcagcaagagtgagaccctatctc

SEQ ID NO: 240148 - DNA, 452 bp, Homo sapiens
tgatgaacatgccggcagagaggttgaattccgaggtgaaccagtcattccaatccaagggagacagcgtttggaagctttaatctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaa

SEQ ID NO: 240149 - DNA, 675 bp, Homo sapiens
tgttcattaagcatttagtgtcttagaagtgatatgtttactgcagaaaaatttggatagcatgcaaaaaatgaaacatactatcacaatcctatgatataacttaaaaatttctttatagcttcatggaggtatttgatgaaaattgtatatatttaaggtatataatgttttgatacatgtatacattgtgaaatgattaccacaaggaggttactaaacatctccatcaccttgttaaattgagttaaacaaatttacaagttgacaaattacatttacaaatttatgtaattttttacgctttttttttttctcctttttctggagaacggggtctcgctatactgcccaggcaggtctcgaactcctgggctcaagctatcctcccgcctcttgcctccctaagagctgggattataggcgtgagccaccccacccggcctatgtcatttttttatgtggtgagaataaataatctcagcaaatttcaagtatacaattcattattactaagatagccaccacactgtatgtcagggctccagaacttactcatctcataggaggcagctacttttaacattcttggtgtatatccatccttcaggattttctgtatatttctctaacagcaaaagtttttgttaagcctacaatttgaaatgcctgggt

SEQ ID NO: 240150 - DNA, 518 bp, Homo sapiens
ctggcttttacatttgttattcctatattctttacagtggcctttaccctttacccatcttgatagttaatcccttttactagttattctttttattaaattttccctactcaaattacttctgtaattattgtctcctgactagaacctggtacataaggccacttgatttttagcaaaggcaccacctacaattaagcacgaaaagaatggtcttttccagccaggtgcgttggctcacgtgtgtaatcccagcactttgggaggccgaggcaggtgggtcacgaggtcaggagttcgagaccagcctggccaacatggtgaaatcccgtctctactaaaaatacaaaaattagcctgacgtggtggcacacacctgtaattccagccactcaggaggctgaggcaggagaatcacttgaacccaggaggcggaggttgcagtgagccgagatcgcgccactgcactccagcctgggtaactagagcaagactctgtctcaaaaaaaaaaaaaaaa

SEQ ID NO: 240151 - DNA, 344 bp, Homo sapiens
ggattgagcatcacactaaaaaccttccccggaaaaagggaccaaaggatgtaaactgaaaattttagatggtcctggctttccagttagtctccttcacctacatctggatcatattgaaaccaaatgtttgtgctgcttctaacatcaagatgacacaccagcggtgctcctcttcaatgaaacaaacctggctggagtgcggtggtccaatcatagttcactataacctcaaacacctgtgctcaagtggtcctcccacctcaacctcccaagtagctgggacaacaggcgtgtgccactacacctggcttttatatttttttggtagagattgggtctct

SEQ ID NO: 240152 - DNA, 891 bp, Homo sapiens
aattcggccattatggccggggagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaatttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacgggaaaatgtgggccccctccacctattgacaatggggacattacttcattctccgttgtcagtatatgctccagcttcatcagttgaagtaccaatgccagaacttgtatcaacttgagggtaacaagcgaataacatgtagaaatggacaatggtcagaaccaccaaaatgcttacatccgtgtgtaatatcccgagaaattatggaagtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaaacctggaaaactaac

SEQ ID NO: 240153 - DNA, 1318 bp, Homo sapiens
aattcggccattatggccggggagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacgggaaaatgtgggccccctccacctattgacaatggggacattacttcattctccgttgtcagtatatgctccagcttcatcagttgaagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaaacctggaaaactaac

SEQ ID NO: 240154 - DNA, 1264 bp, Homo sapiens
  misc_feature (568)..(568): n is a, c, g, or t
aattcggccattatggccggggagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttnctgtgtgaatccgcccacagtactacgttatcaatgtaggagcccttatgaaatgtttggggatgaagaagtgatgtgtttaaatggaaactggacggaaccacctcaatgcaaagattctacgggaaaatgtgggccccctccacctattgacaatggggacattacttcattctccgttgtcagtatatgctccagcttcatcagttgaagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaaacctggaaaactaac

SEQ ID NO: 240155 - DNA, 1263 bp, Homo sapiens
aattcggccattatggccggggagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctccgttgtcagtatatgctccagcttcatcagttgaagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaaacctggaaaactaac

SEQ ID NO: 240156 - DNA, 1975 bp, Homo sapiens
  misc_feature (194)..(194): n is a, c, g, or t
  misc_feature (395)..(395): n is a, c, g, or t
  misc_feature (742)..(742): n is a, c, g, or t
  misc_feature (994)..(994): n is a, c, g, or t
agatcattccatcaataaaacaaacaaacaaaacatattaagcactgtactagggaccataaaagtgcataattttctaagtacctagtgtatctgcataattacaaagaactgtcatggccaatagcagcattttttacatacacaactctgtaacgtaactacttgaattataggaacatgtgacaaaattntctggagtatttgtgttactataacaaatctggcacaatttgaaaccaatctagaataataatttttaaaagaaggtaggaaggggaacagaaatgtaagattatgcaactggccaaaatagaagcagcaacagctttcagtgtctgggcagcagaaagtgcaggattgcaaaacttggaaggagagcagggggtccacangctccccaggctccctcagtcacacagggcagagagtccgtctcgctgtgctgaggaggtccatccacaccatagactcaactacgatggcccaatgtctaacagacatggaattcagtccccaagtgatagaaaaaaaaaatggaatggacaaaatatatgcggataagtgacttaaattccccaaatttgttgcaaaacatctacctagatatctaagaagctcagcaaagcccaaccatagtaaatacagagacaaccacacctcactcagcaaactcttgaaaaccaaagacaaagagaaataaaactaaaaagtcgcaagagaaaaaatatacttataatanataggaaaacaaggatatcaattagagctgacttctcactaacacaatggaagccagaagaaatgggatgaaataatcaaggaataaaagaaaaaatatggcgaacccagaattctctaaccagcaaaaagtatcccccaaaaattaaggtaagagaaatatcttttagataaatgaaaattaagaaaatttgtcaccaacatatctgcattaaaagaacgagtaaaagaatttcttcaggatgaagaaaantgacaccagttagaaatattacgagagaatgaagagcaccaaacacagacatagaaatagaacacagacctaaaaatctatggtaaagagtatgtatttacccttctcaattattttaaaagactcttttcttaatgacttttggcagtttaaagcaaaaataaaaattgcactgtggagttcattaggaatattgtgtaaaatatgtatacattgtaccacaaagaaactgtgaggtaaatggattacacagttataagattcttaaactttgcattaagtgatatatatagatgctagatagactataaaaaattatggatgaatattaaaattctaacaatgacactaaaaatacaacacaaggagttatagcttaaaaggagtagaggaattgtaatggaatacaataaataaataaataacagaagggagtgaaaaagaacagaacaataaaatgtaacaaacaaaaagcagctgggataagtaaaacaaatagcaaaatggtagacttaaacaaacaacatcaataattacctaaaatatcaatagactaaatgccaattaaaaggcataaatgtcaggataaaaaaaagctaactgtttgtggatataaacaatatacattaaacatgaagacaagttaaaatatgataagaaagacctacaaggtgaattgtttgcataaataagctcacagaggctgggcgtggtggctcacgcctgtaatcccagcactttgggaggccaaagcaggtgggtcacttgaggtcaggagttcaataccagtctggccaacatggcaaaaccctgtctctactgataatacaaaaattagccgggcgtggtggcacatgcctgtaatcccagctactcaggaggctgaggcaggaaaattacctgaacccgggaggtgaaggttgcagtgagccgagatcgagccacagcactccagcctgggcaacacgctgagactctgtc

SEQ ID NO: 240157 - DNA, 184 bp, Homo sapiens
aggcgctgagggtttgccatcccctcagtttgcaggctaaagcatcagcccaaaccactgctccttacacttttaaaagaaaaccccttaggtaatgcatattttcaaatatgaggcaaatctcaattatgcacacttaatcataggttaaggtttttggtaagtaaaatattcttattttata

SEQ ID NO: 240158 - DNA, 4079 bp, Homo sapiens
  misc_feature (1033)..(1033): n is a, c, g, or t
  misc_feature (1220)..(1220): n is a, c, g, or t
  misc_feature (1849)..(1849): n is a, c, g, or t
  misc_feature (2480)..(2480): n is a, c, g, or t
  misc_feature (3087)..(3087): n is a, c, g, or t
agaatcctacctaatgcaacccgacttttggcctgagccattcaatggataattagtcctaactgtattgctggagtggaccattactgaagtcttaccttttttgtccttgcttttaccttgccttgttccagcaaggcttaagcatagctttaggtcctatgttatgcgcatgttatgtgattgtctgattgattacattataaactctgcacaggcggcatcacggtctttctgccctttcctgcctccctccgtccttgcactgccttgcttcatggagctttgcacttagcaggtgctcagtaaatacttgctgggtggttgacacaggattacatgttaatccatcatcttcaaaggctagaaccagacctatttaaaaaaacaaacaaaatccttccttttaaaagtggcattaccttcttaccctcacaaatgttcattttagtcgcctttattgctttctggggtagggggtcttaagggagtaactcagagagcctctttaacttaaaagaggcataataaattacagtctttaagagaagatcggatgcctgcgtgcctcccagaagtgggttaggagcacagaattctagatggctcctttgtttgcaccccaccctgtctgcagggctggcctcccacagcagtgtgtggtatcctacagatcactattaaataaacagtcccttgaaatcacaacattaaaaagtgctgtctatgtattgtaccaggagagccaaatattatggaaaaggccaaatatttccactgtgttaagaaaataagaacccagcagcatggaacttcccactcagtaggcaaaagatgtggtggagacttcaaaagggtggaagaaccatcaagacagcttgagctgcaacgggtgactgccccattaaaaaaagcaagtgtgtgtgtattccagatgcagctgcagaaatcgcaacaccacctttcaactgggaaataaatgaatgcaccaacgtatgtatcgtggctcacccaagcaatcgtccaactgtgnctagggctgggggagaggttaggaggagagaggacgaagtacagaacacaaacagtctttgttctccaaagacccaaaaggcagattcacaggaagagattcctcatcctggtctgaaatgaagatagacacttggccatagggctgatggctctagcagaggccctgcccttgggatctcggcagnatctcagccaggagggctccctgactctggaagtggaatattgagtgataagaagtttggcttctcccacccactttccaccaccaggtagagcttgtgaagcctgaaaagtctgtagggccaagcagcctgactttcatggaaggagacccaggagtcaacttgttttaattaaaaagttaggttgggttatctcagggccacccccagggagggtgatgcttccaagctgaccaaattctgagctgctgagctgcttactttaatgagcttggggaagctcatttgaggagtggtggtaaaatcgctcactggacttgcaacatgagaatgttgttcatgaatcatcaggaagaactcccaggtgtggagaatggactcttgttccttcagctgatttgggacctggcactcacactcgcttactaactttctctccctagcgtaagcattcgcttcctgcctagagtctggctacctacccatcatccccattacccaaaatacaaaaacagagaactgtagcatcttattacgtagactttcctctctcccaaaagatgtgccagtgcccctgcctgccgtgccaggccctgcagggatgatgatcatggtctccagcatttacngagctgtaattctgcacagggaaccaggccaggctctgtgcaccttcctagagcctcacagcagtcctctgcggggcacgactgttctcatccactcttgtcatccccgttttacagctgaggaaccagtggctctggcaggtgttgggacgtctgcccatggtcacgtagactgtgtggcagagccggaattcaaatctaggccccatgacttcagtactgctctatctgaggactatgcagagatggcatagcccctccttcaaaagctcatagtctagttgtagagagcagagctccttgcatggacaaataatccaccaggcccagcagaactgggtaccacaaaccgcatgggatgtctaggaaggggctggaaggaagtcacggtgcactgagaatgtggtgtgccaggcggtgtgctatgtacctatgtgtccatgacctctttaattctcaaagcactcctgtgaggttcactttacaaatacaggactgaggctcagagagtcatgtagcttgcccaacaccacacagctcatgggtggtggagctgggcctgaacccacatgtctttctaactccaaaccacattctctttgcatgataccatgatagacactccatttcngtagtgttaccgggagtgaaggccttgaaggatgggtgagaggtgagaagggagaaaggagggagtgggcattccaggctgagggaaaggaagaggagtgggcctgaggagcagcaggaattccaccagccccgcccagaagtggcccagtttttatcaccatcccaaatacatcgccttggtgtacatgaacttgctgagggcctagtttccatggctccgaagaggtgacatctccctcccacccctcatccaccctgagctccctggctgatttattcaatgtggtcatctgcaatggttgtggacctgtcaggatgacagattcgcctggggacatcctcctgtggaaggaactggattcatcccttgatcacttccatgccctgtgggtctctccctacctcttgctcattctacgagttatccctccattagccgggccgaagcatcctccaggcagggtttcctaattacctaatggtgaccatgctaccctttgccaaccttatgaaaagcatggccatgtccgttatctcatctgatcttttgctcttccaaccagcatttattaagtgcctactgtgtgccacacaccatatcaggngctgaagattcacgggtgaaccaaaacaatttcatgcctggagagaagggaggttacagagtagctgagatgactgacattaaccagaattacaaagtgcccggctctaaaatgtgctccgggacctggaaggaattacactcactagggggaaaattctagcatggacagccagttccatcagaatcctgggatcctctgtctcctaggatctgcatgtttctcagtagatctgaagctgtttgatcacctgcaggagctggggagtctgctggaggcctgggatggagttctgggcttagtctggagagaatatgtaaacaggtgcagcctccttaaggaaacctgagaggcagcaccacacagtggaaagaacagttttggagtccaacagacctggacatgcatctgggtttatatctgtgtgaccttaggcaagtcaccgaacctctctgagcccaagtatcctcacttggagaatagggatgatgatagcatggatgtgcctgaaatgcccagccaggagcccaacacatggtgacctgagcaaacatgggcatctttattagctagaggtcatgaaactctggatgtgcaaagcaggccaatttgtgatttgtttaatttacaagatttctcattttatgagaaaacttgctgacaatactttcatattgggagctcctcttaggtttgaaaaataaaataattggccgtgcacggtggctcacgcctgtaatcccagcactttgggaggccgaggtgggccgatcacgaggtcaggagattgagaccatcctggctaacatggtgaaaccctatctctactaaaaacacaaaaaattagccgggcgtggtggcaggagcctgtagtcccagctactcaggaggctgaggcaggagaatggcgagaacccgggaggtggagcttgcggtgagccgagattgcgccactgcatcccagcctgggtgacagagcgagactccgtctc

SEQ ID NO: 240159 - DNA, 483 bp, Homo sapiens
tggagtggcttcgaaagcggccgaggcagccgaagccgctttcgaagttagcaaacaaagcgtctccccagtaaccgcccggttccagacgaggctcctgccactcaggccgcggagtcgcagcgtcgcccagcccccggctcctcctccctgcgtctctcctccctccgctcccggctccccagcggataggagccaccaatcccagccacagacaacccttcaaacgaaatagcgaggcggccccctctaacgggcggcgggggcgctggccccctccctgcgccacatctgtcccgcaccgggcgcagcagctgattcatctgcagccaggtccgggaaggaactgtgctcccggcagttgcagggcagcgtccgggcgggtggcttgtccccaggaccgcgctccccccgagccgttttaggtgtgtgttctcttctgtcccgagcagtcagcaaaccacagaagaaaaaaatcgtaag

SEQ ID NO: 240160 - DNA, 392 bp, Homo sapiens
tgtgctgtataattccatttatataaaactgtagaaaatccaaattaatctgtagtaacagaaagcagatcacttctttcttaagggggaggaaaaactacatagagcacaagggaacgtttaggagagatgtacaggatcattattttgattgtagtaatgtttccactgacatatatatttcatcacgtctttcaaccgtgtcgcttattgaacgtcaattatataataataaaaattttttaaatcagaataaaagaaatctattaataaggttcttaaaaagattaaatgatatacattgggtgctgttatggactgaattgtgttatcccaaaatttgaatattgaagccctagtctgaaataagactgtatttggagataggtcct

SEQ ID NO: 240161 - DNA, 399 bp, Homo sapiens
gaaacacaaaagaaaaaaatattctataattgtacatatatgaagcacctagagtcgtcaaattcatagagacggaaggtggaatggtggttgtcaggggctgtggggagaaagaaatggggagtttggaaatagagtttcagtggcacaagaaaccacttcagtggaggttagttcacaacaatgggaatatatttaacagtactgaactgtacacacaaaaatggttaaggctacgcatggtggtgtgtacctgtaatcccagcactttgggaggctgaggcagatggatcacttgaggccaggagtctgagaccagcctggccaacatggagaaaccctgtctccactaaaaatacaaaaattagctgggcatggtggtgtgcacctgtaatccca

SEQ ID NO: 240162 - DNA, 277 bp, Homo sapiens
gtgggaaagacagattttcgaaacgtggccatttttctttgggcctttgttagctgcatcagatggaggaggtagcctggtggactccttcagtcctcgctcttggacacagagctgtctcccagcctttgttgttgttttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatga

SEQ ID NO: 240163 - DNA, 704 bp, Homo sapiens
gccaaatgtattgcctaattgcagtagggctttcatccctggttttgacccagttgtttttagtgaatttttctcctgcctctttagaaaaggaattgaggttgctcgtacacatgcaccccagtgaagcaaggtgtttttagtaggggataaaggggacatatgggtcatgttacaaggtgaagctcaagaagaattagtgcctgtaaaggttaccaagaaatcccacaacactgttaaaggttctgaccatcctggcatccaaagcaaagaggagaatgccccttgcaggattaacactatcctaaataaaataatcacggctaacttttatagtacttagtgtgagttgagtgactttcccaaggtcttggagctcgcctattacatacatggcagagccaaatttgaacccaggtagcctggctgtggagcctgtactcttaccactatgctgtccttcctcccttacagacagtttacagccttttgacaggagacgtacagcctcttctggcacaaggtctgagaaaagtatcttcgaagtcccttcaggatgtcactgggtgaccaccatgaaccatgtccccaatggatcctttgattaattcagaccaccagaaagccaactattctgattgcattggtttgggcactgtggaatcgtttgatccaagagacaaaaaagggctaaaagttttatt

SEQ ID NO: 240164 - DNA, 286 bp, Homo sapiens
tccatagtgctaaggagaagaaaccctgtcctagggtcaaggttggatgctgacaagactaatttcaagtgatttcaaacgattgtggggaaaatacccagaagttgacaggagcaatatgtagatatttccttctgtaaattatatttccctaatgctaatgctggagcatttggaaacacgtgtataaatatttgaagcacaaaaccagagagatgctcttatgtatttagcttctagttttaaataatagatactacaataaaccttgattaaaccttgatta

SEQ ID NO: 240165 - DNA, 371 bp, Homo sapiens
ccttgcagagcagggctaactcataggcagtgtgcctgtaggcagcctgtttggacttccttaaacactttttttttcttaaatagagacaggttcttgctatgtaacaggtgaagctgggaatagcccttcctagaatgctgaggtgggaggatcacttgagcccaggagttcgagaccagcctgggcaacatagtgagacctcattgttacaaaaaaaaaaaaaaaaaagacaaaagaaaaattagtcaggtgtggtgatgtgcacctgtagttccagctactagggaggctgaggtgggagaatctcttgagcccaagagattgaggctgcagtgagccattattgcaccattgtactctagcctagg

SEQ ID NO: 240166 - DNA, 507 bp, Homo sapiens
agaggtgctgcattccctctgacgattgctcccagcaggtgtccacaaggcagactggactcaaggacatgcaggaagatggctgcagtgtccagtgttattcatccacaaaatgcagcaagtgaagtcgtgagcagaaagcacgggccatccaacctacatgtgggcgaaccgtggtgactacagggaaacaaatgcctttgcaagagccaaagctcccaagtggtctagtccacaagtggggatcttgcaagtctgaccctacagctgtgctttctgtactcaggtctggctgtttctccatcattttaaacatgttgcttccgtgaagcaccagtttgtggttttcatgagactacagcagcctgccaccctctttgagaaccaggccacttctgctcctctatttcaaaattaactttaaattacatattgattccagccctatgaaatttagcaaacagtgcattacatttaaataaattataataatcaagctccagtgtt

SEQ ID NO: 240167 - DNA, 242 bp, Homo sapiens
ctcctcccaccccactaaattagggatgacatcattctttaagtatacaagatggcttgcttcttcacaacaactaaaacaaataggcacagccctagaactccaccagaattatttctataaattaaatgttcccatctgttcccctgcactttaactcctacacagctaagcttctaagcagtttccatttcactctaagtttaagacacatatttactataatagcagtcagcttaata

SEQ ID NO: 240168 - DNA, 270 bp, Homo sapiens
tggtccttgtgcccctccctcagaaaattctggaactgcccttggatccctctaatggctttctgtcatggtctgaaaaggcttatcaacttattaactttaaattgttgaaaagggccaggcgcggtggctcacgcctgtaaccccagcactttgggaggccgaggcaggaggatcactgaagcccagagttcaaggctgcagtgagctatgatcgtgcccaccactgcacttcagcctgggctacagagcaagaccctgtctctttaa

SEQ ID NO: 240169 - DNA, 617 bp, Homo sapiens
aaaaagatctttgcttttaaaaaaagtgtttatcactgcggcctctgatctattagtagttcctgacccatcagatccattcagtggctcatgtgcagctttcataaaataaaataaacttgataagagtggaaaataatcttgtcttgtacagaaaaagttgttttttgaaacttttttcatgtatgtgactgtatgttctgagtcacagcataaagtgtaatttttactgtgggcaatacatatcggagaagttttaaaaaggatgctgaacaagatcatttcttcagcctcatgattctcagcatgtattgagtgcttaggggtatggaaaagtggggaaagtggagatgtgggttcaagtgccagctttgccattaacaggcgtaaggaagttgtgctgtctgctggcatctctacttcctcatctatgaaatggggcatgggatacatggttttaggtatgtaagttccgttagcccttgattccagcttttaaattgagaagttaaacacccatgactttccaccttacagattgtaaaactgatgttgaataagtttacataacctgaaacttcttacctccttcatcatgcaaaccaagtgaaccaaaa

SEQ ID NO: 240170 - DNA, 174 bp, Homo sapiens
agactcaaatgattgtcccacctcaccttcccgagtagctgggcccacaggcacaagccaccatgcctagctaatgtttcttttttttgagagacagagtctcgctctgttgcggtgagctgagattgggcccctgccctccaacctgagcggcagagccgggctccctctcca

SEQ ID NO: 240171 - DNA, 1857 bp, Homo sapiens
  misc_feature (116)..(116): n is a, c, g, or t
  misc_feature (719)..(719): n is a, c, g, or t
aaaacgtacttagggccattaggatcacatcaaaatatagtgcatggtaattatgcatgaaatagaaggttacctgctgtttaagtagctagtttcttgataatgttgcaataaantattgagagaaaattggtttctcaatagcagtggaacaccttgtttaagggacaaagtgaactgcattaggctgaaaaacgaaaagggggaaaataaaaatagattttatcatcaaagttgtcagtggatattgttctcagtcttaaagaattatttttagtctttcccttcatcaaaatggagaattatttgtttgcatgtagattgtggtagagttggtatgtttcagatttaatgaaatgcagaacagaataaatccctcgggaaagaaaggaaagaggggatacgccagacttagtatatgagagtagtcaaaagcctggctttaaaagtcaaagaaaccccaaagttgacacctggtccctatgctaactagctgtgtgacctcctccatgttacttaacctttccgacctcccagtttctttagtagcaaaatggagatgttattattaatataacagaccttgttgaaaagatgaaatgagacattgtatgtaaagcactttaggaggacatgtctgtcacatggctgtgctaaattagatgttattatcctgtcaacaggctgaatagcaagggggaaaagttctaaactttggnatcctgtcgtaatacacacagagatctcattccttgtgaaagaatcctcgttttggaatgggatgctgccttggggaactgccatgacaaggatatgaagttacaactgtgatggtggtcctttgaagaatatgtggagacttttctctatattggattattatatttttacttttgggaaataattacactttgaatcgtttcatgattatttggctaacaaaacaggtgatttctgtgagtatatatatgtatatgtgcgtgtgtatatatgtgtgtgtgtgtgtgtgtatatgcatgtatgtgtttatttatttattttaccatggacatgcccttgatgaaaaagaaatactttgcttggttattcctccaagtggaaatttggacattaccctttgttcatggtggggaagatttttagttattccacatatcagaattatctacgtgaatagttagcacataattaggattaaaaagtaactagttgcagaaaactcattattttttctaattctaagaaagtagcttcattttgggtattagagaaaagctcaagagattcactgattaatatgtattgagcctgttacatagctgacaatgtgctagtgttttcacagtttctatctaacttacaaaataactgaaagaggaagaaaaatattctattccatatgtattagaaaactatcctttaagttctaaagttggcttatgatctcctgaattgcacaatatttatctgcaaaccttgaaactatttaatcagagacttctgaccccaaaatgccaacattactcttggtggtctttcaaggtaattcccccttgtttttagtgtatccattgaaacactaaatggaaatatttagtgccctgatgctaagggaatattccaactagcggcactgattccactccaggttattaattaaacagtagcaatcagcccatctgatctttaatattctattgctgctgactgatgcccagacatcagacattttgtaatctaatacaaaattgctctgtgcttaggactaaagaaaaacaacacataatttatactatgttttatctttattttcaagttccagaggatacgctggttgtgtctttcaatgattaactt

SEQ ID NO: 240172 - DNA, 363 bp, Homo sapiens
aggctatgtgtttaagaaacataaatgaaatttatgtttagacttgggtcccatcgaaatccgaaacacttctgatccaagcattttatgtagggatactcaacttgcagcagtcattcaccattcctccctacccccagccaccagtaatctactttcctttattatggatttgcctattctgcacattatatataaataggaatcataaactatatggtcatttgtgattggcttccttcatgttttcttcaagtttcaactatgttgtagcatggatcagtagttcatttctttttattgtcaaataatattccgttgtgtagacataccatattttgtttatccattcatctatcaata

SEQ ID NO: 240173 - DNA, 533 bp, Homo sapiens
ctccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcagatgatgatttcacaggtgatatatggcaaaagtggccaaa

SEQ ID NO: 240174 - DNA, 489 bp, Homo sapiens
cagtgttgtaccttttaaaagagcttagaatgctaggatgattcttacccttgcaatttcaactgcagattttgtatttttattaagacacgaaacaaatttccattcatttttactaatatgtagatattttgcagaattcttttgtgttcatgggatacataaagtttgagtatggacattggaagcatacaggtctgagtttgaatctcagttctgtcacctgttgcttgggtaactcacctgagttcacagctttagtttatctgaaaaggactgtgtcttaatctgtatgttctccttggcatgtggcccagtcaccgttacatagtgggcatttgtttattccacaaatgtctgttgctcatatactgtgtgccaagcactgtcttaggtaatagagatacaagtaatcatacaaataaatatgaaaaatgaaccaataagtattgtgaaggagaagtatgggtgctatgatagtttataata

SEQ ID NO: 240175 - DNA, 406 bp, Homo sapiens
tcgaactcccgacctcaggtgattcacctgcctcggcctcccaaagtgctgggattacaggcatgagccaccgtgcccggcagaaagtcttttttaaattcccacttcctctttaattgagaaagaagtagctgcagatttgtccccaatccaaacaagaaggctcatcactgccccctgcgggtcctgttgggcataccccaatgcactgggccatgccctggtgccatgccaggcctctgtgatatccctgaggaccaagatatgattatatctgactcaaagtcagatagccagtcttggaatcccagctttacgactgaggttatgagacttgggcctcccttctgtaaaatggagatgatagtattacctgtttgtgagtaaagtctttggcacagaaaca

SEQ ID NO: 240176 - DNA, 495 bp, Homo sapiens
gctggtcttgaactcctgggctcaaacaaccctcctgcctcagcctccagaagtgctgggattccgggggggcccaattccgagccccccccccccccgaatctgtcctcaccaaaagaagaagaaaactttgcatctgaggttgcgactgagcaaacagaacattaacttagggaaatttctccgtccgtgcattaactgaaggaaactgccgtgttgctctctgcactatttagagagaatgtgagttaggaactgttggaagagacatgaatagatatgaaatttttgtcatgacaaaactaatgctgtgttaataagaaacagatgaaggacccatctgtttcattcctttctcttcttaagaggatatagccgaattatggttaagtaaccctgaggacagttacatgatagcctttctcatgtcaaatgtgtggaaagagagtgtgaggtcgaagtttcaggtattgtaaataaatatcttgtgacctg

SEQ ID NO: 240177 - DNA, 402 bp, Homo sapiens
ttttttgttttccagtcccattttccactgctttggtcagggagtgagtcccctgatgtcatccgaggatatgaggcatcgctaaatctggccatcccctgaagcacccagcctcaccgacttcctgaagcgtggatgaacgctgctgccacaaatgtgctgtgacaaccgctgacaaggagagtgagtgatgtttgtgccatcctgctgagcacgagggagctgcttggggaagccaggggctggggcatctcaatagcactgagggcagcctcgggggggcttcacagcacacccacccccagatcactgctgattctgggggatgcatgacagagctttctgaccttgcacttccctttggctgctaaactgaatgaagcctccttcttagacccaacc

SEQ ID NO: 240178 - DNA, 481 bp, Homo sapiens
gttccccaggctggagtacagtggtgcaatcttgagtcactgcagcctctgcctcccaggttcaagcgattctcctgcctcagcctcccaagtagctgggattacaggcgtatgccactatgcacagctaatttttgtatttttagtagagatgggtttttaccatattggccaggctggtcttgaactcaagtgacccacccacctgggcctcccaaagtgctgggattacaggcgtgagccaccacgcccagcctaatgtgattattgatacagttggtttaaatctgctatcttggtattcattttttattctattctttattccccttttcctcttattctttcttttagattatacattttcctatgattccattttatcctcctgtgttagctttattagatttagagtttatagcatacatctttaacttatcatagtgtactcagcagtatatttcccttctcccttcttagc

SEQ ID NO: 240179 - DNA, 360 bp, Homo sapiens
gcagtctccagagacaacactggagccatcgtaggtgagtccgacttccccagtgaactggctcaaggacctccctttctgtgactcttcaaaggtgtggttcaaacagaagagcacgttttaaatccaatgacactgaagtatgagcttcatatattgtttcagataaaaatggcttcttaacatatatattatttattaaaattaaaaccaaactaaatagttcatgcaatgtatagaaactaaactaatagatctttgcttttcttaaacaataagcttgattaggatgtctgtttttacacctaataaagcttttggctagcacctaatgcattaaataagaaggatttttacatt

SEQ ID NO: 240180 - DNA, 465 bp, Homo sapiens
tacactcatatgtgaaagaaacttgatagagatttttctaaatttgatgataattacaaagatttgcacaatattaccaataacaagttgtaaaactgaaagaaatttttctacactatcaaaatttttttaaaaatctatcaaccatgctaaaggaaagactagtccatttctatattctctttatagaaaattctgttacaaaattagtgttatatatagagaggtgattaaagagtatgaccttaaagtacaaaggaaaaagtgttatagagatatgtacaattagttaataagatacattttttgattttgttatctttttgtgatgcattgttaactttttaaaatttgtaatttgtagtgactttctcattcaaagtaaacatttgtatgtatttcacacagagtcctgaaatgctgaaagtacagatgcaataaaattaggtattgattgaaatactc

SEQ ID NO: 240181 - DNA, 629 bp, Homo sapiens
aaataatggcaaatgtgatattggatttagggttacatttatagataatatgttagaaaccataattttatatttctctttcccacttataatgggaattaagtatgttcattttagcttttctataataaataccagcttagtctaccacagcaaataaactttttttaaaaaagcagcaacaacaaaatacttcactgtactcttttcttggtttattgagatattaataaactgatagttttgtctcatcaaatattcttttgttctgaaacactgatgcatttattttggcttctgaagttttataagaacatgttatttggggagtattgatgccaactttattgaaaacacttattttactaagctaatgactaagctaattgactaagatgcaggattatagtaacctggttgatttcactacattcttccttacaaagcagaaggtgaaatggaaattttggaggaggtggagtgagatttgtatgtcacaatctattttcacaggatgcagtgccttcgttttcattatactttcagtatggttgacttcttaaactagtttgaagatttagaatttgaaatgagaatatatgattagaaaatacaggagctgtgcattt

SEQ ID NO: 240182 - DNA, 331 bp, Homo sapiens
ccctgtaaatagagtctgtagcaaaataagagctgcttcctccaacttatcacaagtcgccgttggtcctctctaaggagggctctcttctgagttcattgtacaatagttggaaacgtggtgatgtgctgttcgtttatagaaagctgactttttataaatatatatatatactaaaaaaggaaagaaatcccccacagtgtgtgtcgtgctagtgccagagaccatctgtagggatatatcttcatattgtgtgtttcaaattatgcattccaggctctagtgggttctttcaatcttgttcctttatttttttcatttggtatttctc

SEQ ID NO: 240183 - DNA, 315 bp, Homo sapiens
gatcccagctgaaatggcacattctatttgtcatcacatctccttaggctcctcttggctatgatagtttctctttccctgtttttgataaccttgatagcttcaaggagtgctgatcaggtaattggcagaatgcccctctagtggaatttattccatattgctttttaattatttacttgtatgtatttctcccatattttcctatgatgttttgaagggaaagaccaagtcatctgtgtatctccaacacttagcattcaataaatatctgttgagtgaataaataaatgggtgaaaagtgaataaaactga

SEQ ID NO: 240184 - DNA, 759 bp, Homo sapiens
cccttccatgtatacatcagtcactgttctgctgctattgctaccttttctacctcttaatatggaattcttgaagagatttacaggaagtggaaagaaatacacgctcccaaatggcttgagtttaaaacatatgtcttaatgatagaaaagaatcatatccctggagtttctagatgttattgtattcctattatttcaaaaatatatttttgaaaaattaatgtttcccagttaaactaagtacatgttcactttaagaaattttgctgtgaaagccagaaaaaaaatcctctgaaatttcactacccataagcagcttaccatgtttcgtcttttggatgttggtttttttttttttttttttttttttggggagtccaaaatcaactttttttttttgagacagagtctcactttgtcaccaaggctggagcacagttcagtatctcggctcactgcaacctccacctcctgggtttaagtgattcttgtgcctcatcctcctgaatagctgggactacaggcattcaccaccacacccagctaatttttgtatttttagtagaaactgggttttaccattttggccaggctggtctcgaactcctgacttcaagtggtctgtctgccttggccttccaaagtgttgggattacaggcatgagccaccatgcctggccccaaaatcaaattttaaaaaattgttttaaacataccaaaggtagctatccatgctatcctttctagctaaacata

SEQ ID NO: 240185 - DNA, 355 bp, Homo sapiens
gtatatttggggctagaatttaccccagaacttatttataacttttagttcctctctacatgagttccttagcagtgagttcaataaatgttttggtataaggccaccctggttcaaagaggagaaggctgttgtccttgcttctctgcggtgccttcttcctcccaggccctcagacctgcctctattaagtgggagaagggaggcctgggtaggtaggtcccagatcttcagattgcccggggaatgggtctggagtcctctaggcgttgttgtaagcattttgctgggcctttaatgtaactttccagtacaaatgatctctctttaaaataaaacaaaaaagctaagctta

SEQ ID NO: 240186 - DNA, 370 bp, Homo sapiens
ggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagt

SEQ ID NO: 240187 - DNA, 386 bp, Homo sapiens
tggcccagtgctgtctttgcccctgcttctacctcctcacccaagggtgtacactccacagggtgtgcaggaagcatgacgcaggcatctgcacggcttcctggtgctgcctccgtggccctctgtggcactgtgtgatgccttgtcttggaattgtaagtaatcaattctttctttctatgtcatcagtcacccccataaattaacatccctgcttcaatcattgaggctggggggtttgatcaggaaggagcatgcagagtgtcgggggtaacagcagtattctatttcttaaatggattggtgagttcaagggtatttattgttattcttcagactgtacatatatgcctttgtctctatggcatgttccacaataaaaatga

SEQ ID NO: 240188 - DNA, 170 bp, Homo sapiens
cagccgcccagggaggaggaggctgggctaatgcagcccttagtcagcagctgggctcggttttgaaacaaaagccaatgtcctccctcggagtccgcggccggtcagctcctagggggaagaaagccatgctgcccagccggttagtggcccaacttacttttccagag

SEQ ID NO: 240189 - DNA, 434 bp, Homo sapiens
gagagctaaaggctacataataagttgtgagcctacctagggtattagcagaggtgtcccaaggaagctccctgtgagccaaaccccaaaggatgggtggaaattagctcaactaagtggagaggtgggatagtcatgggccaacgccccaaggcaggaaagaataggcctggtctgtgggtctgagaggatggagagggctgaacacgggccaaaggagaaagttagggagggaaggtggagtccctggcaggggctcagctcagaacagggggagccccaaaggatgtgaggcaagggagcaatgaacaaatctcaccattgtgagatctgaaattcagaacggtggcataggccagagtaggacattgtgaaaaagaaacaattagagaagcagaaagagtgcttggaaatgtcaattatgctgctgaatt

SEQ ID NO: 240190 - DNA, 481 bp, Homo sapiens
tggttgagaaggtggggctgcaaggtcatgttctttagtggggatccatccacatggaaaaatgaagctggtgtaaaagagggtttccctaatatcattgattacacctcatctgctacattatctttcaaaacaaaacgactctgtgaggtaaatagtggtatctccattttatagctgtaaaaactgaggcttagaaaagataagtgatgggtcgggcgtggtggctcacacctgtaatcccagcactttgggacactgaggtgggtggatcacgtgaggtcaggagttcgagaccagcctggccaacatggcgaaaccctgtctctactaaaaatacaaaaattagcagggcatggcagcaggtgcctgtaatcccagctacagggaggctgaggcaggagaatcgcttgaacctgggaggcagaggttgcagtgagctgagatcgtgccattgcactccagcctgggcaacaacagc

SEQ ID NO: 240191 - DNA, 476 bp, Homo sapiens
cttacatggcaaatggaactttgcagaagtgactatgtttaaggatcttgaaacagggagattattcaggtggccccaatctaataatctgaattcttatacttggagaatctttccagtctttagtcagagaaagagatgtgacgatggtagcagactcagacacgtgcttcatcactggctttgaagaaggaagaagaaggctgcaggccaaggaatgcggctaccctctagaagctgcaaaggcaagaatggtttctcctctagagcctccagaaaaagcccaggctagctgacaccttgattttagtccaatgaaaactgtgtcaggtgtctgacttccagaactgtaagataacaaattttgttgttttaacccactaagtttgtggtactttgttatagcagtaatagaaaactaatacagttttgttgttaaactatacaagatttaaaaaatatattgttaacatgca

SEQ ID NO: 240192 - DNA, 419 bp, Homo sapiens
tcttttcttctcttcttttccttctatactggttgaagtattttaggatgtttaccttagcatctagctataacattgtttttgtttgcctcaatgtgaagagagggtgatacttggtgacagtccattacaaatgtgaacctaaggctgggtgcagtggctcacgcctgcaattctagcactttgggaggctgaggcaggtggattgcttgagtttgagaccagccagggcaacatggcaaaatcctgtttctataaaaaatacaaaaaattagctgggtgtggtggcgcgcacctatagttctagctacttgggaggctgaagcgagaggatggcttgagcccaggaggtggaggttgcagtaagctgagatcatgtcactgcatccagcctggacaacagagccagactctgtctc

SEQ ID NO: 240193 - DNA, 2121 bp, Homo sapiens
ggttaatggaggaagagatggaaggctcgtgccatgatttggtactgggtcatctgactgtccatgcagttagctacgcattctgcagacttcctccatccccagctcccacagttacaaaaagttctttcctgctctgagttctgaaatgctcacattcccagctccaagaggattcccaaaatgaatgtttaccttctcttacagttcagtctagccttcacatcttgggaggggttagagggggcagaggaaaggaactttagctgcctaggtgcagtttaaagagggtctaggtactgtggctctcagcagcctttgaccctggggccactctcttcatcttatggaggacaaggcctttggttccctggaggttcactgaaaatcactgacatgaggcagattgattaataggataaaagtcacacaaatttatttaatgtgagtacacatgaaccttcaaaatgaagacccaaagacacaggggaaattgtccatttttatggttgggtacaacaaagtatggacagccatgtagaaatatgattgaacaaaaagggtatgatctaatgctaatagactgagtggggaaaccaagcaaggcctgcctgtctggattcttcttggcctctctgagcatgcattcctctgtgaacccagaaaatctgagacagctctcagtccagaaagtttattttgccaagtttgagggccagcctgtgacacaacctcaggaagtcctgatgacatgtgcccaaggtggccggggcacagcttggttttatacattttagggagacatgagacaccaatcaatatatgtaagaagtacattagctctatccagaaagatggagacaactcaaaccaagccccctaccttccaggtcacaggtagctgacagacagatggctgcattcttttgagtttctgataagtctttccaaaggagacaatcagaatatgcatctatctttgttatctctgtgagcagagggatgactctgaatagaatgggaggccctgagcggttcccagcttgaaggggcccaagatattttcttttcacaccttccttctggatgtggggcaggaccctctctggaacaacgtagaacagatcatttctttatggtcagtttttacacagaaagatgaagagaaaattagagtaatgattttaggtttcatggctgactttgggaaaagggggttctggtttatacggctgccttggagaaggggaattctagttcctagttcctatggcttgccttgtgggacaatgagactgagacaggagggcaagagaagatcagagaaaaacttttgcttctggggcagtatctatatctatctctctatccatctacatatctatactggttgaattgaagtggtagtcattataacaatctttcaactattctgcatgcctgaaaatctgtataataaaaagttgggggaaacgctttaaaggctgccccgtgacaacatggattacctctttctctatttccctaatattgtgcattatcaacaacttaatcacatttcattgtaattatgtgctaagaaactttctcccataggctgtgtaaaagtacagtagctgcacacagtaggcactcaataactgcttgcatgcctgaatatcctctcctatgaggctgtccttgagaattaataagccaccggagtgggaagacgccagagttaaccatacactaccctttgatgcttcattcttcataacacagaagctcatgagcgagcacaggaaaggcgccgtggctgggaggaaagacaataaatggctatggactgaatgacagctcagtttaaaactcaggagatccagcctctgtggtcatatgattaactggctgtgtgaccatgtccaaacactaacctctctgtgcctctgttttctcacttgcaaacagggagtaataatgtgtcttggccaataagtggagaaaagtgttttgaggccgggcgcggtggctcaagcctgtaaccttagcactttgggaggccgaggcgagcggaccgcctgagctccagagttcaacaccagcctgggcaacacggtgaaacccgctctctactaaaat

SEQ ID NO: 240194 - DNA, 1907 bp, Homo sapiens
  misc_feature (631)..(631): n is a, c, g, or t
  misc_feature (1354)..(1354): n is a, c, g, or t
  misc_feature (1700)..(1700): n is a, c, g, or t
  misc_feature (1816)..(1816): n is a, c, g, or t
  misc_feature (1902)..(1902): n is a, c, g, or t
atataaaactcttcagaacagcacagggtgatttgggtatagctatctccagataccttggcccttgttcttggagttttaggaattcagagaaaggaagaaaggatctgaaggacctagtgaagactctccttgaggccactcatttcagggaagcgaagggaagagggtgggagaagtagcttttgttgtgtacccaacagaccagaaatctataatacaatatctttttcaagcctcatgattggctgagttttacaaatgaggaaattaaggacagagaagtaaagtaagtcatccaaggtcacacagcaaggaggtggcagagccaagaatcgacccaggcgggtcagattcaagcttgcgttcctgtcactaggcataggacaggaagtggggtggtaagatgtcacccctaggccaagggggcagtggtttaaatgggggctcaggtcagaaaagcatcctatctatggtaatgcgggaacctggctttgttctgatactgaactcagatctgagacgccacccaggtgtatgttatatgggttctgagaggtccagcagcaagcagggcagttgggcccaccccagagcagctgtacgcccttggagatggcctgaaattggncaagctctggaatgagggtctgggcattgctcccagcatctgaccttggaaggaagcagaagcagagctgtggttttgaagattttccttccccaacggagacccattgcagcctgttatgaaggacccagcacaggtagagagagccaacaaggtggaatggggggctctggcttggtgagatgggggaggagaaagaggggtcactcctgccaagctgacctcagctgggtaatgtgatcagcctgtcatggttctgagccctgatttgggaagaacaaagaggccaggcccctctgcctcctctagcccaggaatgcagctgggggccaggccgtgaccaatggggaatgcaggttgggagcgcagcgaatgcagtttgtagagcaaggctttcatgcactgatgggagccccactcacaaagccaggctgacatgcccccgcgcttccaactttgatatcccagccccgccttgggggagccgcacatccccaagctgtctgtgcccaactgccccgctgtggccctcgagtgatgatggggtgaagagtggagagctcagatcccaactcccctcaaccccaccaggattcctagacaccaacatctccttgtccgtctctctccacctcgggatgtctgaggaatggacagggggaaacagcctccagctcctgagggctgagagagatggatggagagacagaaagatggaccacnagagaggccgcgggcctcaggcagcccctgctctgagcaggtcacagaaactccttgaggccacccactccagggaaatgaataatgttagaggtgggggtttcactcctggcttggacatctgaatactttctgcattccaaagctgctagctccccttctccagccccagtctcttttcccactggccgattcactcagtgtggggtccttcaggactgcccttttctgccttctcaattatccactgccccctccctcctggtgtctctgtgctcctgcgcttcctctcctcctgggtgttaataatgacagtgctttacagtttacaaagcacaatcacctncagtaactcgtttgattcttataggagccctgtgcagcagggactctgatcctcattgcatgcaggaagagaagaaggaagaggaggtggaggcttgatgaggaggtggtggcctntgatggcaagagtgagatggggagaatgtccagcgggagaagtaagggccaggagcttgaaggaactgtgaaataaagatatttcnccttg

SEQ ID NO: 240195 - DNA, 1061 bp, Homo sapiens
ttttttttcttttcagtactttgaaaattgtcattccactgtcttttcacctgcattgtttccagtgaaaaatctgtcatcctcatctttgttcctctgtatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctggtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctaattaagatgttcaatctttcttctaactttttgaacacttggaatatagttataataactactgcaatgtccttgtctgttaattctaacatcttctggttcagtttttattggtatttatcttcattgtgagttatatttccttgcttctttgcataactgaacatttttgattggatgccagac

SEQ ID NO: 240196 - DNA, 159 bp, Homo sapiens
gagttagaattgagaactccacagagggctttatgtgtccccaggaaggtactgtgagcttattgacaaggaagctggattcaagggcagggaggaaacaccttgttagtagatagagcagaatttgatatgttggatttcattttatggttttaggat

SEQ ID NO: 240197 - DNA, 478 bp, Homo sapiens
gagtcagagatagagaatcactttactaaagttacattttacctaaattcatggatgtttccagaaaaatatgatgacttccaaggagtctattagaatgaatccacacatactttcggaaaaatgctaagggccatgcactaatactatctctgtttcattgtttgagaagaacttcaacatgaatgctgttcactcttttccctagttagagactaagctaggcttttcgtactaggtttaagaagctaaatcgctgtataatacttcccagattcaggactgaaacatttaacttaaaacataaaaatgatttattgttgtgtctcctgtcttccctgataacttattaattgccacttgggctgaactgcactgtatttttatgcaaatcaaatcggcattccataatgttcctgcttcccaatggtaattataacagtttgtgttgcattaaaaaacagttttgccaagaatt

SEQ ID NO: 240198 - DNA, 492 bp, Homo sapiens
tcagggaattagtttcctcatctgtgaaatggggatcgtcttaccgattgcagggggttgtcgtgacgagattactttcagctcaacatagacatccacttgggaggtgctcagcctgccctttgggctcacccagccttcccgggaggactgagccctgtgagctagaacccaggacacccatgggatctcccgcacgacctgggcctggggcttcaagacagaatccctgtgactaaccctgggccccgagaagcagccttgccagccaagccagtgctgttctgagatgggctgcagacggggctgggggtcccagtgaagagctcctgccaggggctccgaggccgcctcagtttcttctgatgtcctctgctcaccccccacgcagagcctgcagcaaagaatttgtgatgtaatgaagcacctgctgcccctctctcccctacgaccctccttaaccaaaataaagactcctgaataagatcatga

SEQ ID NO: 240199 - DNA, 411 bp, Homo sapiens
cgcagccctcgcggctgctctctctctggagtagccattcttttattcctttacttttcctgataaacttgctttcactttacagacttgccctgaattatttgttgcacgagatcaaagaaccctctcttggggtctgggtcgggaccgcttttcagtaacatctttctggtgatcacggaagagactatagtgtggaaacacccgacccaaaggctaactttgagcccggtgtggtggcacgcacctgtaatcccagctactcaggaggctgaggcaggagaatcgcttgaaccccagcgacagaggttgcagtgagctgagatcgcaccactgcactccagcctgagcgacagagcaagactctgtctcaaaaacaacaacaacaaacaacaacaacaaaaaaccaaa

SEQ ID NO: 240200 - DNA, 410 bp, Homo sapiens
tgtttgtcatacattaacatcaacaacaaaacatcaaatgtgttataaacactaaggaaagtagttattatgaatttttttttccccaagccaccaccagaacctttgcagaaaggagagaattctcatttaagaaggtttgcttagtcgtcagtccaggaagtgtctttgtaggtatttgtcatctattttgtaggaacctttatggggctaccctgcagaaggttataagtccttctttctctgagtacaatttcttttcttttaggtttgttttctaactgaccttgacagcatttccaacaggcaaaattatgagttgtccctggagaagtgcttcatttcagacccaggttatagtacaagagacataatgaaactagaaaaaaaaaatagagagtcagccaaat

SEQ ID NO: 240201 - DNA, 591 bp, Homo sapiens
tgtcacccaggctggagtgcagtggtgccatcttagctcacagcaacctctgcctcctgggttcatgctattctcatgcctcagcctccggagttcctgggattacaggcgtgtgccaccacacccagctaatttttgtatttttagtagagatgtggtttcgccatgttggccaggctggtctcgaactcctgagctcaagtgattcacccgcctcagcctcccaaggtgctgggattccaggtatgagccaccgcgccctgccttcctttttttctttctctccctcctctcataccctccagccaccaacgaagcctggaacccattgcttttgcaatactatttttctatttcacatgtaggtatctggaacccctgccagaggcctccaaatttttagctacacaatctgtgccatgctgtggtcccttctgcctctcccagggtgatctggagagacagaaactgcagagccaggctgaaggatcagctctccttacccccaagatacttcagagaagcaaggatctttaacttttaaagaaattcaaaccagtgaaagagattccacatcagtggtcattaaca

SEQ ID NO: 240202 - DNA, 683 bp, Homo sapiens
actgattaaatacctgtaaataccgcaaggaagtttcacaagatagagtaggcaggagaatgaaatttcctgcgaccatgtacaatgtgtactccaccttagtaaagaaaacaaacaaataaaaaataatataaatcttacttacagaacaaataagggtctccaagctaacagtcacaacccaacaactcttgacctctgccttatccccaaccctccaagaaaaccctagaaagaaaagtagaaaggtggggcagggagaatacacacaggggaagatgttgatccaaggatacaaagttccagttagacaggagaaataagtttttgagatctattgcacagcctggtaactatagttaatatcaatgtaatgtatattttgaaattgctgagaaagtagattttaagtaatggttgtaccataaataaaggtgtgttaaatgatagatatattaattagtgtgatttaaccattctgtaaggcatacatacattggaatatcacattgtaccccataaatatatacagttattatttgtcaattaaaaatatatggaaagaaatcaagattaaaaataacagctttgttctgcctatcgacccagaaaggacttatagacatggacaaggttcagtgtgagcatacctggttcctggccttctggtcctggttctcggg

SEQ ID NO: 240203 - DNA, 623 bp, Homo sapiens
actgattaaatacctgtaaataccgcaaggaagtttcacaagatagagtaggcaggagaatgaaatttcctgcgaccatgtacaatgtgtactccaccttagtaaagaaaacaaacaaataaaaaataatataaatcttacttacagaacaaataagggtctccaagctaacagtcacaacccaacaactcttgacctctgccttatccccaaccctccaagaaaaccctagaaagaaaagtagaaaggtggggcagggagaatacacacaggggaagatgttgatccaaggatacaaagttccagttagacaggagaaataagtttttgagatctattgcacagcctggtaactatagttaatatcaatgtaatgtatattttgaaattgctgagaaagtagattttaagtaatggttgtaccataaataaaggtgtgttaaatgatagatatattaattagtgtgatttaaccattctgtaaggcatacatacattggaatatcacattgtaccccataaatatatacagttattatttgtcaattaaaaatatatggaaagaaatcaagattaaaaataacagctttgttctgcctataaaaccgtaagtccaattcagc

SEQ ID NO: 240204 - DNA, 468 bp, Homo sapiens
gtgcctggcacacgcagcagacattgagcaaatacattttttgaatgaatggggaaaaaacgttattgctagaacataattttgtagaaacgcagtaacttgaagttctgctctaacaaagagaaaataatttgctgttagcatgttgctgtggattttgtggccaatacttggtgcatcctgtgagactttcccaggaacatgggaatcagattgcctgggagaagcaaaccccagacctgcaaatagtgggtcagaacggaagtgtgctgttacctttaaaaagagcaagtgggctgggtgccatggcacacacctgtattcccagttacttgggaggttgaggcaagaggatcacttgaggccaggagtttgaggctgcagtgtgtctgtgaatagcctctgtgctccagcctaggcaacaaaacaagaccccctctctaaataaataaacaccccatctctaaa

SEQ ID NO: 240205 - DNA, 386 bp, Homo sapiens
cagtggtgcgatcccggtccactgcaacctccacttcccgggttcaagcgattcttctgcctcagcctcctgagtagctgggactacaggtgtacaccaccatgcctagctaatttttgtatttttagtagagacggggtttcaccctattagccaggctggtctagaactcctgaccacatgatgtgcccgccttggcctcccaaagtgctgggattacagctgtgagccatggcacctggccacacacgtctttttaaatttaaatgaggatgtggccatattacagcccaggttttctctgactttagagtaccttttgggacatagggccttcctctctaccctttctgtacacagccatcataaacctctttcaacaagcc

SEQ ID NO: 240206 - DNA, 428 bp, Homo sapiens
ctggttccatagagtgggccctgcagacagcctggactcggggattgagagagaaaggtggaatcaagatgagcatctggaggaacgagggtgccatttgccaagtctggggaacaaacccaagaacttcatcttaggcatgtcgcacttgagaagcccatggagatgtcgagtactgagctggctacctgatctggaactcagaagagttgtttaggctgaagatgtaaacatgggcatgatccacacacagccctaatcccacttcaagaaactctctctgttcagtccctagggcactctgcatttatcccatcctgattcccatagctgtagcctcactcctactcccttctgtactgtaagcggtctgagggcaggcattgttccacatctctttttagccttataaagtgtagtacatagca

SEQ ID NO: 240207 - DNA, 388 bp, Homo sapiens
ccagaatgaggcttcaaggtcccaaggcaccaccaattgtaggcagtggttggaagagaactccatcagatgtcctcacacccataccactgacccataaggcagcagccacaaagggccccaacagcaccccctatggagagagcttaacatcgtgctgactgtaaaagatgcttaaaaggaccctgcccattacacagacacttgattgaagggttattccagagctgagccaataaattgatagccgtcacagacacattgttctacatatataccctggcattatcttctgataccacatgtaattttatagttgctgattctgtaagaaccatttctcagataataaaacagtgcctataaaatggccaacatatctcttgaa

SEQ ID NO: 240208 - DNA, 482 bp, Homo sapiens
ctgtccctccagaaaaggataacctttggtcccctctgctttggaggaatagaggacagcctgccttgtgcaaatcttttccaagctttcattaaagatcacctctaagcatttccactttacagtggaagcgagcagatgccttcttgctgaactctgacccacataccattcatcttcccaataataatgccaagtgacactcgaacagcaggacaattagatcaaatcctagagcacacccagaggagaaaaaaacagcatgtctaaataccaccaacaaaagtttaggagaacagacttagaggaaggagagaaaaaaaggaaagttcttaaaaagagaaagtgccctgggtgtagtggcaggtttattttctcagtagatccttgaaagaagtagaattgcagcatctctttgcttaaaggacaagtgagagtaagtctccatccaccaggtaggggagatcaggttctcctgaaga

SEQ ID NO: 240209 - DNA, 410 bp, Homo sapiens
cccatgaagatgtggctgctgccattcctataaacagctgggatgtgtgggacctgcacacagagtgggggtgtccccggggcaacctgcggtggcaatgcaggacttcctgagttgtcctgtcaaatctggagatcagtcacatccagccctatctggcccttacctctctgctctcaagtttgacatgcccactctggtcatctgagttgatcttggccccctgaacccacctaacaggctgcaccttctatgtggaaccctcctggccctcccaggagaatgcagggggagagtgggcttcgggggtcagatcgcctgggtttgagccctagttctgccactcagtagctgtgtgactttgggaacattctggacttctctgtgcttatttccttatctgtaaaata

SEQ ID NO: 240210 - DNA, 498 bp, Homo sapiens
gtggtggagccgcaggccttcctgggcctgcgccagatccgcctgctcaacctctccaacaacctgctctccacgttggaggagagcaccttccactcggtgaacacgctaagagacgctgcgcgtggacgggaacccgctggcctgcgactgtcgcctgctgtggatcgtgcagcgtcgcaagaccctcaacttcgacgggcggctgccggcctgcgccaccccggccgaggtgcgcggcgacgcgctgcgaaacctgccggactccgtgctgttcgagtacttcgtgtgccgcaaacccaagatccgggagcggcggctgcagcgcgtcacggccaccgcgggcgaagacgtccgcttcctctgccgcgccgagggcgagccggcgcccaccgtggcctgggtgaccccccagcaccggccggtgacggccaccagcgcgggccgggcgcgcgtgctccccggggggacgctggagatccaggacgcgcggccgca

SEQ ID NO: 240211 - DNA, 396 bp, Homo sapiens
tcaaatgtcccctaggagacaaaatttcccttggttgagaatcactcctctacaaaaataatttatactatgttggaaaggacaactagcttaaaacattgatttatatagtttcagattggaaagagagctttactgcatttgggggtcacacactgagacagagtctcacagtcacccaggcagtggcacgatcatggctcactgcagcctcgaccttgtttctacaaaaaataaacagttagctggatgtggtggggtactcctgtagtcccagttactcaggaggctgaggtggaaagatcccttgggcccaggaggtcaaggctgcagtggagttgtgatcgtgccactgcactcctccagcctgggtgacagagggatacctagtctcaa

SEQ ID NO: 240212 - DNA, 707 bp, Homo sapiens
tatttttagtagagacgaggtttcaccatgttagccaggctggtcttgcactcctgacctcaggtgatccacccgccttggcctcccagctcatgctgatattacaggcataagccaccacacctagccaagaaaccattctttgaacacaagcaaatatactttggagaaaaatttaataatcctggcagggctacattcaacataattctgttatgggggaaggcagcatgctttggctgctcagtgagctatgttctgtacaaccaagtgaaattgctaaaaaaagattctcctgtatacagtaacttaaagtgatgcagtctacttaagatcagatctgagttacaaaatcaaaagtgacagctcctatgttcttttaaagtccaatctctttttttcattgttgtgctccaaatgccttgagtacctgatgtagagtaggtggctaataaatattggttgaatttcttgaacgaatctgttatgaaaagatctactttgctcatctctgtgccccaatagcaggagcttgaggagaaggagaaaatattgggtcagagcttttgattaatatgtatgattctattaaacgggttcactaaaccaaaaaaggcaaaggaaaacagttaaaccaagagttcttgaggttaaagtcttgtgatgattaaaatcatcatcctaagatgatgatgacataaactttc

SEQ ID NO: 240213 - DNA, 955 bp, Homo sapiens
gtcctaagtacgaagtcttggttgcgaccaaatttacacccaagagggacaaccctgagcagttcctggaggctgcggccacctccctgcaggctctgagcccccagaagcagagctttgttttggaggttctgtctgggtgcctcgagtaccggaagctgctgaccgtcgtggtggatgccttctacgtggaggatggccgactctgcctgcgggttgaccacagccgcttcgaggtgatctgctacctagccacattcctgctggaggaactcggcttccagctattctgtaacatcatcaagtcccagcccgtggataagatgtgcaagttcctcaggttcttcttcaaccccctgcacctgtgctcatggatcaaggatgagtggagcctcatctacgagccagcccacgtgaaggagaactggatcgaccccctgatgaggtcccccagagcacctaccagccacccaaggagcagcagcagctggagacagtcaagaggtacaaccgccgaaaggccgaggagctgctgctgagggcaaacatcgaggaactgcgctgcgccatgcccaggtcctgcagggagcgagtgcaggtaccgcccagctctctcaagacccatcatcgaggtgccatcttctcaagccatcagaaagttcctcccaacgccatcgcagtgaccacttatgtagccttttcccactgagggccggggaggggcggattcccagtagcactgggaaagtgtgccttgagcccactgcgatgtggcccctaagcaggcgggtgtagacgcgcacccacatcccccgggaggaagctcacgggaaagcacctgcaggtgctgcctctgggtatctccagatgttccgtgacaagcatttcatgtctctgtaaggaaaaaacaaacccaggtatgtttgccaataaagaaaaagcaaggtaatgacga

SEQ ID NO: 240214 - DNA, 427 bp, Homo sapiens
gagctcggtaccccaggccccgaacaatgaccagcctgacctccttccctttactgccaacgctgacccaccagcatccggtggtgttagctccagccctgtttctcctccaatgcaggccgccaccaccctccccttcacccacatccaccaagctgtcagccctggcatttctaggccccctcccactcgcagctgctgaccataggctcttcctcccaccacttcagcaggtcccccagagcacctaccagccacccaaggagcagcagcagctggagacagtcaagaggtacaaccgccgaaaggccgaggtgagctgtgtgcgacccctgccttcctagagaccccatatgagggattgttcggggcctgatcatataattaggcctgatgttattaaaagggctgatagggttacggtaag

SEQ ID NO: 240215 - DNA, 1658 bp, Homo sapiens
  misc_feature (868)..(868): n is a, c, g, or t
atcatggccacaagaatttgctctgtcgagggtcgtggtgccagctaggtgaggtttggggctctgtcactattggtcagtgtctgttacatacttgggccccagcagtgccctggcactgcacccccaactccatgggcacatttgtcctgttctcttcatctcagtttcctctcctgtaaaatgggtgcattgactgtgcagtggttcctccaaggtcccctgatccccagatgcggcccagggctctgccaaccagtctcaatgtttcaaggtggccaccatgaactttctgcatgtcgaagtaaaacacttcatgcctttctgcacagaggttagccctccacaggctctgggttcaaatcctggattccgttgatgccctgggcacgtccttaaagcccaccaagcctcagtttctccactgtaaaccaccgtcctggggggcatggtgaggatgaagtgggcttgtgcctgggacgttcctactcagccagtgccctgcctgaaacactaggatcgaactgtccattcagccaggcaccttcgaactcctcccaggcataatctctgtctggaaactccttgtgttgaataagatgggaaaatccatccatgagaactgaagccacaaacagcgcttgcaggacaagaggagagaaggtctttgggaggagatggccacatcgtttctagtccccacctcacacctgatcttggcctgtctggaacatgcagtgtgacccagggaaggccatgggtctcccagaggcccggtgaagcggggagcctttcctattcccagttaagggcctttgagaggcctcattttcttccctgaaggtctcgtccttccagcaaaatcagngtcaacaacaggccctctttctggagcacctactgagtggcagtgttacaagcatcatcctattgaatcctcagctcaccccttgttgaggggcttctattactcttatctgaattctactcatgaggaaacaggtccagagaggttaagcaatgtgcctaagatcacacagcaaatgaggggacggagctgggatttgaacccttgcttatctgatccctaaccataggaataccaacattgtagttagttgttaactaatatgacctgcatgcaatgggcacatgccatggttggcaaccactgggctgaggcttctacacacgcacttgatagcttactctctgattttgctttttccacctctacgccctggaatgtcagttccacgaaggcagggatttgttttctgtcttatccaccactgtattttgtgcttagatggtgcctgggacaaactatttataggatgtttttcatttaatctcagtaaatctgtgaggtgggctggcgctgtggctcatgcctataatcccagcactttgggaggctgaggcaggtggatcatttgaggccaggagtttgagaccagcctggccaacctggtgaaaccccatctctactaaaaatacaagaattagctgggcatggtggtgggcacccgtaatcccagctactcgagaggctgagccaggagaatcacttgaacccaggaggcggaggttgcagtgagccgagatcgtgccattgcactccagcctgggtgacagcgaggctccgtctcaaattt

SEQ ID NO: 240216 - DNA, 978 bp, Homo sapiens
gggcctcttttatgagaacattaatcccattcatgagggctctacccttatgacctaatcacttcccaaaggtcacatctcctggtaccaaaaccttggagattaggatttcaatatatgaatttgatggggatacaaacattcagaccatagcaaaataaatatatattttttaaagtaagattttacaaataacattgggattatactatttcgtagttggggacttgttttccttgtagacatggattccggtgtcatttggtcatgcatgctcttttgctttggcacggtctgcactttgggccctttcacagtgcgtgcagctggtcacaaggggaggctagatgagaatagctgaataaaatgcttccagtgtggcaggaaagaagagggaatgaatggggatggggcagcctatgccccctgtgcagcaggcgagttatttcaaagtatgctgccaaatgagttttatcatttcccaggcagagtccttactttgagactatttggaaccttgctctgtccacccacaatattatgccccatcctttgttctgctgaactccatacctgccatttttctactacattctctgctgtaccttcttggatctctcctgtctgcttctttaaactgaggctgataaaaggcacatttcctctctgtgaatctttttaaatatcctgaaaacagaactgtttgtttggggacagttgtactcagactcagagtctgtagtcctaatgaacagtcagtcattccccttaaatgatggtatcctcagatacataatatattaataatatcctaaaacatacttctttgtgggctcccaaatctagaaatttactgtatcttttgggtaatttcatgtaactattggtatttataattttaaatcactttaatgtccttcggctaccaaatatgttcttggtatctaatgggaaagttctccagtggctttgcaaaaa

SEQ ID NO: 240217 - DNA, 584 bp, Homo sapiens
gggggctctaggaactcctcccggagtccagccaaggagccggggggccggcgactggccaagggagaagacccccggagggggctgaggggagggggaaggtgaggaaaggacggcggcgtcggtcctgttctctccgccgccccagccgccgcttcacatcggggtccccgcccccccggccggggggtggttgccgagcttggttggggccccggttcatacactccggggcaagatgctacggccccgggcgggtggccgagtcggcggcaaggcgagggacccggccggctccgctcggcgccgcccccgctcccggctcccgcatgtgtcgctgcggctgggacccccctccctacaccttgggggtctcgccccacgccccacgggacgaggcagaagctctggcgcctcctcagcgttctctcaccgcggagcagctacccactcccggcccgtggtagccgcctccctgccccccaagccgccggctccggctcaggctcgggctccggctctggctccggctccggcgtgtgcagccgccgctgccggccgggaaggtgagggggggaaaggag

SEQ ID NO: 240218 - DNA, 913 bp, Homo sapiens
cacctatcctactttccccagctcttgtgtggttcccaaagcccctagcagtagccaaaacgggggccccaactgctgtcgctgtccctggtgctgactaaaccctaaagcctctgcgttgcggccttggggccattggtggtgccgagttattcttttattttctttctgttcttttctttttttcttttcttctcgttgctgcccttggtgctgcccaattattcttttcttttcttctcctctccctctctctcttttctttctctctctttctttctttttctctttttctttctttcctcaagaaaatgctgcagatttagagagtgactttgaagcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagccggtcctgcccccgccgcccgccgcccgccgcccgcctccgctgctaaacccgcggacaaccgccgggacgaccacccagagccaccagagccccctgacacccgccccgaggcaccggtaacccacggcacccgccccggtgcgtgccatgaagtcggccgcgagctcgcgcgggggcggtgggggcggccgc

SEQ ID NO: 240219 - DNA, 391 bp, Homo sapiens
gccacattccagtgcttcaaaggagtatctttctccttgagcacagtgtttatagataggagagcaggtcacattctggtcatgggaacatgatggcaattagaaggctttactcctcagaggcctcttgtggctttctacaacttactgttccatatttttatggctggtttatgcaggcaccccacaagccctttccccaacatgagagaactgcttcgtttattttatctcatcatttttcttgaaactattttgctatggaatgtcctactgaacatagtttggctaacctttattaggtagaaatgataactacttgccttataggattgttaggaacaatatctgaaataatgtataagaagtttgtggtgtagtccctggtgtc

SEQ ID NO: 240220 - DNA, 375 bp, Homo sapiens
ttgcatattttaattgctgtctggaatcctccttcagctgggatgagaaaccatctctgggttagttctgtccctggaggtgagggccagacaacacatcaaaactgactttttattttttttcaaagttgttaagactatctaagattcagatctccctaatactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtctgatttcaccccatccta

SEQ ID NO: 240221 - DNA, 607 bp, Homo sapiens
gcatccctggaacgtcctgcatccctggaacccttggaaatgagctgtccaggacagtgggtggggcctgagggccagcctgtgcccagccctaagcccattgctcgctgccatctccatggtggcttgcgctacatgaaggaatcatgatggtcatcagcatatagaacagcacacagccagggagcaggcggcctgggaacgggatctcgagctccacctgcagggaggagctgtggcccacggacacagtatgctcgtactgcgtcctcgcctagttgcggttgcacaggtagctcttgggcctctccatgaaccatggattccatcacacattatagcccctgaatcctcaaagcagccccatgtggaaggcaatgtcatcctcattttacagaggagaaaactgaggcttggagaggtgatatgatctttcagcggtcacagagcaagggaggggaggtactgggattcctttatccagatgtcccaacccagggaggagccctgctaccccaggaggaatgggctgggctacataagccgctttccgtctcacagaaggcatgtccttcaatgccaaggtccaacatgaactcaggtgtga

SEQ ID NO: 240222 - DNA, 433 bp, Homo sapiens
agtcagactctctaaagtcagataattctaaggacagcaagagaaatgtgtgtaagcaactataaaggaagccccatcagactaacagtggatttcagcagaaaccttacagatcaggagaaaatgagataatatgttgacagggctgaaggggaaaaaaagtaagccaaggatactatgtctagcaaaattatccttcataaatgaaggagaaataaagtatttccaagacaggcaaaagctgagagaattgatcaccactagactggccctacaagaaatgctcacaagagtcctaaacatggaagtgaaaacatgacatttaacactatgtaaaacacacaaaagtataaaactcactggcaaagcaaacacacagatgaggaaaagactcaaatgctaccactacagaaaactaccagagtacaatgcc

SEQ ID NO: 240223 - DNA, 296 bp, Homo sapiens
cattcacttggcctcagtttcctggtttgcacaatgagaaggttgaattaaacatcctctccaaggccgggcacggtgactcacacctgtaaccccagcactttgagaggctgagatgggcggatcacttgaggtcaggagttcgagaccagcctggccaaaccccgtctccactaaaaatacagaaattagccgggtgtggtggcatgcacctgtaattccagctacttgggaggctgaaccaagatcgtgccactacacttgatcctgggcgacagagcgagattttgtctcca

SEQ ID NO: 240224 - DNA, 372 bp, Homo sapiens
gatctttttactgttatcacagttttgtcttttccagaatgccgtacagttgaaatcatacggtatatagactttgcaggtttttatgcggacatgttttttgactcctttgggcaaataccaaggagcaagattgctggatcatatggaaagaggcattaccatatcaaagcctttagccttcttgcatcacgacaaaaattcgaacttggtgtttgaagaacatgaaaaatgaggaggaataaaataatcatgagtctcctggtcattaactgcatgaagttgagctggtcacttaagccattcctaatatgtaacttgagagtatagtattagatattcagtaaattcccttcaaaattcataaaaaaa

SEQ ID NO: 240225 - DNA, 426 bp, Homo sapiens
gacagacgttattgactttatcttttctctttctcactctcttttcactcatacacacacatgcattcacatacatacaccacatacacgtggtatgtatttttaccgaccatttgagcataaggttaagttgcagacatcatgataaatcattaagtacttttagcatacatctcaaatttttaaaaaaatatatgtaagcataaaattaacccaaaaacccctttgttatctcatattcattccgtatccaatttcttcagttcagttgtcccccaaaaaaatgttttttaaagctttttgttgtttttctccttaatccaggattcagtcaagatttattcattgcatttggttgttacgcataatctaaaacagtactttcccttttgtttttcatgacattgacttttgaagaatccagac

SEQ ID NO: 240226 - DNA, 1861 bp, Homo sapiens
  misc_feature (1280)..(1280): n is a, c, g, or t
  misc_feature (1283)..(1283): n is a, c, g, or t
  misc_feature (1296)..(1296): n is a, c, g, or t
  misc_feature (1298)..(1298): n is a, c, g, or t
  misc_feature (1434)..(1436): n is a, c, g, or t
  misc_feature (1438)..(1438): n is a, c, g, or t
aagccaccaaggaaaatgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaagaattggaaaaaactaaagttcatatgggaccaaaaaagagcccgcatacccaagacaatcctaagcaaaaagaacaaagctggaggcatcacactacctgacttcaaactattctacaaggctacagttaccaaaacagcatggtactggtaccaaaacagatatatagaccaatggaacagaacagaggcctcagaaataacaccacacatatacaaccatctgatctttgacaaacctgacaaaaacaagaaatggggaaaggattccctttttaataaatggtgctgggaaaactggttagccatatgtagaaagctgaaactggatcccttccttacaccttatataaaaattaactcaagatggattaaagacttaaatgtaagacctaaaaccataaaaaccctagaagaaaacctaggcaataccattcaggacataggcatgggcaaagacttcatgactaaaacaccaaaagcaatggcaacaaaagccaaaatagacaaatcgtatctaattaaactaaagggcttctgcatggcaaaagaaactatcatcagagtgaacaggcaacctacagaacgggagaaaattttttcaatctacccatctgacaaacagctaatatccagaatctacaaagaacttaaacaaatttacaagaaaaaaacaancanccacatcaaaaantnggcaaaggacatggacacttctcaaaagaagacatttatgaagccaacagacacacataatcccaaatcatgctactataaagacacatgcacacgtatgtttattgcggcactattcacaatagtaaagacttgnnncnaacccaaatatccatcaatgatagattggattaagaaaatgtggcacatatacaccatggaatactacgcagccataaaaaaggatgagttcatgtcctttgcagggacatagatgaagctggaaaccatcattctccgcaaactgtcacaaggacagaaaaccaaacaccacatgttctcactcataggtgggaattgaacaatgggaacacttggacacagggtggggaacatcacacactggggcctttcagtgggtgggaggctgggggagggatagcattaggagaaattcctaatgtagatgatgagttgatgggtgtggcaaaccaacatggcacatatatacctatgcaacaaacctgcatgttgtgcacatgtaccctagaacttagagtataataaaaaaaaagaaaacagtg

SEQ ID NO: 240227 - DNA, 894 bp, Homo sapiens
aagccaccaaggaaaatgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaagtttggacctgattaaagaaggacaacaaaggccaatttgccatcaccaaaggagcagcttgacctggagggatgaggcctggaggccgacagcaggactccgtcagtgattctttcagctcttgaaacatgtccaagaaagacacttgtctctcacctttttggagcctctagcctgcctgggaagcctggtggacttggtgctgagaagagaacccggccagttggaggtccactctgtcccgccagctggaatgcatggcacgatctcaagtcactgaacttccactcc

SEQ ID NO: 240228 - DNA, 624 bp, Homo sapiens
ataaaagaacaattgggaagagctggggcaatggcttgtcatatgttcaataaactctcactatgagaaaagtgacaatggaagccctcaaccgtgtcacagtctctacaggtattcattaatatgaaaggcaaaccaatgatcacatttaaggcttaaataactatactttcacctagcatattatcagttaacttttactcagtctaatttccatgagactttaatacacattttttcttccttttttcggatataaaatcattttacgacccaatgtaacgcttagaagaaaaaattgccatccttgtgccttaattaaagaattaacttgtcacagaggcctcgatgtatttctcaaggctcctggatgcccgccaaagctgtggcacacgacgaagctctgtgagcaaagtgctatggaaggaagcccactagatctctgcctaactatatgaccccctttcagcacactgcaggtgttccaaaagtgttttgtcaattattaattattcataaatattttggtataacagccataaaaactcatttaaagaataaaacaaggattgaagaaaaatttttaaatactatttcaaaaaaagttcatactatgagttttct

SEQ ID NO: 240229 - DNA, 445 bp, Homo sapiens
agagctgatgaccagtgctctctgatgaagttatcatgactggaagataagtttagattacttgatgagtattggggaaagggaagggctgagagatatctgaataggttcaaaggttacccaaagagttttcaacctcaggtatccaccattctgcttctctggagccacactcagaccagaggtgtgggagtgaacattcctcagtctatactattaaatggaatcaaatatttagatgcagatctaagtatatatacaaaatattttttaggaatattatctgttattatacatatacttaacaagaaaaggtaaatacaaattatgcaaattataaattacccatttttattaatttaagatatgtaaaatgtcactagtattttttatgttgtgtgtaatgtgtgtataaataaaaatgaataactgttttcaaaccatc

SEQ ID NO: 240230 - DNA, 797 bp, Homo sapiens
tcgagtgcgcctgtccctgtggtgggagcagtggcgccgagcgtgcccacgggccgccgcttgggtttctctcgtgttcagggtagtatggacgtggacaatggcagtggcccctggctggcccaagagccgggtccagatacgcgcgcctgattccaggcgtcataaccaacccggggccgcgaggctgggatcaggcaccccggagccgcttgcccgtggccgggctgctctccccctctaagcctaagcaccgccagtcgcggcgctgcgctttccgccgacctcccagagcgtcccgccgtcgccggcggccagcctcgcgcaggaccagtgtggcgccgccctgctgttgctggggggcgcccgaggcctccattccttgcccaggcttccggctctcggggcggcctcccttccgcccacgctccagggcttccccggctcccgagctccgagcttccaccacatcggccggctcaggacagggcttccactgtaaagtcggctgccagacgtgttggagctcaccggatttgtccctggtgccttatttagttcacttggtgaggtcatgtttttttcctggatggtgttgatggtagtagatgttcttcagtgtctggacattaaaatcttgggcatgcagcaccatatgagaggtttaaaaaataaaattaaaaaagagaaaagaacccagagttgatctctgcagcatgccatcactgctggggatgaggaaacggtgatttcaggactgttttttctgtctcttcagtgcctctttcagtgatctg

SEQ ID NO: 240231 - DNA, 324 bp, Homo sapiens
acagctatgttgaattctctgtctgaaaggtcacatatctctttttctccaggatttgtccctggtgccttatttagttcacttggtgaggtcatgtttttttcctggatggtgttgatggtagtagatgttcttcagtgtctggacattaaaatcttgggcatgcagcaccatatgagaggtttaaaaaataaaattaaaaaagagaaaaggtgagtatttattgtagtcttcactgtctgggcttatttgtagctgtctttcttgggaagacttttcacatatttgaaaagacttgggtcaaatatgggtcaaatatggctt

SEQ ID NO: 240232 - DNA, 617 bp, Homo sapiens
gttttgcccatgtcagtctctatttgctttcagatatccaggaatgattttcagagtatttgagaaaatgagaggtgcagatggttttcactgaggcatggtttcaaatttaaagaggattatggcccagaaatgatgaagaagatggaaggaaccaccacctcagtggaggtgacaggtgctagacgactacctggaatagatgggagaacaaaataaatgcaagaatccaagtctgaaattgtttccagcctagaggaaggaaggccttcttggagtgaagcctaagtgccgtgtgttgtcagtgctccatggggtaactgagtctcagagagcttaattagctcaactagcatgggccatatttgttccaagtcacagaattttccagatgcagagtgacttggttagtatgtggggaaggatggtaggattttctcctgggtagctcatacttcaaaagaccatgttctgtcaactatggcacatgagcaagtgacctccaggtatggatcttcagctgtctgctatcatcatctggctgtctcctctgaacttcaaacttggtgtgtcccaaaccaagcttttaaagtgctaatgaggacaaagtgggtgcc

SEQ ID NO: 240233 - DNA, 248 bp, Homo sapiens
gttttgcccatgtcagtctctatttgctttcagatatccaggaatgattttcagagtatttgagaaaatgagaggtgcagatggttttcactgaggcatggtttcaaatttaaagaggattatggcccagaaatggtgagtagaggtgtgaacctttgaaattctaattgcagaccagtctgaggaggtatatacttaccaaagcacaatatctcattgtgagcatattcctttcttggccaaaggag

SEQ ID NO: 240234 - DNA, 376 bp, Homo sapiens
gccttcagcacacactgtccagtatatccgagctctttgtcgccccagcagcagccccttgaccacccttcgggcctagggtgcatattgcggcccacccttccctctgaagaatggaccctgggaagagaagtcctgataagagaaagggctggctctgagcaaagaggcaggcaaccagaggagggccagaaccacggcctctaaagagcgagaggtgcaggcaggacaccgactgcccaggtctaggggaatgcctaacaggggcatctatttgggaacgttgaggggctagggggcagggaggaaaaagaatgcctttggttgaacaaaataaatggactactcttgataggatggagaataggatgatcga

SEQ ID NO: 240235 - DNA, 375 bp, Homo sapiens
  misc_feature (38)..(38): n is a, c, g, or t
tttttttttttctcgagatacagtcttgttttgttgcncaggctggagtgcggaggcatgatttcagctcactgcaacctccagctcaagctcctggccaacatgttgaaaccccgtctctactaaaatataaaaattatctgggctggtggcgtgcacctgtaatcccagctacttgggaagctgaggcaggagaattgcttgaacccaggaggcggaggttgtagggagacaagatgacaccactgcactccagccggggcgacagcccgagactccatctcaaaaaatatatgtattatcacttgatacaaaattctgggttttagttcttacagcactttaaaatgtctacttccttctgtcgttcataat

SEQ ID NO: 240236 - DNA, 260 bp, Homo sapiens
gagatgcaatttcactctgttgcccaggctggcgtgtagtggtacaacctcatctcactgcaacctccacctcccaggagaattgcttgaacccaggaggcggaggttgtagggagacaagatgacaccactgcactccagccggggcgacagcccgagactccatctcaaaaaatatatgtattatcacttgatacaaaattctgggttttagttcttacagcactttaaaatgtctacttccttctgtcgttcataat

SEQ ID NO: 240237 - DNA, 526 bp, Homo sapiens
caggtcattcacaattgccattgtaacatcacaaacatgttgtgttgtccacccacatggtttcctccacctctgatgagactgtgagagatgcctcggagaatatcattggtaagcaactctcacccacttttggagagtttgacttgttctttgactggtcaccacttagaaagaaattgctatatatcttagacgtttacgctgatatctctgtggatatgtatacaggtatattttcagggggaagggaatgagaggggaaatttgagaaagaaagtaagaaatcaagtagttgtcttgatttagactttcccgaattttgtggtttttcttagaaacacatggtctagcgcagaggtttttctcatgagttgaccgatttaaagattaatcaacaagcttcagaattgccaaaaaactacctaaaatagtataaaaatttttagtatgagaatagtttttcacatatgtgaatttttctggatacaaggttcatagactgcacaggtgttcctgattcaaa

SEQ ID NO: 240238 - DNA, 779 bp, Homo sapiens
ccgaggaagtgctttccagaccgactcctctgtagagcctggtgggtgaggataggcttggctgcacacagcatatgtgtaagctacagagacttgtttctttcttgcacaggtaacccagaggcagagggtccaggctcaggtcattggcatgttttttgtttcacgaggaagcagaggagccccatctcccatcttaatctctgccaccaactagggtgctgcccttgtccctgtgacacctgtacctgccacattcacctttgcactgagcttagtcttgtgaccacatctcaccagacgggaactgggaggtgtagtctcttcgggcctgtgtgtgtgccagctcgatgcagtgtcattcccatggaaggtgggagcaaaccctgccacaagcatccagagctgtcttcagatgtgctcttgggcctgaatccagcgtcccaggtcttccgaccagagacgactgaggaggtcgggcggccgcctccctggatctgactgcacatccatcactgcaacctacgacaaagctcctgggccacaaccggctggcagtgagagaataactgctaaaaacgtttcagggagctgagtccaatttcttccccaaccacaagacctgattgcagtggtccatataactatcaccacagctccctcaaatcaactctgccttattatcttttttttttttttttttaaatccggggaccaggcacggtggctcacgcctgtaatcccagcactttgggaggctgatgtgggcggattgtgag

SEQ ID NO: 240239 - DNA, 464 bp, Homo sapiens
ccagctttttatggactcactctgccttctattttcatgcctgggtctggggtctctgaggagggggaaggggacagaggatgtggcataagagtgaacacagaagttggacccagggcttggggccttctgcatgggagatgagatttcggggtgcccagctcctgggggtatgtggacagtggagtactcccctctgcatgtgagacgtgatgctgagtgagccgggggtgtcagtgctgacatgtgggtgcctctgtgtgcaggtttgggaagttgctctactgacatgctgtcaccctgtgtgtctggggacatggatatcttggtgctgtgttcaccgtctccatcgtacagtgtgttctttgggcatttggggtcctgtgtgtgtcttgtcaggcatttgtgttgttagtaagtcccagtcttgagatgtgtaattctgtgttgtgatgggtgtgcac

SEQ ID NO: 240240 - DNA, 495 bp, Homo sapiens
tttaacaaaggaaaatttggtaactatttctggggtaaagattttacaatagcaagtattatcactagacattactttaaatgtggatttttttaaatcatggtagaaaacaatataaaaagtgttcatgtggcagttgttaagaatacacatcttcagggttttttaatataaaaaggggaaagaacagtctcattattatatgcatagtttctctgatttggtacaaaatttcccagtgatgtcattgtggaatgatccaagtgttgcctgtcagcagagataggagtgaagttgatgatgatggttagatggcctcacaagggactctagtgatagtaaaggttccagtggcaaacacacaagtgaaaagtttgaatatagtttcataatgtttgagagtgtaaaaaatgcatttttaaattaatgcattactttctgtactattttaaataagtgtgtatctaaataaacacataaaatgttatgagtaaa

SEQ ID NO: 240241 - DNA, 505 bp, Homo sapiens
atcatagacacaggaagtagaatggtgtttgatgtggactagggtcgggggaatggggcgttattgtttaatggatacagagttttagttttacaagatgtaagagttatagagatgaatggtggtgatggttgcacaacattatgaatgtattcaatatcactgaactgtacaattaaaaatggttatgatgggaaatgttatatgtatttcatcataaaaatgttatgtgtatttaatcagataacaattgtaaaaaaagtttactatgtcaattaataagtcaacaagtttgcaaaaaactacttaagagagtaaatggtttccaagagctctcaagtatttcagaaaggtacctttagattttgatggtagagtcactaactgattaataatgttgatttttgtgctaatttaaaattgttctaaatgctatgtgatgtcctacattatgtttcagaacagaaaactgaaatgtgaataaagtgtcaagtttagttaatag

SEQ ID NO: 240242 - DNA, 378 bp, Homo sapiens
atccagttttttgtgactatttcctgatgtttgacagactgttctttcaacttggtgtagagttacagtctactcttttagggagaatgctgtttgttcacatcatgaggctgtaaatatttaaaatgttctcaccattgtgttagtttccaactgacacatggcctgagagattggagtatcattaattctgcaactcttttagtgctcaggatgtgcatgtttatttactttcaggactagttcagacatagtaaaactgctagtgacttcatgtaatccttattctgaactgtatttgaaagcaagggaaatgaaacatgatccctaataacctcaaacatccaaagatcaagtcaattaagggcaaaaaaaaaa

SEQ ID NO: 240243 - DNA, 510 bp, Homo sapiens
tcacccaggctggagtgcagtggcacaatctcagctcactgcaacctccgcctcccgggttcaagcgattctgctgcctcagcctcccgaggagctgggattacaggtgtgagccaccacacccaactaatttttttgtatttttagtagagaaacagggtttcaccatgttggccagtctggtctcgaactcctgacctcaagcgatccgcttgcctcggcttctttaaattattttttgtagagtcggtgtctcactctgttgcccaggctggtcttgagctcctggcctcaagtgatcttcctgcctcagcctcccaaagtactgggatgactttgggcacgagccacagtgcctggcccctgtattttatttctttttatggatgaatactatttcatcatatggagagatcatattttaattatgccgttatccattgagggacatttgggtattttcctcttttttttttggctactgtgaaaagtgctgctacaaatattcac

SEQ ID NO: 240244 - DNA, 564 bp, Homo sapiens
tcacccaggctggagtgcagtggcacaatctcagctcactgcaacctccgcctcccgggttcaagcgattctgctgcctcagcctcccgaggagctgggattacaggtgtgagccaccacacccaactaatttttttgtatttttagtagagaaacagggtttcaccatgttggccagtctggtctcgaactcctgacctcaagcgatccgcttgcctcggcttcccaaagtgctgggattacaggcatgaacccactgcacctggccctatttctttttttaaattattttttgtagagtcggtgtctcactctgttgcccaggctggtcttgagctcctggcctcaagtgatcttcctgcctcagcctcccaaagtactgggatgactttgggcacgagccacagtgcctggcccctgtattttatttctttttatggatgaatactatttcatcatatggagagatcatattttaattatgccgttatccattgagggacatttgggtattttcctcttttttttttggctactgtgaaaagtgctgctacaaatattcac

SEQ ID NO: 240245 - DNA, 411 bp, Homo sapiens
acacccagtttataaggtagaatctgcaactactatacaatatacttgaaaaacttctttgaatattgaagtttaacatcacagcatatctggtacattctaaatgagcatcttcccagggaattgacccacagtcatggtcttaaaatgtttcggtcacccccattttaaattaataaaaggtggctgtggaactgcccaaaaaactggtattggctttcagctagagatgtcaactggctggctcttgtttcttgtaaagtggccaatatgtggtttggagctctgattaggggaaattctggtaatattaagaaaacattctcctgctatgtaacgggccaggaatgtatactcaaaatccaaaaaatcatctaataaaatgttttaaaacaagtaccaagaggagaa

SEQ ID NO: 240246 - DNA, 134 bp, Homo sapiens
tctcccttcacccccactttgtcccctcacaccccaactcccccagctctgcgctcttcacccccctcccttccccgggctgcccctcctgagcacctgggaagaagaggcggggccccctcacctggcggccg

SEQ ID NO: 240247 - DNA, 348 bp, Homo sapiens
gattcaaggggtacatgtgcaggattgttacatgggtataatgcatgatgcttaggtttgggatacaaatgatcttgtcatccagatagtgagcatagcactcaacagtaagttttttaacgcttgccctcctctctccctcttctctttattagtccccaggtctattgttgccatcttgcgtcacatattcttgccttctctcttctgaaaaattaaataccttagggttactatgaaaattctctatatatttatgtctatattagcccttatttatatgctgtactttttgttatctgtctttattaccaaatacaatcttggttctataaagccatgaacatt

SEQ ID NO: 240248 - DNA, 297 bp, Homo sapiens
tgataaaaaatgaaatattataggttaaggttaaatgctttttgactactacatgtaatacctctttttatcccagattatcatttaacaggtatatttttaggctttttaatgtgttaaatacacatgtactcatacaagcaactatttagagaagtgtacagtgttgctgtgtgtgtttgtgtttctgatggatacttcatcatgctaaatgctttattatgataattgcttcctactgccttctctcaccatcataatccctttggagacttttctgtgtcactttttaacctt

SEQ ID NO: 240249 - DNA, 724 bp, Homo sapiens
tgagttcagcctatcatttgagatccgagtatgattggggaaatatcctgaaatagtctatgatttgaagaaatggatagatggctagaataacatgctagatggtagtcaagttactaactgcagaattgatttgataaaattctcatcgtgtctcctgacttaggagaaatattgggtctgatgaatgggtaaaattcccaggtgaaaagaatttggtctgtaagatttggcagcaccctgaggtttgccatatctgatggcctggctttagtggcagcacctagtgaaggcccaggtgtccttctgacaacctttaccacctaccgttttgtccttacttatgttgaatcactacacacaggctgttgaattcagctgtctgtggagaaattataccaaccacatggttagacagaaggaatacaatatattgcttaatttgtatctgaaagctaagcaacatggaaaaaaatcaagcctgctcagtcacttccatgaggacaaacgaagacacttcaaggaggacattgacatggatctgccagctttctaagactttccccagattcaagtccagtcacatcaagttgccttattaaagggtctgcccactcaaaaggagaaagtgcaaaagatgctcagcaagggtagcaaacgcagtcagatgatacttcctgacagcatccaagagcaagtctcaccaccacatctgtcaataaaa

SEQ ID NO: 240250 - DNA, 452 bp, Homo sapiens
aattaataaggtagttggctttatcacttcagatgtgtatgttaaaattcaggggaaagctgtaatttaaaattcactgtccatttgaaaataagcttcctattgggacattaaggtgcacgttcatcctggctaacacggtgaaacctcaactctactaaaatacaaaaaattggccgggggtggctcacacttgtaatcccagcactttgggaggccgaggtgggcggatcacgaggtcaggagattgggaccatcctggctaacacggagaaaccccgtctctactaaaaatacaaaaaattagctgggcgtagtggcgggcggctgtagtcccagctacttgggaggctgaggcaggagaatggtgtgaagccgggaggcggagcttgcagtgagccgagatcgcgccactgcactccagcctgggcaacagagcgagactccgtctg

SEQ ID NO: 240251 - DNA, 116 bp, Homo sapiens
ttatctgtctttgtatgaaggtcattttgaatctaacagccaggataatcacatggaagaattactggaaaaatccccactcatgtaattgctaacataataaagtttcaaattag

SEQ ID NO: 240252 - DNA, 422 bp, Homo sapiens
tggttccccttcacctctgccatgattgtatgttttctgaggcctccccaggcatgcagaactgtgaagcaatgaaaccccttttctttacaaattacctagtcttgggtagtgcttttatggcagtgtgaaaacggactcatacactatacttcctgcttggaccggaatggattatgacactagtgctttcattggcagaatccagtaaactcataaggttccacaggtcaggaggcatctatcacaaatgggtaaacagtgaatggctcaatcaatatttactgatgtaaaagcagaagattattcttgaaaaataaaccactttaagaaattgaagctgtgtattccaagttgtacgtccataacttgtgtgtcttatcaaatctcttcaaactttctaaactatcaaaccaagtaaa

SEQ ID NO: 240253 - DNA, 373 bp, Homo sapiens
actccatctccaaaaataaaaataaaacaaaataaaaataaataaataaaacatctaaaagtccctgctatgggctgaatttggtccctacaaatacatctgttgaagttcaaccctcagcacctcagaatgtgactgttttggagacagcatccttacaatggtaattaagttagatgcagagacatcagggatgcgcttgcacaggggaaaggccatgtgaggacacagcaagaaggcggctgcctcccagccaaggagacaggccccaggagaaacccaacctgcccacaggttgatcttggactttcagtttccaccctccaaagaccagtgggagagttttcatgcatggtccatttgaatcactgac

SEQ ID NO: 240254 - DNA, 461 bp, Homo sapiens
ataggatatgtattaatatttgttcagatttagtagacactgcaaagcaaagccttctactaaagtagtttactgattcactctcacacacagtgtgtgagagttccagtggctccacatcttcatcagcacattgtatttttagtcttgattttagccattctggtgggtatgaagtggtatttgttgttgtgcagattgcatctccctgatgactaaagaggactagtgctttgacctcaagaacttcccctctggggagatcttatgttatttaaatcttaggtttttaaactgatctctgctagtttgactttatttcgatattcacagaaactattattttcctctggtgttcaggatatactgtacaccaagtttttcaaatctctagacccttctgtgtcatattttatggtaatcactaatagatacaacatccaaattttgctgcttgatga

SEQ ID NO: 240255 - DNA, 497 bp, Homo sapiens
acatgggtattattcaatatttgtggtgtgaatgcttcacccgcaacatgatgccctcactcacggagtccaactaactacttggtgacaagctgattacatggagcctttctatgctggaaggggcagtgattcgcacagacaggaatgaatacactgtccaagtaaggtttaggctttcttctgcccacagagcctcagtcagaacatctgtcagctctcatagggtttggccattagacacagtacttcctgcattattgcatcggaccaacgctctgctttataacagaggaggtgggaagaggatctcctggtcctgtcacacatcatactacccaatcgcatccgaccttttagactgacagaatggtcttcaaatgtgtagataagcatcaacttgggcaagataccctttgataggtctttttacattgctggattatgaaatttagattgtctaataaggtctctcaataaaatactcaacacaaaaa

SEQ ID NO: 240256 - DNA, 437 bp, Homo sapiens
gagtattttgctaatttcaggtaattaatggagatatgaatgtttttcagttaaagtgatgaatatcaaaagattacctgagtttctgtttatattgttatttaatatttgagtttctctttaaggtagtaaaaaagttatgatctagttttttttaatggcgttaacaattagtttgcacatcttatgcattttatttacatggattaaagtatgtggtaagttatcactttaattcataaatttgttttatatgtaactgaagaagcttattgtaaattggaaataccttaccttcaaatttcctgggtgagaaatcactattgagttatttctactttgattatttttactaatataatgtaatataagttatctgacagttcaagactggaaattggtatgaagaaacaaggaaatacaagtttctgaaatga

SEQ ID NO: 240257 - DNA, 517 bp, Homo sapiens
tagggtaagcacaatatttaatcagttgatatcagttctggtccttatcacttgtaaatgagtgtgattgttcagtttaataacaagtgctcatgaaccccattactaaaaatatgagatatagctcctagaatacaatcgtaccccagtgccacctagaggaaagaatttgcatcgagaggctgggcatgtctgtttctgtacatcctggccactgaggtaccgcttttgccttttgtatttcttttgtaaaatgaggccatccacaagactagtgtgtcatagaaataattacataaaatttcttataactgaagtcactaactagtaataattttaaggaaggcatgctaatacttttaattaaaagactgtaatttaggctaaagaaaaacctactgactaaaagtgaacattacttttaatttacaacacagaaagctgttgaaaaataaaaataactggccatcttagggctcaagccagctctgatgccagaatttttcctattctattc

SEQ ID NO: 240258 - DNA, 656 bp, Homo sapiens
  misc_feature (656)..(656): n is a, c, g, or t
ggcacataggcagcacagctatgtgggaagaacacaggctggtctgcaggtctagatttggatcctagctctgatacttactactttgtgactttgagcaaattcacgtctctgaaagaaacaaagctccaaatttggaagcagcagtgaaactccacagattactgagggcaaaattgctgggtcataggcaccaaggaaaggtcttgtgctgacacagggagaaagctgtcatttacaagctgggaggagaccttcaccagaaactgaatttgctaccacctggatcatgaacttttactctccaaaacggaaggaggtgatgaagagagaaagaaaggatggaaggaaggaggaagtggacaatgagatcctggctgatggatgtaatgaaggcatgaactatactagttgaacaaggaaatgaacttgaaccaaattgtgaagttctctgcagtgaaatattaaaggtacagatcaaagctctaacaaacaagcttcgtgtagcacaaggacctaaaaaagatgatgaaactcgaggtggggccccggcccccaatgtgacctatagtgatgtcgttcacattatcactgaccgtagttatacaacgtcctgtctgggggcgtaaattcaaagaggccctgacggattcccn

SEQ ID NO: 240259 - DNA, 929 bp, Homo sapiens
  misc_feature (69)..(70): n is a, c, g, or t
caaccctcatctccctcccacctgcccccttttagaatccccagtgtctagtattttgaggaatgtatnnttaaagggaagacagattttaaagaaagcacagaaacagtgaatccaagaaaacaataacaaatggaggtaaacataaaggaaataaacaaggaaactaagtgcttggacctggagactcccagaaggactaactccaagttttgaaggtataatttaataaacaaacaaatgtacgaattgataatttcctttcccctggatttgctgtattgtgctcaatttctcttctctgagtctatttctcctgggaagaggactgtgagtgtgggcagatattcaaggaaggggtttaaggagagggtagcaatttccagtttgcattttagagacacctggctgcagtgggggtggggtgggctgcatattaggacagagactattccagtgttagaatgtgagggagaaaaagatggatttgaaggacatttaggagacatagggcatggaggtttgctggttaaggaagaaggaagctaaaggtcaagggtcaagaaccttttctaggtctctctgatttgggcatctggctggctggaaatgctaatttactatgagacattaaggataaagagctaagggccgtttgcagtggctcaagcctgtaatgtcagcactttaaaaggctgaggcaggcagttcacttgagcccaggagctcaagaccagcctggacaacatggcaagacccatttctacaaaaatacaaaacttagctgggtgtggtggtgtgatctgtagttccagcaactcaggaggctgagatgggaggattgcctgagcccagggatgctgaggctaccgtgagccaagattgcgtcactgcactgcagcctgggtgacagaatgtgactctgtctc

SEQ ID NO: 240260 - DNA, 348 bp, Homo sapiens
tattctaatgaaatttttattaataaacactttattgaactatgacatgcactcagaaaatcataaatatgcagaacaatgaattatcataaaataagaataccagtgtgatatgatttggctgtgtccccacccaaatctcatcttgaattgtagctcccataattcccacagtgtcatgggagggacccagtgggaggtaactgagtcatgggggccagtcttttccatgctgttctcgtgatagtgagtaagtatcacgagatctgatggatttataaaggggagtttccctgcacatgccctctcctgcctgctgccatgtaagatgtgtcttgcttccccttc

SEQ ID NO: 240261 - DNA, 423 bp, Homo sapiens
atgaagggcctaagaaacattttttgttctatagaatttcactctgtaaagtcattgaagaaatgcatatattaaaaacaaaacaaataacccacgtaccacagaacaaaaaaattccttgcaaaaacaagtatttttaaacgacttaaactctgaatttttaaaaaagggaaattcttgggagctaaggtatgaggacgtaaagacataagaatgatacaatggactttagggacttgggggaaacggtggggcgatgagggatagaagactacacattgggtacagtgtacactgcttgggtgacggttgcaccaaaatctcagaaatcaccaccaaagaaataccacctgttccccaaaaacctattgaaataaaaaataaatttaaaacaagcaaaaagagaagcaataaagaacagaa

SEQ ID NO: 240262 - DNA, 474 bp, Homo sapiens
agtgtaagacgacctgcctttgtgtactcggcttactgcctgttttcctggagtggaatatgtgctccttgcctggaggtctgtggcccagccactggcgctcaataaattatttgttgagtgcatgaatgaagggctaacccaacactggaattcaagccttgggacttgaaatcccttgactccaaattccattttccttgttaagactagcaactgtaatttattcatcattcttatttatttatttttgagacagggtctggctctgtccccagggctggagtacagtgacgcaatgtcggcttactgcagcctctgcttcccgagttcaagcaatcctcccgcctcagcctcccagctacttgggaggctgagttgggaggatcacttgagcctgggaggttgaggctgcagtgaactgagatcacgacactgcactccagcctgggcaacagtaaaacctggtctcca

SEQ ID NO: 240263 - DNA, 477 bp, Homo sapiens
gtcactcggcactgagaatactggtgtccagttcccggcggtgtgctgggtcagcaccacacgcacctggttttattattcatgcctctttaaatagcatggaggtgaggctggctgcttctgtagtgttgcatgaggcttttgagataaatgattttcaatcaacagaatcaatagcagctgtgctcagtacctcgcgcttgtgtacgggtttgcgactgaaaagctcacagcctgtgggtgcttgttgctgcttttccaccagtttgatttgaagaaataaaagcagtcacagaggaaaggtaaaagagttggaaattgtttcagattggacagaaccttcccttggcggttgtattcatctgttcttatgctgctgataaagacctacatgagactgagcaattcgtctcttctcacgctgctgattcgtctgttctcacactgctgattaagacatacctgagactgagtaaa

SEQ ID NO: 240264 - DNA, 787 bp, Homo sapiens
cacacttggaggtttaaggccttccacaagttacttatcccatatggtgggtctatggaaaggtgtttcccagtcctctttacaccaccggatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactca

SEQ ID NO: 240265 - DNA, 366 bp, Homo sapiens
tcaccctacttaaccttcactacccccagcagggtgggttgggcaccacagagagattacattccttaaactaagtggtggcaaaactgggattctagctctgatctctccaaatctgaagctgattcttttttcctaaatagtactgtccctcccttccctgaaccccttcactgcccaccccactggaggtgtggcagctgggggtctcagggcttgatttaccaatcaaagacccgaatttaggggtgatctccagttttcccccaagttctcaggggaactcatttctccctcatgagggcactaagaaaagcaatagttcttttcctcttgggatcctggggccaggactgcggatcctga

SEQ ID NO: 240266 - DNA, 699 bp, Homo sapiens
tctgtgttgatttagctacagtaattttaaaattaggattcatattccttataattttatctctggggaatttttgaggatcttcttccagaaaggactggggttttatttctccagatacctggagtattattaccagcccaaggcctcctacaaatacattttgggtttttttgaaaacgcaggtggtgtaaattctgactccagccctaaactcaggcaggcatttcttcatttcatttattgcacccagaacaaagtctgagaggggcctgtatcctcagttcatttctgtggggcaggtttttgtttgagtaaacccactgagtgtgttgacctttggggaatcctagtttttgtagagttctctcatttagattcctatacttctaaaaatgtaaagcaaataccaataaaatagcataccagatattggttatcttttgccctaatgtggtgtaacaagtcaccacaaaacttagtgatttaaaataataatttggccgggcgcagtggctcatgcctgtaatcccagcactttggtaggctgaggcgggcggatcacctgaggttgggagttcaagaccagcctgaccaatatggagaaaaccccgtctctaataaaaatacaaaattagccgggcgtggtggcgcatgcctgtaatcccagctgctcaggaggctgaggcacaagaatca

SEQ ID NO: 240267 - DNA, 521 bp, Homo sapiens
aaaaaagaaaaaatgagtggtttggcaagatggttgggtgggggtcaggagacagaggctggtatgcttctggctggcctaattccctcagaccctgctcccctgcatcctctgctcaccttgagccttcccaaaactgctgtccaggctcccccagccccactcggctcctggttctgatcccttccagagtcctgggacgtgcaccatcacactcacatccacacatggccgcacgtgcgttctgtcttggctgctccccttccccagcctctgctctcccaggaccctgactcctgcgtcaatgccctgacctaaccatggagagggggccggagacagatgggtggggtggacacagctggaggaggaggagccttttgggctgtgggacctgcccctcccctcacacagcttctcgggggtccctgcatccttgtctgcagttgaagaggagtgagagatgggccaggggcaccagcctctaaatgctgtagcctgctggataggagtagtgactg

SEQ ID NO: 240268 - DNA, 668 bp, Homo sapiens
cctaagcatgcacagctgcaaacaaaatagtataattgtatttactcacatcccaaataatagcaatattgcaccccctttatatttttagcttgaatgagactatatgatggttcattatggtttagtgcctaaaacaaaaaatcaccataagtattgaattaatgtgtgcatgatgtcagaatttggaaatctgtcttttcatgcattttttaaagtgttcccagaaatcaagaaatagcaacaatgctaattggcttgtgatcacttaaatgttttcctaagggcaaggaaaaaataagcctttggaatttccctctaatccaaaaaagcaggtttgtgaaaatccagaagagaaaaaaaaattgtacttttcatactgcttaggaaactttaatcttattaacttttgtcaaggatattgacagtactggggaagcaaaaggtttactaggttaagtctagaaccagctatcttataaatatagcattttaacataatatattaacatctatagggctgtctgcttacgtctacctcccatgtagactgagtgtcctatccttggtgtgtagggaatctgtttcatgagccataatattgaacaagtatttttgttgtttttgtttccttttttttgagacggaatctctctctgtcacccagg

SEQ ID NO: 240269 - DNA, 413 bp, Homo sapiens
ccagctcaagtaaaggcttcagtgtctttgatctgggtctgacttgaatgcctggagtcagaacagaagaaggaacacggttatctttgaagctcacactggttgctggttgcccactcaacagatgtgagcagtttagttgtcaccataaatcaagggctcccccacaatgttataaatagggatgggtaaatattttggattcatcaacctccaagtatgcctcagatgttttgggttcaactaaacagaatacatcatgcaaaacacataccctccttgattttttaggaccgtatgtgatttatggaaaatagaatccatatgtttctgcttcatttacacttaaatcttcaaaaggttgtgtgttgtaagagctttttgatgtcgaagatgcctctgcgcatgcttaa

SEQ ID NO: 240270 - DNA, 520 bp, Homo sapiens
aggtgtgagaggagatgtaaaatactctctgagagcagaagagtgaattcaacaggaaaattagatatccagtaaagtaggatttaaggaaaaacaccgaatggaacctactgcccctagagaactatcaatttcatgtgaatgaaagttccaatccacaatgcagctataacaagatgaacatttatgtgcagagtcaaacagcattgacaagtaatacagacagtccttgacttagaatggttcaacttaggatttttccacttatgatgggtttatcaggacgtggccccatcataagtcaaggagtaataactgtagagtaataccgtttagaaacataattagaaatttggatgtggtggcacatggttgcttgagcccaggagttcgagatcaacctggacaatatagcaatatgccatctcaaaaagaagaaacaagaaacataattagcaactcagagataccattgcagctggcgaacctaacacatctgtctttgattgatagagtaggc

SEQ ID NO: 240271 - DNA, 598 bp, Homo sapiens
cactgcattccagcctgaacgacatagtgagacctcatctctaaaaatgtaaaataaaatgtaaacaaaaacttattttgaatatgaaacagtaatctttaatgcttgataatcttatatctcttccattttcacctagatttatgctgctgttaggcaactcttcatggtatgaaatatcaaaaaaaggatatttggcattaatcatttttagtggggactttattagtttttaatttatttgttaccatatagtaaggttttctgacataattgtcttataagcaggatacattttactactcttttgttgaccaacataatatcagaaagttttagtgctaaaaggaatgctattaattataaaatctactttctcaaattgttttccagtgttctggagtctcactgtctctactttctctggtgaattacaaaggtttcttctaagtatctacttggctcatccccattatgattcccttaacaagtaatacaggatacagcctttcttaaattcaccatgttaatgatcccctcatcccaccccaccccaatctgtctttcatataccatcaggtaggaccactatgctcca

SEQ ID NO: 240272 - DNA, 444 bp, Homo sapiens
  misc_feature (65)..(65): n is a, c, g, or t
ttttcatttttttggtttttgtttgtttgttttgttttttgagactgagtttcgctcttgttgcncaggctggagtgcaaaactccctcaaaaaaaaaaaaaaaaaaagattgcatctgaaagtgaatttaggggaaatgtcttcaagtaatggagaagtctagccatctcttgagacagttcactcacaagcacagtcacagccactgggtgtccaaggagaatgagagacatctgagggctaaggttggatttcactctggaagccacaatacacttctgagcctgtactgtaaataaaccctgacttcatcagactatgctgtggctgggaaggaacgtcattgtagaggggccagatgagcatgcagtgagaagctagaactgctggccggggtttatttgccattgttgggcaaacaggatcaccttggcccctagaag

SEQ ID NO: 240273 - DNA, 1302 bp, Homo sapiens
  misc_feature (14)..(15): n is a, c, g, or t
  misc_feature (298)..(298): n is a, c, g, or t
  misc_feature (1082)..(1082): n is a, c, g, or t
tcatacttagcagnntctaaaagacaggtaatcactttaaaattttttctaatgaatgccctgtgttcaaatcctttgttttcacaggattgggcttgttgttgttgtttttgttattcattgcctggaatacctttgctatgaatcaaagcaagtgccatgagaatggctgagttcagctggagaggagcccactcagtgggtttccatgtgaataatcatgctcttgcagcctttgggaggtcatttgctgcaggagattctaaaatgaacctgctatggaaatcagaggagggantgtggcctccatcttctgtaatgaaaagtatatacatcctcagggtcattacattctatggggacagggcaggaaactaaaaaaacaagcaaaggtgccagcaaatacagtggagataaactctgttgttcttctttgtctttgtttggcaacactaccagatttgaagaattgaacaaaagtactagcttatataggaataaaataacattttgcctttgctaggttctatttttctttagagccacttaaccagatacagcatagtaaatacagcagttcaaggggaagatggtaaaataaaggacaacaacaaaactccgaatatttgcagcttattaaatggcacattttgaaaagtgtggcttagaagatatccaagaaattaactttttccgtgtggtgacacatgtctgacaatgttgcagcattatatatggtttgggttacctgtatctattcatttttaaatgtgtagagcatttcctagaagcaagcaggcttgctagattcttaataaatattaactcatttaatcatcttaagagttctctggaatagacattattattggtagtgttattcccttttaacttatagaaaaacagagagtcagagaagttacttaagtttatggattattactgagtgatatctcattatttgagaattatatacaacatttgtctatattgaaataagaggtttatatttaatagttatttgtttatgagatcatagcaaaattcaaaatcagttattctctcgtgtgaaatgctttaancatgagcataaatatatttgttaatataggaagttaaggtcaacgtgatgaaattgttttacaacattttgctggatggcttaattttctttaacttacattgtttttaatggaaaacttaaaaatgtcaggttgctgaatcatgcggaggcaatcttcataaaatgcctgaaggtgattgctaaaaaaaagccgaagcggtgatggtatagtttatgct

SEQ ID NO: 240274 - DNA, 415 bp, Homo sapiens
gctgaaacatagaaatgggctgaagagtgtggtgactagatcataatatagtctttaagccatgttagaaagtttggacttattctaagatagtaacaacccattgaaaggttataaacaggccgggcacggtaggtcatgcctgtaatcccagtactttgggaggccgaggtgggtggatcacctgaggtcagatgtttgagaccagtctggccaacatggcaaaaccccatctttactaaaaatacaaaaaaattagctgggcagggtggcacgcacctataatcccagctacttgggaggctgaggcaggagaattgtgtgaacctggaaggcggaggttacagtgagccaagatcagtcaccactgcactccagcctgggtgaccgagtgagacttcatctcaaaaaaaaa

SEQ ID NO: 240275 - DNA, 487 bp, Homo sapiens
acatcattggtagtaaaggaggtgggaagtataggatgcatttttcatttaacgtttggccctctctactagagaaaaattaaaggtttccaaaaggatggatcttgtccacaacaataactgaaattgtaagcctttgtgaaaacagcccaagtggttcatgagagaaatgaatgttcatcaataatgtaaacactggacataaaagttaaatcaacaaagaatattcaccacccagctcactaaatccagcaaacttgggcacacaaggggcccactggagtcaatgatgttgtaatcaacagtgagcatttcggagacttataagctacatatttgtggttctcatttctcactgtgaacctttaaaaattgtttcaagtcatcggaggatggctaatgttaacagcaatacatattgaccatttgtataacattggtgtacagtgttacaaagtgctttgcatatacattatgttaacagatc

SEQ ID NO: 240276 - DNA, 711 bp, Homo sapiens
gaataaagaacctagaaataaatctacatatttacagccaactgattttcagcaaaggtgccaagaacatatattgggaaaaagacattgttcataaatggtggtgggaaaactgggtatccatatgcagaagaatgaaaactggacccctatcttgtaccacatacaaaaatcaacttgagatggattaaagacttaatgtaagacccaaagctataaaactactagaagaatacataggggaaacccttcgggacattggcctaggcaaccattttatagttaatatctcaaaagcatagtcaacaaaaatagactactgcgatgatactaaattaaaaagcttgtgagccagatgcagtggctcacgtctgtaatcccagcactttgggaagccaaggcgggcgaatcatttgaggtgaggagttcaagaccagcctggccaacatggtaaaaccccgtctctcctaaaaactaaaaatgcaaaaatctgggcgtggtggtacacccctgtaatcccagctacttgggaggctgaggcaagagaattgcttgaacctgggaggtggaggttgcagtgagctgagatcgcaccactgcactccaccctgggcaacagagcgagaccttgtctcaaaaaaaaaaagcttctgcacaacaaaggagatagtcaacaaagtaaagagacgacctgttgagtgggagaaaata

SEQ ID NO: 240277 - DNA, 438 bp, Homo sapiens
atatcccggaattggctctccatctttttctgtttcattcacactgtcccacattctaatccttgggattaaacttctcattaggtattgtgtacacaaatcttcatctcaatctatgatatctggcagaatttatgctgataactatactttctaaaattcaaatatgccataatgtttacaggatggtttaattagttgtaacatatttactgaagtaggcttaaaattaaattttcccaattaagtataaaaaattaattacactcttagaaaattcaagtccattattcacttttttgttagataaatacatttatcaaatttatataaattagaatatatgtattttatctgctttaagtatctattataacctgttgattattttaataacaattttcaaaaagcaggaccaatgtaaaagaaattaagagg

SEQ ID NO: 240278 - DNA, 375 bp, Homo sapiens
cctggtggtgaatctcgacttctacccttacctagcagaaacgagccccaacaccaccactttccctgccagagtcctgagaagccagcaaaatcagaaggcctaaatgagacccagagtctcacacacaatatctaaaagtccagattccaatcagaagccactcgccacactaaaggccagtgaaatctcaatatgaatgaaaaaagacaattaacagatgccaacaccaagatgacagacatgctgaaactgtataacaaagattttagagcagccatcagaaaagtgctacaagcagcaattatgagcatgtgtgaaataaaaaacaagaagtctaaacaaagaaagtattgacaaaaaaatagaaggtat

SEQ ID NO: 240279 - DNA, 234 bp, Homo sapiens
caattctatttctgggtatatataccgaggaattaaatgtcagaactcaaacgtatatttgagtttctgttcgtcagaactgaaacatatatttgagtttctgttcgtcggaactcaaacctatatttgagtccctgttcatatcagcatcattcacaatggctaaaatgtggaagcaacccaagtgtttcttgacagaagaatggataagcaaaatgtcttgtgtatctgtat

SEQ ID NO: 240280 - DNA, 255 bp, Homo sapiens
ggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctatta

SEQ ID NO: 240281 - DNA, 438 bp, Homo sapiens
ccaaacacacaaaaattgtgctgtaaattctattcaattgaattcgtccaaataaattcctagtgtttgaacttaggaccctatttccctctggggaggaaagaagatgtgattgggaggggccacagggggaccactaagatgctagaatgctgtttaggtgctggttaattcatgggtgtgtaaactttctgtatttctctgcatagtatttaatggatatttgttttttaattgatacctggaccttagccccagggattttgatttaactcatctggagagggtcccaggcagcagtgttctgttttttttttaatcccctccagatgattgtaatggatagccagggtgtataatcactgtattataatttcttatgaaaaggacaccttatggtcactatagaaatttaagaaataaagaaatgtgtaatga

SEQ ID NO: 240282 - DNA, 561 bp, Homo sapiens
aaatttgttgcctagtgccagactgcccacatgcttggagctttgagcctaggaggggcaggtttgtggctactcttgctgtggcatggtggttttggacccctaaggctccaaacacacttaaaggctcacctgtctttgagaatggttgattccccagggtataacctttatgtcacctgccttttaggccctagttaggcagcagttcttgaattgtagctctgaaaatcccaccatcctctttccccaaaggaaacctatctggctctctgtctcacctgtctacctatacaaaagaaaagaaaaaaaaagagaaagaaacctaagtccaggatgttggtcacccattcattctcttaatggcattagtggaacgcttccaggcattgagatgcagcagtgaataaggcagataagatctttgatcgcatagagagtgccctatgatggaggaggtaaattataaacaaatttagcaataaaaaatatggtttcagatagtgataatttgctgtgaaggaaataattaaagtgctgtggtaatgaacacatgagata

SEQ ID NO: 240283 - DNA, 376 bp, Homo sapiens
ggtttgtagtaagtttgaaatcaggaagtgtgagttattcaactctgttctttttcaagattgttttggctgttaagggtcccctgcgattccatgtggatttcagaattgatttttctatttcttttgggtagtgctgatatcttaatatcggattttctgatccacaaacacagatgtctttccatttatttgtgtgtttaatttcctttgatatgtaccagtcatttgtctccttggtttcttacgtattatttttttgatgttactgtaaatggaattgctttaataatttccttttcagattgtccattgttgatttatagaaacacaactgatttatctgtgttgatttttgtatactgcaacattgccg

SEQ ID NO: 240284 - DNA, 545 bp, Homo sapiens
tcaaagaagacttaaaaatgaccaacaaatatatgaaaaactactcaatatcattaattatcagagaaatgcaaatcaaaactagaatgagatattacctcacacccgttagaatggctgttataaaaaagacaagagataacaagtgttgttgagagtgtggagaaaagagaagcttgaacatcgttggtgggaatataaactgatatgcccactatggagaacagtatggaggcttctcaaaaaattaaaaatcagaactattgtatgacccagcaacccttcttctgggtttatgcccaaaggaaataaaatcagcacctcatagaaatgtctgtggtcccatattcattgcagcattattcacagtaatatagaatcaacctgtgttcactagtggatgaatggataaagaaattacattatatatacataaacaatggaatattactaggttttttttttctaaaaaaaaaaggagatcctgccattcgcgacaacatgcaaggacactatgctaagtgaaataagcccaacccagaaaa

SEQ ID NO: 240285 - DNA, 1803 bp, Homo sapiens
  misc_feature (1589)..(1589): n is a, c, g, or t
  misc_feature (1617)..(1618): n is a, c, g, or t
  misc_feature (1653)..(1653): n is a, c, g, or t
  misc_feature (1664)..(1664): n is a, c, g, or t
  misc_feature (1676)..(1676): n is a, c, g, or t
aaaaaaaaaacaaaggtaaattacatgtatatatgtgtgtgcacaaatcttaaagaatagagagataagtagtggtaaacctactattggttgaatcgtgggtgtcccactaagcgtgacaccgttgttccctcatggccacataagaaatagcctcccaagttcctgggacacctcatgcacttctccctggcttattcccacttccctctagaagccaacagtcttctgaattgcgggtcagccattcgctggcttttgtcggtttcccacctttgtctggatcctgaaactgcgaatgattttggctcagttcgctgggagccgggtgtcctgcactcttgggacaccaggagcagcagttcctgtgttcccattctccatttcagtgtccaaggtggcgccatccacacataatcacctgtcctgctggcagtgagcatttgggtgggtttctgggttttgtttttgctgccttctaagtagctgacttttcacccccaagctatgcttcttgaggcagagaagtgccagtttattttgttttctgtctctaaatccagttccttaatgcaccactgagactcagtttagaagtacagtgaaactttgtgagcatttttctccctgagtttgaatggatccctctctcattctttgagttcttgggcacttgtctcttagacactttcaagttacctactggacaggagagacctcttctctataaagtatcacacttggaggcttttcaggcacaggaccatagattgtaatattttccatagcagttgcccaattttatctgtaaaaattgctttttaaggcctggcacagtggctcacacctgtaatcccaacattttggaaggctgaggcaggaggatcacttgagcccaggagtttgaggccagtctggaaaacatagtgagacctcatctctacaaaaaattttaaaaattggttgggcatcgtggcatgcacctttagttccagctactcaaaaggctgagacgggaggatcccttgagcccagaaattagagctatgatcgcgccactgcactccagcctgggccacagagcaagaccctgtctccaaacaatcacaaaacttccaatggatgccgaacgtataacttttttttttttttttctttcttggagtaaaataacttgatccttgatctttggctgtagctcctgagccatttgaggcactggggggtttgtgtgttgattacctatgaaggagcaagtgggctgtttccttctcccagcggcttcctttgaccccaaatccctgagagtctcgcccattttcttcttggcttcctccctttgatatgcccagccggctcctgccctacctggctgccaccaggacctgctggaggcggttgctgggaattatttggtgtcctgtttgaacctcgcttgccgtgctcccagatttcctgtttctcctgggcttgcctttcaggatttgcagaaccccttctcctttagaagtgtcaactggggctgggtgtggtggctcacgcctataatcccagcacttttgggaggccgaggcgggcggatcacctgnggtcgggagttccaggccagcctgaccnncatggagaaaccccgtctctactaaaaatacaaanttagccaggtntggtggtgcacncttggaatcccagctactcgggaggctgaggcaggacagtcgcttgaacccgggaggcggaggttgcggtgagccgagattgcaccatggcactctagcctgggcaacaagaggaaaactctgtctc

SEQ ID NO: 240286 - DNA, 503 bp, Homo sapiens
caatgcttttcacttccagcccaactttgttatttatttagctctccagaagcctttgctaactgatcccaaactcgggaactctgacaactacaaatagttcagtaattaagctttcttttctgttcccattaccacatttgaaagtttgttctctctctttctctctctctctgtctctgtgtgtgtatgtgtgtgtgtatgcatgcatgcatggtgggaatggggggtgtatctatacaactttccatgtaattttatagacattattatgtattctttaaatcttggcacttgagcaagtctcaggttttgtcaaatctggaatacagaagaatattaaattaagtacttgtagtggggctgtacaccagtgtgtaagttagatgttttaaacatctaattgacctccaacttaaattatgagtcattatttttgtcataagttttaacagttcttgaattttataagtatctctagcttcttgataacttataaggca

SEQ ID NO: 240287 - DNA, 464 bp, Homo sapiens
cctagtagtttaatcccatgtctttgcaaggtcataaataagcacctgttggtggccaacattttacagggtcaaaaacacctgtagggttacatggtgataaatgcaccttcctctctttttctcccaggcaggcctaactattttataatttagtttctgttttctccagtggaagagtagaaccattctggaagggacattttcctgctgggccttggagtgaagggaattaactttgagccttgagtaagtcagggttgctgggatcactgctgcctgacctgctacactctgaacggggacaagtaaaacttgtttttattttgtgtagactggaaaaaaaaggcatttggtgagtttttaaaaaatgacttgaagctttgacagcactatagctatgagaaacattctgaagtgttttaatatagttgaatttttttttttttgagtcagagtctttc

SEQ ID NO: 240288 - DNA, 442 bp, Homo sapiens
ttagatatttattgaatgttgaattaatatatctttagagatcaatgagctttctaaatatttattaattttcttattttaaaatgtgaatattaatatacagttcgcattatgtaattttcacatgtcatcattttgattctctttatctccatcttcttaacaaaggccgttgaagatatacaaagaaaggcatggttaagaagagttccaatatcacttaattgattgctctttcttatttctaaccataacatgtgtatattacttgcccaataaactgtctcttgaaaacaggacatgagctttattgtatcctgaatccctaacaccaggctcagagcctgacacatggtatgcatttggcaaacctgtagttagtgtggaagcaaataaatgactccaagcaggactacatgttaattctaaatatacatgagat

SEQ ID NO: 240289 - DNA, 146 bp, Homo sapiens
aaatgtcttcaagcactctggcaagttacatatatcccattgcttttggttgcccatctcttctttgcttcaaacccccatgcgagtttcttcttttttcaggcagccctgtgaatttttagtctccatttttggcttttacaaac

SEQ ID NO: 240290 - DNA, 355 bp, Homo sapiens
acaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagc

SEQ ID NO: 240291 - DNA, 879 bp, Homo sapiens
attccttggaatctgtgaggccaagaaccccaggtcagagaacatgagacttgccaccatcttggaagcagcccaccaccatcttgggagctctgggagcaaggaccccccggatactataagaagattgggatagatactgagtgagcctcagaaaatcagctggatacaccccagtgggggatttgatgcagcaatatgcaggcatgggatatcagaaagagccagataaccaaaggaagagtagtagctgaagcaggattctaagaccaagaatattaatttcagggcagaagagatttttgctgtttcggtcgtggcattatctccagtatttatgtgcctggaacctgcagcagagccatcagaaaacaactcctgattttagttgatcagattcaagtcaatgaaaaaatgacgtttctgtgtgtctacttcgggctaagcaccagggtaggcacaagagagatcacagggatgaattagtcctagccccttggagattatcctctcaccctctccccgccatagttatcttggtccttttcacatatatcttagcaggttctgtttcaggcaaagtttcacttctgtatatgtttgttactactgttcatttgagatctgccactaaccctcattatgacctgggacatgtctgtggcccctccacatgctggcaggataaaaattgaccaaatatatgatgctgtcacatagatggatcctattatttggtgattacattgaaatctttactgtaaaaattgtgttgtcaaaaatgaaaacagatgatactgagtaactcactagtgccctaaagtactctacagcttttcaaacaaaattgaatattcttttcaacattctctctgtaaa

SEQ ID NO: 240292 - DNA, 538 bp, Homo sapiens
agctgtggaattataaaacctttggaaaatctttcatgtgagaacaacatgggggcaagcctctgaccaaaatagctcaaaaatttgtgttacgcagttacagtaaatacccaagagcttgacgcataaaacacaacagcctcctggagacagagggaggagaaagaaagataaagtctgtggctttagaagaaaaggaataacttaagaggcttgtttgctgttcaggctggccaccaaggatgacattttggatactataagaagattgggatagatactgagtgagcctcagaaaatcagctggatacaccccagctccctcccaccacatgaactaaagatctgcaagctgtaaccttttccgaagggctacctgggcctctgtgtccatcagagctgatgagctgatcttcattcaccataagtgcaactatcatggctcatggagccctggagagagtagcacatatattgaacttcagttttaaaaagtctaatacttttctaaaatgacttgctatctatttcatccaga

SEQ ID NO: 240293 - DNA, 413 bp, Homo sapiens
tgacttgcttttgtttatattttttattcccagtagaatattaatttcagggcagaagagatttttgctgtttcggtcgtggcattatctccagtatttatgtgcctggaaccagttactgagttaggacccatgatagattatatgctgaatcatttcatccaaattcttttcagcagtcaagtgaagtagatatttctcttcttgagagtaggtaggcaacagagcctgagagtagttagccactctaagccacatatccagtaagtaacagagccaagacctcagatacaattcagattttgctctaaatgctaaggtcttctgttatattgctctgcctctttccattgacctctcaattttcttttcagatccaacaggtatttttaaaactatactaatatagtaaa

SEQ ID NO: 240294 - DNA, 380 bp, Homo sapiens
aaatggtagagaaaagtatttgtgtgaccttaaaaaaaatcaaatgtagaaaaacattgcaagaaattaatctgggaacttatacacagacttgcaaaaaagtacagcttctgctaaaaaggcataaaacaatagtattgaatttcaggagataattcattgctacaaataggttgctatggcaccagaaagtccaggaagagctgattaaagtgttagctggctgacacattatggtggtgtggtagaaagtgtctcattttaataagtcacagtgctgcctaatctgtgtgcaaataaattaagaacaatgttatagatgtcattttggggcagatgtcaagattttgtcctacaataaaagtagacacattcagtta

SEQ ID NO: 240295 - DNA, 246 bp, Homo sapiens
tactgacacagcccatctcctactgtggaggctggacttcacagattctcactgtcccagactcagctgcagcaagctgatctatgactcagatctggccagtaaggcataaggtaaatgtctggaggatttctaaaaagattttcctttgtgataaaaagagagagacaatgtctcgattccttcatgcttttgtcagtgtatgaaaatgtgattttaggatccatggcaaacatcttctgtcta

SEQ ID NO: 240296 - DNA, 298 bp, Homo sapiens
aaaagccatctaaaaaagaatgtatttttttaaaagatagtttatagcagcaggaagcagattggtagttgcctggggctgcttctcaagtggttattgactgcagatgggcaggagggagttttttgggggtgatagaggagttctaaaactggactgtagtgatagtggcataactgtgtaaatttactaaaactcattgatttgtgaactacaatgtgtatattttaatagtatgtagattttattccaataaaactttaaaccaaaaaagtcaccattaaaagaagaaaaagag

SEQ ID NO: 240297 - DNA, 387 bp, Homo sapiens
tgccctgttcactttaaacatttgtctttccttgtatggtcactggatattaggggagactcaaaatgaatgaggaaactggcatgtgttgagtacttattgtgtaccagagactgtgctcagcagtccacattattttattttatttattaatttttttgagacggattcttgctctgtcacccaggctggagtgcagtggcgcaatctcagctcactgcaacctccgcttcctgggttcaagcgattctcctgcctcagcctcccagatacttgggagtctgaggtgggaggatcacttgagcccaggaggtcaaggctgcaattagccatgatcacactactgcactatagcctgggtgacagagagagaccctgtctccaaaa

SEQ ID NO: 240298 - DNA, 310 bp, Homo sapiens
tctcgtgagaattcactctcagaacagcatgcaggaaactgcccccatgatccaatcacctcttaccaggttcctctcttgacatgtggggtcttataattcaagatgagatttggatggagacagagcaaaaccatatcatccactttacccaaccaatcgatgaccccaaattttctagtccctcaccctccacaacccccttaaaaatccttgcccagaaccctatgaggaaacagatttcaagcttgagaattcctcctgcttccttgtttggcatcttgagattattaaactcttcactacatga

SEQ ID NO: 240299 - DNA, 381 bp, Homo sapiens
cccaaggccatttgttaattaacagcaaagtcacaaccagatccatatatccagactgttggtagtacaaacttctttctactggctatagtgatagtatctcagtttccactagagtttattcctgccaacaaagaatagataattgtatgtctgccaccacataccccttgcaaaatagcaaaattgaaggaaattattacaagaatatctaaagagttcataatgtagtcagtctctaatgtacactggattccagacaagttgctcagaaatgtcaatcccatgaagtatgagattcatgggtcattaacacgcaggataataactcttaaatcactgtggagatctccaaaatgggcaatgaaaactgcattctgg

SEQ ID NO: 240300 - DNA, 402 bp, Homo sapiens
gcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacatcaaccaaatttgggaaattttgatttgttagatttataaattttacagtaacacaaaagtctaatttcctatatattttcaaggcccctatacctttgtcaaaataaagtatcaatga

SEQ ID NO: 240301 - DNA, 554 bp, Homo sapiens
ccataactgagaaagtatttataaagcccaattcctagccaaattaacatatatcccaaaaggtaaggtctatttcatctttagtttatactcaatgcaatacgtccagcctccaaaaaaaatgacataaacaacaaccaaaaaaaaaaaaaaaagaaacaccaacaccattataagcaaaacacagtctgaagagacaaatcaaaaattaaaataagaatcagattatgacacagattttgatattatcaaatggagaatttaaaaatagttatgtttaatatggaacataacagaaaaatatagacagaaggttaatgaaagaagagtgatagaaactctaaaaatgaattaaaagaaaatgtaagaatcaagaacattgtaagagaaatgaagaatatctttgctgttctaataagtagacttgacatagccaaggaaaaaaatattacgaaactaaaatataaaaagcaaaaggaataaaagaaacaaaacatctaagaaatgtgagaccatttcaaaactattacatacaggtatgtggactaccttac

SEQ ID NO: 240302 - DNA, 431 bp, Homo sapiens
cttttttttcttctcaagtgggatacttgcttctgctcctcttgcccttggatatcagactttggtctctgggacttacataagtggattcccaggagctctgtggctttggtagcagactgaaggctgcactatcagcttccctggttttgaggctttcagacttggactgagtcactggcagcttgaaccctgtacctggaaaagtcacaagcactcaataacctgtgattgcagtctcaggggctgacccttgcaaagccacaagggcagagctgtccaaggccttgggagcccatcccctgcactagtgtgccttggctgtgggatgtggaatcaaaagagattattttggagctttaaggcataatgactgtcctgctgggtttcaaacttgcatggggcctgtatcccctttctttcggctgatc

SEQ ID NO: 240303 - DNA, 655 bp, Homo sapiens
tgaggatgcagttttgcagcagggcctagcaatgagatacgttgttacacatcctggcgaatctttctgtggactctaggatcctcttcatttgcaagaggtcagccatctatttcttccaattcctccagcttcacatatctccacagaatgcaacactgcaaatctgcagttctcttcatgatcctctttattagattttaaaagagtatctccaaaagatgaacatagtgcctaaggctttccaaatggagtaagaataatgcacaagaacctagaataaagttattaaatgtctgatacagttgtaatacagacttgatttttgaaaaatgtggccaatgaagagaagagcaaatgtgctatacgatggtgagcaaaaggtgttgacaggcctggcatggtgactcacccctgtaatcccagcactttgggaggctgaggtgggtggatcatttgaggtcaggagtttgagactagcctggccaacatggtgaaaccctgtttgtattaaaaatacaaaaattagccaggtgcgatgacacatgcctgtaatcccagctacctgggaggctgaggcttgagacttgcttgaaccggggaggcggaggttgcagcgagccgagattgtgccactgcactccagcctgggcaa

SEQ ID NO: 240304 - DNA, 448 bp, Homo sapiens
ttggatttgtgattttgatgaataaatttttataaatttttgtttcagttcctctgattaaaaatgacaaatgttgactggaacagaaaataaattaaaaatttattcaaaattcacaaaaacaaacaagtataaaataaatataaataattaaaacttcaaataaattttaatagtttttagcagttaagcttttgaagttattgaaacttaaactgcacagaaacatttagggtatactgtatatttattattttttgctaagccatttcaaaataaattatagatgtcatactttacccctaaaaacttcagcatgcattttccaaaaataatgatattctcctacataatcacaataccattttcacatataacaaaattaacgataattctctaatattatctactatccagtgcatatacaaacttcaccagtcatccccag

SEQ ID NO: 240305 - DNA, 650 bp, Homo sapiens
aatttaccattttctctcagtgtagggtaataaaaacattttgatatttaagttttactttatagatgatgtcgtgagttttaatcatgggctgaatatatttattggaaattttgtgtaaagaattctttgggccgggcgcggcggctcaggcctataatcccagcactttgggaggccaaggcaggcagatcacttgaggtcaggagtttgatacccgcctggccaacatggtgaaaccccatctctactgaaaatacaagaactagctgggcgtggtgtggcacacctgtagtcccagctactcgggaggctgaggcagaagaattgcttgaacccaggagccggaggttgtagtgagtcgagatagcaccactgcactccagcctgggtgacagagccaaataatgtctcaaaaaaaaaattcatctctacaataaaaccatgttggcccgccttgcccattcgattttaaattcgtcaagcttatgcttgcggccgcaatttggcctaatttggcaattcgccctatagggagtgtttacaatcattggccgccgtttacaacgttggacttgcaaaaccctggtgttccccctttaatcccttgcagttcccttttcccagtggcgttagcaggcccccccctc

SEQ ID NO: 240306 - DNA, 420 bp, Homo sapiens
aagaaagccaatttacctactttggtatttggtaaaatttttcacttctgttgttattttatgactatcctcttcatgtaatttatttgaaatagctgtacaacttatatttagaaagtataaatgactgaagtgatatttttaattaaacataggggaaagaagaaaagtttccgaatgatgatgttgttattgaaattgtttaaatgtgtggtttatagtatagatttttaaaataataggttttgttttgttcatagttaagtggagcataccaaatggttttatctaaaagtaaaattcatttgcactcactgaatattataaaatattatataagaaaataactgtacggctctgaggataagactttgttttgcaattacatgacagctttttaaaaataacatcatgcaacct

SEQ ID NO: 240307 - DNA, 325 bp, Homo sapiens
aattgttttgcctatccaccccatgctgccaaacccatatactctcctatcctcaatacctgcctctacaacccattattctgttctagatctcaaacatgctttctttactattcctttgcacctttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcataattctcataaaaacatacgtgctctccctgccaatcgtgtcc

SEQ ID NO: 240308 - DNA, 448 bp, Homo sapiens
ttaaaatttagacttgaacagtaaggacttcaactgaccttcctcagactgagaactgtttccagtatatacatcaagtcactgaggtaggacaaaagattgctacattcctattattttatggctattataagtgtaccaggactctaaaagaaacttgtttgtataatgctattctatccaaggtatgtagcccaggaaataaccaacctgatgcgtgttatgacccattttaagcctcccatgatcacagtttttaaaataaaattaaggactggtccttttctaagtgacacaagaaaggtaatagctagaacagaagaaagaggggtccccaaaaatgtaaccttaaaatttgatgcttgtgccactattaatagcaaacagcataggataagatgtggttctctagattaagaaaaaagttacacagcagaaaataagtaca

SEQ ID NO: 240309 - DNA, 394 bp, Homo sapiens
atactagttttccatctaatggataaaatcattatacataaagaaaaaaaccttcaatgcattaaatgacttatttttaataaagaccatctgataaaattagaaccttcttcctagataccattcttcagacaaaaggcagaaaggctgtctcatactcagactacaaagctgcaaagagctgtaatggtagattagcttgcctctaatttaaccagcaattattaggactgaataataaggaaattgtttcaatgcctgcataattatataatctctaagtagaaacaaatgaaaacattttcttgtttaaaaaaataaaaataaaagacgccgggcatggtggcctcacatctgtaatcccagcactttgggagggcaaggcaggcggatc

SEQ ID NO: 240310 - DNA, 640 bp, Homo sapiens
agttgaacaccagccagggcttaggttttatggacacacaaggctttgcattgtggacttgctctgaattctttcttgcctgagatctaagaaccgtctctgggagcctggattgggacccctttcctgtaacagatctacctcctactgggtccccaaaccagaactattcctagagaaggatgtctcctttcctcaaaaaagagagcccataaaactgttggaggtaagggctgtgctaaagcaagcagtggtttctgatgggcggagcctcccctcacgcttcctgctggcagatgtgaaaagccctccttcagaaatacgtctatgagttatttcccagataagagcaatacactcggccgagcgcggtggctcatgcctgtaatcccagcactttgtggatcacaaggtcaggagttcgagaccaacctggccaatatggtgaaaccccatctctactaaaaatacaaaaattagctgggcgcggtggtgggtgcctgtagtcccagctactagggaggctgaggcagaagaatcacttgaacccgggaggcggagattgcagtgagccgagatcatgccactgtactccagcctgggtgacagagtgagactacatctcaaaaaaaaaaaaaaa

SEQ ID NO: 240311 - DNA, 348 bp, Homo sapiens
aggggctgtgagtttgatctgggatggttagagaagaccttgctgggaaggaggtactcgatctggccctgaagggcagatggaattcaaacaggcagggaaggcagtacagagttttcttttcagggaagatttcagaaacacagatgtagaaatggcaatgctcaaggcagaactgttcttgcgacagtgagttatccagtggggccaggttgggtagagtgaaaataaggcagaaaagtagcaatgagggacaattctgtcactctccagagaggacaagtggagcatagccagttcctggaagctttatgctagttcaggatccgcctggatccactggtggtt

SEQ ID NO: 240312 - DNA, 534 bp, Homo sapiens
caacaattgtcctgtcaggtgtggaatctcatgggccagcagtggaagagcttccacctcagcattttgggagctaactacacagcattagtatgagctctggcattggctgtgaacatcagtggcaagcctttcatggagcccaccccacagtatgaacaagtactgttacccttcccagctacagagcatcgaagcccagttctctggatctgtgagctctctaatacctttaatatatctctttcctgttaaaggctacaagagagaggaagtattccagaatattctacaggggttccagtctatgccattgataggatgccattgtctaaagaagaggaagtacttttcaatttaaatacctaacaggtatttatcgggaagagtaggatgcactgaatttggcagagcatttatgtagaggcacttagaaattctgccctggaggttcagagagaggcgagggttagaaatgtggacataaggctgggtgcggtggctcacgcctgtaatcccaacactttgggaggc

SEQ ID NO: 240313 - DNA, 536 bp, Homo sapiens
tgcttcagatccaatcccatctgtaagatctcatgatctaatccaacagattatctcctttcccctttggattgcatggcaatacactctctcatcctcctttccaattttctcagtgtgctttactagttcctctgtagctaccaagtcttcaaatgttagtcagtgttctatatatctacaactatggtgtcaattactagctgcaaaagtttccaaattcacagccctcacctcatctctgtataaccagaaaatttatgtcaaatgttagatatcccccacgaaccctgttgctatttccctgcccagctgctccaaccaaaaccttagaagttatttccctctgcttcaaggtcaacatcaaatcaatcacgaagttctggctaccctagttcttatacattcttaaatacttcttctgccttgccccacagacctcccagaacctacatactgtatctccctattgccacttgtgctgccttttttttttttttttaacttttttttttaaattaaaaactctgccagcc

SEQ ID NO: 240314 - DNA, 588 bp, Homo sapiens
tgcttcagatccaatcccatctgtaagatctcatgatctaatccaacagattatctcctttcccctttggattgcatggcaatacactctctcatcctcctttccaattttctcagtgtgctttactagttcctctgtagctaccaagtcttcaaatgttagtcagtgttctatatatctacaactatggtgtcaattactagctgcaaaagtttccaaattcacagccctcacctcatctctgtataaccagaaaatttatgtcaaatgttagatatcccccacgaaccctgttgctacttgaacaagctcctcctccagtatccccatctctgtaaatgatacccatattttccctgcccagctgctccaaccaaaaccttagaagttatttccctctgcttcaaggtcaacatcaaatcaatcacgaagttctggctaccctagttcttatacattcttaaatacttcttctgccttgccccacagacctcccagaacctacatactgtatctccctattgccacttgtgctgccttttttttttttttttaacttttttttttaaattaaaaactctgccagcc

SEQ ID NO: 240315 - DNA, 496 bp, Homo sapiens
aagaattatgcattattaaaataatcactggttatgttcaggtattctctgtatacttataaaaggtttttaaattctatgtaattgtggattacaagaataaagagactatctttagtgctggttcactgtatcatcagtcagacactagcccttcatgaataggttatttatgggggcagccaggaagaaaaatgtgtgatgaattgctggcaaaatccactgaacaccaggaattcattgttgaacatccttgattgtcttgggagaattcccattccagaacagctaacacttttctggcaatatgaaggttttggatggaaagatcgaggcccagaaattccagctccaggactctcagttcttggagctggtccatccgagcctgattgcccaaatgaactgatattatagctgattaccaggaacacaatactaaacagatttaaatgcgtcagttcataaaatgttcataagcaaagtcactattcat

SEQ ID NO: 240316 - DNA, 758 bp, Homo sapiens
attagagttgtccgcagttggcagtggtgatcttcttgccagtctcaccattcccggacccagagcactccatggcttccatgatattcactccctcttctcactttgccaaagaccttgtgcttgccatccagccactcagtcttggccacacaggtgaaaaactgggaaccatttgtgtcgggccagcatttgccatggacaagatgccaggacctgtgtgcttcaggatgaagttctcatcatcaaatttctcctggtagatggactggcattattatggtgtgtgaagtcagcactctggcagataaaataaaccctggaataattctgtgaaagcaggaacccttataaccaaacccttttcctccagtgctcagtgcacgaaagttttccactgtttttggagctttgtcggcaaacagctcgaaggagctgcatgggccaaaggagttaccatcaacaatgatgtcaaaagaacacagtggcgttgaccatggctagaggcaggtggcttcaggtggcagcgatgactacaaagccccatttctcctttgaacctaacttcctttcctattttaatgtcccgtgaaggtagggaaaaataaattcactaaatatacggtaaataacatttaagtttagattttacagttgctagaattcaaagttatctgtgtattaatgttatcatattgcccaaataaagaattagttttgtttgatgaatttcgaacttctaatttatttgaggtggt

SEQ ID NO: 240317 - DNA, 486 bp, Homo sapiens
cggtagaagtgacactgtgtaacttttaaaattgagtctaaagagatctgtaatttctgtctcatactttgaacaccccttcttgggatccagccagcatgtgagaagccctggtggccatgtggaaattatatccacgtgagagagaggcccagtcatccctttcagagcactagagatgggagggaacccattttacatgcccagcccttattactatctgacctgagggagatcacaaatgccttctgtattgggtggtaatgatacatcacaaaaatgcgaatgctcgcagccaggcgggcgctgtggctcaagcctgtaatcccagcacatttcaagcctaggtgggtggatcccttgagcccaggggtttgagaccagcctgggcaacgtagcaagaccctgtctctaccaaaaatacaaaaattagccagtcttataacccggtctcaaatgaataaataaatagagggatacaaatta

SEQ ID NO: 240318 - DNA, 410 bp, Homo sapiens
ccttaaaatattcaagcccttttaccttccccaccaacctttatgccataatgtttagtacatcttcttataatgaaaatgtcaccagacaatgttaaactttttgcttgaaaaagtcatattttagggctgggcctggtggctcacacctgtcatcccagcactttgggaggccaaggtgggtggatcactttagctcagaagttcgagaccagcctgggcaacatggtgaaaccccatctctacaaaaaatatatatataaattagccaggcctggtggcatgcgcctgtagtcccacctgcttaggaggctgaggtggcatgatggccttagcccaagaggcggaggttgcagagaggcaagatcatgccactgcttgcgacagggcaagaccctgtctcggggaaa

SEQ ID NO: 240319 - DNA, 433 bp, Homo sapiens
tgtgatgtgtgcgttcatctcatagagttgaacctttctttggattgagtagtttggaaacactctttttgtagaatccgcaagtggacttttggaacgctttatggcctatggtagaaaaggaaatatctttcacataaaatctaggcagaagcaatctgagaaacttctttgtgatgagtgcattcatctcacagagttaaagctgtcttttgattgagtagttttgaaactctctttttgtactatctgcaagtggacatttggagagctttgaagcttatggtggaaaaggaaatatcttcacataaaaattagatagcagcattcagagaaacttctttgtgatgtgtgcattcatctcccagagatgaacctttcttttgaaggaccagttttgaagtactctttttgtagaatctgcaagtggaca

SEQ ID NO: 240320 - DNA, 1959 bp, Homo sapiens
  misc_feature (38)..(38): n is a, c, g, or t
  misc_feature (591)..(591): n is a, c, g, or t
  misc_feature (796)..(796): n is a, c, g, or t
cttttgatgttaggcccagtggccttccccctgacccnagcagcctctcatgaagacccactgaaggaatgggacaagagtggaggtaggttggtacatcacagactcatggggcagcatctgcaagacccttttatgatttatgcagaggaagcctggcttggagttttttagaccacccgggtcaggatcttagttctgccacacactgtcttggacacgttatttcatatcttgtgagttatgattttttcatctataaatctggcccagtgtctcccttgcaggattgttgtgtgagtccaactggcaccaaggaggtgggaattctgcaagaacagctgtcagtggtcatcatacttgtgctgtctatgtgcatggctttattgatactcggtgttcataaattaatattcccatgtgaattaggcagttttttctgagtagcaaaaacctcaggatttcagaggcttgtttgacagcagatatgtatcttcatgctcaaggatctatgggttggttgtggtttggctgatctagttgcatggctggttcatgccggacttgtggttgattgggatctgctccacntgtctttgatctgagttcagactaaaaggcagcaacagacagcggctatggagacatattccttttgtggtgcatcataagagggcaagaggaatagacttgggaacagcacactgtcacttctagccacattccattggctacagcaagtcagtgatccagtccagaatccagtgggacagggaagtaaacaccattcactctngtgggaagtactacaaagtcccatgacaaagggcagaaatgtgtagttcacagtcatgttggaagtgaactgggaagactcatgcagtctaccatactaactcagctgctccacttgggtgaagcaaggaaagcaaaagaataataaactgaggagcaggctgggagaggcattgactatgtatgcaagtaacagatacttatttttcataagcgtgtgcttagtaaagttgggttctggaggtcaatattataggaagatcatgatctttgattctgaaggatagcatatgtttatccttatgccagtaccacactgtcctgatttctttcaaagtcaggaaatagaagtccaacattgttcttcattttcaagattgttttggctatcctgagtccattgcatttccatatgcattttaagataagcttgtcagttccccatctaatttaaatttgtgattcagtgctcaggaagattcaattgctgttggcatctaagtttgaaggaaatggtttgatcgtttatccaacaaatatttattaatattgttgtgccgggcattgtagagttggtgctgcaacatacaccaataaacaaatccaaacacaatctttgtatccacatggcttacaattgaagaaaattagcagatattaatcagtcttcacgttgaaacataattaaaaactgagataaattccatgatctaatctgaagatgcagagtttctctgagaatataatatttaaggaagtacaggagttacctaggcactgaagatgagagaggaagccttccagacagagagaacaacatgggcaaaggacctgtggtggaacaactgcagcatgttccaggatctaagaaaatgtccaatgggccgggcacagaggctcacacctgtaatcccagcactttgggaggccaaggtgggcagatcacctgaggtcaggagttcgagaccagcctgctcgacatggcgaaaccctgtctctactaaaaatgcaaaaaagtagctgggcgtggtggcggacacctgtaatcccagctacttgggaggctgagggaggagaatcaattgaacccaggaggtggaggttgcaatgagccaagatcgcgccactgcactccagtctgggcaacgagtgaaactgtctcac

SEQ ID NO: 240321 - DNA, 642 bp, Homo sapiens
ctctgtgatagccgtgaaagtcgaaggcaccttgcttcagagagaggaattgccaagtgctgagcacggacagccgcttggtctgcatgggcaggacgtgcctctgtgcagtacccgtgaagtgtgaggttctattttggtctgatgttccatggagatggcctggagctcgattctgaaaaccgaagacagtcaggcggcagggaggggcggcaaaggaagaggaactgcacagatttctcttcccacaaacaaatatggtccagggcttcagattctctgaagtctcacagatacccggcagcacatggtcctctgtttgtttgtcgataacatttggagacacgcgcgcctcgtaaactgtcggcctgctgtgcttcttgtcacacagcacatggcctgcctgcgtgggccctgctatggccgggggcggggtaacttccagtgagatttgactgatgacaccgtcaaatcctgcgtgtgaaaaaacatgtttcggagactgagatgctctattttgatatttttaaagattgttaatgtatatttgactttcacaacaagctaacaggattagtaagtttttatggatttttaaatttctataggaaacaaagactgagattttgtgacatttgacta

SEQ ID NO: 240322 - DNA, 259 bp, Homo sapiens
agagacggctctgccatccggctcaggcagtgggcgcccgccccgcccccagcgcccacgcgactccggccccgaggctctcccgagcgcagcgttctggaagcgccgccgctaagcgtctgcgtctgcgcctgcgctgaccccagtcccggactcggtccgaggcgcgcagcccggagggggcggggccgagcccgaagggaaggcagtgcgcatgcgcggggcgagccggccggcactgtcacagctgagcggccgc

SEQ ID NO: 240323 - DNA, 2978 bp, Homo sapiens
  misc_feature (622)..(622): n is a, c, g, or t
  misc_feature (908)..(908): n is a, c, g, or t
  misc_feature (918)..(918): n is a, c, g, or t
  misc_feature (1360)..(1360): n is a, c, g, or t
  misc_feature (1440)..(1440): n is a, c, g, or t
  misc_feature (1644)..(1644): n is a, c, g, or t
  misc_feature (1704)..(1704): n is a, c, g, or t
atcactgatgggtattttgcttggttccaagtctttgctattgtgaccagtgccacaataaacatatgtgtgcatgtgtctttatagtagaatgacttacaatcctttgggaatatacccagtaatgggattgctgggtcaaatggtatttctggttctagatccttgaggaattgccacactgtcttccacaatggttgaactaatttacactcccaccaacagtgtaaaagcgttcctatttctccacatcccctccagcatctgttgtttcctgactttttaatgatcaccattctaactggcatgagatggtatttccttgtggttttgatttgcatttctgttatgaccagtgatgatgagcattttttcatatgtccgttggctgtataaatgtcttcttttgagaagtgtctgttcatttcattcacccacttttgatggcattgtttgtttttttcttgtaaatttgtttaagttctttgtagattctggatattagccctttgtcagatggatacattgcaaaaattttctcccattctgtaggttgcctgttcactctgatgatagtttcttttgctgtgcagaagctctttagtttaattagatcccattngtcaattttggcttttgttgccattgcttttggtgttttattcatggagtctttgcccatgcctatgtcctgaaaggtattgcccaggttttcttctagggtttttatgattttaggtcttaggctccggttttaactttatatcactgaaagaggcactgaagaggtggtaaaacagtcttgaatcaccgacaccacccctccctcatcctgtgacagcagtggcatggtgcagagagcttttctgtgcactggggagagagagagtgcagtaattatgaggcantgagctcagngctgtcctattataaaagaaaaaaactggatgaaacttaactgatgctcacccatggagggagcatttaatccagccctaaacagaggggaatcactgacccccagcagtctaaacttgagttccccgcaagccttgccaccatgggctacagtggcagtctaggccactgggactacaactcctaggcaagccctaatgctgaactgggcccagagacagtgatagtgggctaagcggggcatgtgacctaatgacacatcagtcaggggaagctaagggagtgctggcatcaccattcccctaaccccaggctgcacagcttgtggctccaaaagagaccctttccctccacttgaggagaggagatggaataatgtggaaaactttgttttgcatcttggataagctcagccacagcaggataggacatcagtcagagncatgaggtcccctttccaggctgtagctcctggacaacatttctatacatacctgagaccagaagagaacccactgcctngaaaggaaggacctactcctggcaggattaattatctcctaactaaagagtccttgggtcctgaataaccagcagtaatagccaggtatcatggcaagggccttgggtgagcctctgagacttgctgccttcaggtgagactcagcctattcccaaatctggtggctaggtggcaagatgcctttcacgtgaagaacagagganggaaaagtaaaggggactttgtcttgcaccttaggtgccaccttggctacagggggatanagcaccaagaggactctcagggtccccaattccaggagttggctcttggatggcatttctggacctgccctgggccagaggggagcctgttcccctgaaaagtgagtcccaaaccaggcagcattcaccacaagctgactgaagagctgttaggccctcaaggaacatcagaggtagtctggcagtactcctcatgagcctatggtagtgtggccacagggtgaggctcctctctgtttggaaaggggtgggaagagtgggaaggactgtgccttgtggcttgagtgccagctcagccgcagcacactagaataccacgtagaattctaaggtttttgcttttagttcttagctcccagatggcacttctggacctgcgtggggagtggaggaactcaccacctgaaaggaagaacacaggcctggctggctttaccacctgctaagtgtagagccctagggccttaagcgaacataagctgcagccaaggactggttatggtaagccttgggcaacacccaatgctgtggtgactttgggtctgatccagcacagtgctagtggtggtggccacaagggtgcttgggtcactccactgccagctccaggtggctcagaacagagagagaggctctgtttgggagaaagtaaggaaagagaacaagagtctcagtctggtaatccacagaattcttctaaatcttatccaagaccatcaaggcagtacctctatgagtctggaggaaccactgcattattgggcatggggtggcccctaaagcacatacagcttagatcacaactcccaagtccttctgaatatatggaaagccttcccaaggaggatgggtacaaacaagcccagactgagaagactacaatgaatacctaactcttcaatgcccaaacacagacaaatatctacaagtgtcatgaccatccaggaaagcatgacctcaccaaatgaactaaataaggcactagggaccaatcctggagaaacggatatgtgacctttcagacagagaattcaaaatagctgttttgaggagactcaaagaaaaatcaagataacacaaagaaggaattcagaattctatcagacaaatttagtagagattgaaataactaaaatgaataaagcagaaattctggaatttggcatactgaagaattcatcagagtcttttaataggagaattgatcaagcagaagaggaattagtgagcttgaagatagagtatttgaaaatacaaagttagaggaaacaacc

SEQ ID NO: 240324 - DNA, 464 bp, Homo sapiens
ctgcccagatgtgacacaatgtccctctgcccacagtccattgttcaaaggaaaccatatacacatgtttaacttcaaggtggcagggaagtgcaaccctaccatttactcagaagtggaagaactagcaatattttgcaagtaacttaataactaccacacttggcaagtagaacccatttctcagggtgcaagtcatcttccatagtgactgattatacaaactgtttggtgacacaggtcatatctcatttcaagatgtataattctgcaactttgttttgtctgtagcatgcatagaatgtttatgaagttaattattatgaagatatgatattaataaccatgcttttttggatatagtcaactttatgtaccttctcttttcttggtgttagaaggcagtgctgtatgccctttttccaaagctcccaggaataaagaggtttgccatttgtgctgtg

SEQ ID NO: 240325 - DNA, 836 bp, Homo sapiens
cacctggaattccacactagactcctaatttactgtgttcacttttgcccttctagatctactccagtcttggtgacttttacttttttaaaaataaaatgaaaaacaacataaaaaaggaataatagctaaattataatcttacagtggatgatttttgagaagtacatctgttctcacactatcatgtaaggaacgaattcaaggaactaaattttggcaaataccctcagaatcttagtcatagcatcatccaaatttccatcttgctagcccatgtgctctatcgcttgcttactctctctctatgtgtctctctctttctcattagctcacacactctctcactctctctctctcctcccctttcttttttatctccctctctctctcatggcttgctcatactgatgaaggaagttatcatggcagaaatctcacatggcaaacaattgaggatgacctttagtcgacagccataaaggaacagaggactttagtctaacaagttaatgataaaatgaatcctgccaatgaccatgagactgagtttgaggagtggattcttccccagaaaagccttgagatgtctaaagcccaggaggcactttgattgcagcctgtgagaaaccaccaagaagacacagctaaaccttacctaaaagattcttgtgaactttagaaaatatgagacaatcagtgctgtttcaagtcactactttgggagcatatttcttatgcaatagcagatactaacacagaaatgttacctgacttggaacatcacagattgttattgtctgctttttgtctttatataaactgaaatatatacc

SEQ ID NO: 240326 - DNA, 362 bp, Homo sapiens
ttttcatttcctggataaggaaatgagtgcctgcttataagtcccattagagattttccttcgaagaacccttcacagaatccaacaggcccaatacgtttttgctttttaatgtattggtcctagaataactggtacagagaatagaacacttcctgatcctgatagaaatgatcatctcaaaataaaacagcccaggagttacagtccaacagtgctgaatggctgtgacacactcacgttttgaccaggcccttggtcactgctaaatgtgactaaggtctttttagacaaaaatcctgacaattatcagggttactggaacatgttcctttatgccaaactttggctacccagtctct

SEQ ID NO: 240327 - DNA, 377 bp, Homo sapiens
ctgactccccagccctgaaccctcaggcctgagactcgctgtccagtgctgaaaacgtctgtctccctaacactgacaatcgagctcttttcatgtgttgcccggggaaatctcaggcaatgaatcttattcttaatttcacacttgcttttctttatggcatctagctaaaagcaaggttcctcttgattgaggtataatgctgaagtattaaaaagaagcgacaggatcatttataaaggcacctaccagaagctgcagagaggcacagagcagtttcttccctggtgtcttcccagggagcgtggtactgccagcacctggatttcaaacttttgatctccatagctataagacaataaactcctgctgtctta

SEQ ID NO: 240328 - DNA, 454 bp, Homo sapiens
ccactgtgcccatcctcttataattattattagtaatagaactttcagaaacattcaaaatattatcaccaattattctcttcaaatccgaccagaatggattcattttgcattttaaaatgtcttaattgacacttaaaaactgtgaatttcagctagtcaggaggctgaggtgggaggatcccttaagcctagagtttgaggctgtagtataccatgattacatctgtaaatagctactgcattgcagcctgggcaacatagtgagactacatatctaaaaaaaagaaaaagaaaaaaactgtgatatagaatgaagaataaagattgtagactttggaattggacaaaagttggaagcattccccttgaaatctggcacaagacaaggatgctatctctcaccactcctattcaacatagtattggaagttctggccaggacaatcaagca

SEQ ID NO: 240329 - DNA, 257 bp, Homo sapiens
ccactgtgcccatcctcttataattattattagtaatagaactttcagaaacattcaaaatattatcaccaattattctcttcaaatccgaccagaatggattcattttgcattttaaaatgtcttaattgacacttaaaaactgtgaatttcagcctcccgagtagcagggattacaggtgcatgccaccatgcctggctactttttgtattttaagtagagatggggtttcaccatgttggccaggctagtcctg

SEQ ID NO: 240330 - DNA, 1714 bp, Homo sapiens
acagcggggcgtcacctcggacatacgaacagcgggcggtgttcccggctccgtggggccgtcttcccggcgagtccgcgacggtcgccgcccacggcgagatgaaatctcgctctgtcgcccaggctggaatgcagtggcgtgatctcggatcactgcagcctctgcctcccgggttcgggcgattctcctgcctcggcctcctgagtagctgggattacaggtgcgtgccaccacgcacggctaatttttgtatttttagttgagacggggtttcaccatgttggtcaggctgttcttgaactcctgacctcgtgatccgcccgcctcggcctcccagagtgctgggatttacaggcatgagccaccgcgcccggcctgttttttttttgttggtttgtttttgagacggagtctcgctctgtcgcccagcctggagtgcagtggcgccatctccgctcactgcaagctccgcctcccgggttcacgccattttcctgccgcagcctcccgtgtggctgggactacaggcgcccgccgccacgcccgtcaaatttttttttttttttttgtattttttggtagtgacgggtttcaccatgttggccaggatggtctcgatctcctgacctcgtgatccgcccgcctctgtctcccaaagagctgggattacaggcgtgagacaccgcgccctgtccggcctgttattatacatatgattgatatctcgtgactccctaaaatgaatacaaccaagctgtgccccgaccaccttggacccacgtcgtcaggatctccggaggctgtgtcatgggcgtccttaactttgggaaataagcctcctgaaatgattaagacttgtcatttttctcgattgacattgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactagatgtgtcttgtataactatcccacagctactaagcagctggctgggactcaggatcaacgttggcctgactctgaagcccatgcacctccatagaccacactactcagccaggtttcctggaccttcaaggggctggagtgacacttctgaaataggagcaagatttttttgagaatgtcatcccatccatccattactcttcaccattggaaataattcactccagggaatggttctgaagtctcttgggaaaagcgaaacaatttgagaaaattgctgagcattgggtttaggaaattaatgtccaacattacatttttaatttatcataggagaaatttgaaaacacctataatgcactgatcatatctgcaaactctttgtattttttgtatttgttgactatttatgatttttaatatagacaaagtcaaattactgttcctgaatcaacttttgctctgtagacaaatgacatagcaatagggctgctgcttttttttcccagtgcaatttagccgaccagcagagtatgc

SEQ ID NO: 240331 - DNA, 1247 bp, Homo sapiens
acagcggggcgtcacctcggacatacgaacagcgggcggtgttcccggctccgtggggccgtcttcccggcgagtccgcgacggtcgccgcccacggcgagatgaaatctcgctctgtcgcccaggctggaatgcagtggcgtgatctcggatcactgcagcctctgcctcccgggttcgggcgattctcctgcctcggcctcctgagtagctgggattacaggtgcgtgccaccacgcacggctaatttttgtatttttagttgagacggggtttcaccatgttggtcaggctgttcttgaactcctgacctcgtgatccgcccgcctcggcctcccagagtgctgggatttacaggcatgagccaccgcgcccggcctgttttttttttgttggtttgtttttgagacggagtctcgctctgtcgcccagcctggagtgcagtggcgccatctccgctcactgcaagctccgcctcccgggttcacgccattttcctgccgcagcctcccgtgtggctgggactacaggcgcccgccgccacgcccgtcaaatttttttttttttttttgtattttttggtagtgacgggtttcaccatgttggccaggatggtctcgatctcctgacctcgtgatccgcccgcctctgtctcccaaagagctgggattacaggcgtgagacaccgcgccctgtccggcctgttattatacatatgattgatatctcgtgactccctaaaatgaatacaaccaagctgtgccccgaccaccttggacccacgtcgtcaggatctccggaggctgtgtcatgggcgtccttaactttgggaaataagcctcctgaaatgattaagacttgtcatttttctcgattgacattgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggtaagaaaattgatttggaattttgtcttgcaaattctttttaaatgactaaagataacattaacaacca

SEQ ID NO: 240332 - DNA, 243 bp, Homo sapiens
gaagcaaaggttctctattcgtaacagttgtacagtctgcctaaggctgtaattaggtattaccagggtgtggccacaattttcaaattacttacaagtaattttctctcaaatctttttttaaatggacagccagccttggcaaaggtagggatggaagtgttttacattgggggagaatataaatatcaaagaaatgtttttaattttgtagccaagacttgcaataggagaaactttatc

SEQ ID NO: 240333 - DNA, 521 bp, Homo sapiens
ctctcattacatataatgctgtgacacactggcagaatatctgatgaactatcattcatgacagaatgacttcaattacattgataacaagatgacatgttcatgtcgttggtatcctactcagtcttgccatctgttctcacagtaacattgacttaagggccatgttcctagttatttggttagaatttatttccttctgtattcagagccaaagcaaatattcataagaattgtttccggcagggcacagtggctcacgcctgtaatcctagcactttgggaggctgaggtaggtggatcacgaggttaggagttcgagactatcctgaccatcatggtgaaaccctgcctctactaaaaatacaaaaattagcctggcatggtggcgtgcacctgtaatccctgctactcaggaggctgaggcaggagaatcgcttgaacccgggaggtggaggttgcagtgagccaagatcatgccactgcactccagcctgggtgacagagcgagactccatctc

SEQ ID NO: 240334 - DNA, 403 bp, Homo sapiens
taaaaaggcaaaacaaacacttctgaagttcacagttagctctgagccaaacagattaaggaaaaagggatatgcctcctaaaatgacagcaagaagaagctctctatgggtcaaaagcaatattctgtgaatagccctttgctagagaaataaaagttattttcacatggttcagattagacagtaattacagtaatgataacgtatcctcagattcatggtaggatactggtgagtttgcactatcagaatcacataagttgtggagtttattcttgagaataataaccagcagttttcccaccgaaatttaaattacctttcaaatagaggaaatctttaagaggcagtcgagtataataattgagagcatgggcttcggacataggttatagagccagc

SEQ ID NO: 240335 - DNA, 778 bp, Homo sapiens
tatttttaaattttttgtagagatggggtctcactctgttgtccaggctgttctcaaactcctggcctcaagtgattctcccacctctgcctctcaaagggctgggattacaggtgtggtgagctactgctttgggccatgcctttcatttaaaaaaaaacccatttgagtgtcacaatttgttaggaaggaaacattgttgtcattttccagatgagggaattgagcccaaggaggatcgagaaacttgctcaaggcaacacagctaggaaatggtggcgagggcaagagagaatttaggtcttctccagcccaaaactccaccattgctctggtggtcataaaaactgaccttgcagatcttcaactaatgggagcacattttttcaaggggctgctgctgacctctgaacttcattacacttttacacagaggtcacacctcccacagtggctctcagccaatgactgggcctggcctgtagctgggagatctgagacttggctcaaggactccctgacggcctttttcagcctcccctagactgtagggtgttccaggatgctcctacccattttatctctttcttttctttactggtttcagacttaacttgcaatctgagggctctcccaatcttttccagccacctcctagtttctttcacaggtgtttcccctaataaaactcatacacctttatccatcttggtgtctgcctcttggaggaccctgactaacacaattgccaaaagcccccaccagattaccccacaat

SEQ ID NO: 240336 - DNA, 332 bp, Homo sapiens
cagaattctaccagacatccaaagaagcattggtaccaatccttttgacactattccacaagatagagaaataaggaaccctccctaattcattctatgaagccagcatcaccctaataaaaccaggaaagaacataacgaaaagacaaaactacagaccgatatccttgatgaacatagatgctaaaatccttaacaaaatactagctaaccgaatccaacaacatatcaaaaagataatccaccacgatcaagtggtttccataccagggatgcaggaatggtttaacatatgcgagtcaatgaatgtgacacaccacataaacagaatt

SEQ ID NO: 240337 - DNA, 497 bp, Homo sapiens
gtaggaccagctgccacctcctctgggaagctttccctgcccgtccacagggtatgcctccttgttcctctcctgccatcggtttacgtgcctgtctccatcaacagaccaggagctcctgaggacagggactgagtctgcctgattcatctctgcattcctagcacttaccttggtgcttagtgaaagctcgaacctgcctgggttcccaccttgtctctgctacccccagctctgtgaactcagagccaactactaagcctgtagcagcctcccaaactgcccagtcttgttcagatgcacctccagaaacacaggggtccaaaatgccccttcccagacaccctgaggagtagaacagtgccagcaggctccagggatgagggactagctaccacattccctttcccaagcctcagtttccccacctgtaagatgagggatatgggctctgactttctgagtttggaaaataaagtgctccccaaactggaaag

SEQ ID NO: 240338 - DNA, 691 bp, Homo sapiens
gtaggaccagctgccacctcctctgggaagctttccctgcccgtccacagggtatgcctccttgttcctctcctgccatcggtttacgtgcctgtctccatcaacagaccaggagctcctgaggacagggactgagtctgcctgattcatctctgcattcctagcacttaccttggtgcttagtgaaagctcgaacctgcctgggttcccaccttgtctctgctacccccagctctgtgaactcagagtcatttttctctccccgagtggcaccgggctcagcagacactctggccatgaaggcatcttctgactcaagcaggctggagtgcaatggcgtgatctcggctcactgcaacctctgcctcccaggttcaagcaattctcctgcctcagcctcccgagtagctgggattataggcatgcaccaccacgcccagagccaactactaagcctgtagcagcctcccaaactgcccagtcttgttcagatgcacctccagaaacacaggggtccaaaatgccccttcccagacaccctgaggagtagaacagtgccagcaggctccagggatgagggactagctaccacattccctttcccaagcctcagtttccccacctgtaagatgagggatatgggctctgactttctgagtttggaaaataaagtgctccccaaactggaaag

SEQ ID NO: 240339 - DNA, 553 bp, Homo sapiens
tgtgttgattgcactttttggctactatcaataatgctataatgaagatttgtgtacagctttttctgtggacatatggagtggaatggctgcatcttaatggcaaccctctgataaactttttgaggaactgccagttttctaaagcaggcgcccgcaccatttgacattcccatcagctgtgtgagggttccagtgttcccacatccagtacttactattttctgtctttttgattataggtatctttgtgggtgtgaaatgatatctcattgtaattttgatttgtttctaatgactagtttcattgagcatcttttcatatacttaactggccatgtgccccaattgctaaaacttagcactctgttttgtgataatttcctagtttgcctcctttgctaactagaatttctgggagcagaacttatgcttttttttttttaatcttcatgaccctgacagcaggacagcacttggtactaatgtgctctaaaataattcaattggaaaaggaagtagtatccttttctaggtagtacatgactatatt

SEQ ID NO: 240340 - DNA, 276 bp, Homo sapiens
ccaagaaaaatgatccagtcaataatggaattccaaataagatttcctttttatttggctattaatcagaacctgggataacatccattttctgggccctgattttactatggaatatttccataaaacatgcatgtgattactgtaaatgtcctgtaaacactcctgcttgggaggctgaggtaggagaatggcgtgaacccgggaggtggagcttgtagtgagccgagatcctgggctcactccagcctgggtgacagagtgagactccgtctc

SEQ ID NO: 240341 - DNA, 504 bp, Homo sapiens
aagttgcagtgagccaagatcgcaccactgcattccagcctgggcagcagagtgagacttcatctcagaaaaaaaaaaaaaagtgagacgacattacaaactggggagaacatatttccaacaaatataaccagcaggcgatttagtatcaagaatatctaaagaacactaatgtgaaaaggacaaatagccctatggaaagctggatgagagacatgaaagggacatttcatagaagtggaaaaacaaagatacgaagataccttaacataaaggtccataaacattcaaagagatgttccacctgataagtgattagggaaatgcaaattaggaccacagtgagatgccattttacgtctattgtagtggcataaatgaagaaatctgatcattttggagaggatgtggatctacgtggtctcttatatattgctgttgggaatatcaattcaccattgtcatgtgaaatcaaacatttagaaatcattgcccagcaacctc

SEQ ID NO: 240342 - DNA, 1340 bp, Homo sapiens
  misc_feature (59)..(59): n is a, c, g, or t
  misc_feature (112)..(112): n is a, c, g, or t
  misc_feature (404)..(404): n is a, c, g, or t
  misc_feature (609)..(609): n is a, c, g, or t
agacatgaaaaccttatgtctatgtacaaaccaaagaaatgacaatgtggcaaacccantcaacgtggtccctgcagcccagctgctgggtcttagccatagtgcagcagcngagctggctgcttaactcaaatactctgagcactttggccaagacattggccaagctagttaggctgcttatacgtgtatggttttacatagcctaaaagagactgtaaaacctccctgctgaattttggttccccacttatgacttaggctctttaattatattttgtactagataatgttacttttctacatataatctttccttatattaagggtacacatacactgcaaagttctaataaggaagaaaaagtctattgtgaaactgcaaagagcaaaaaatatcagangctatcattactattggtttttctataattttgtttaaatttcactctattaaaaaattacgtatcacaggaatttaccaaaaattcttttggggaactaaacattcattaaaaattttaggctgggcacggtggctcatgcctgtaatcccagcacttttagaggccgaggcgggcagatcacttgaggccgggagttcgagancagctatgcagcatggtgaagccttgtctctactaaaaatataaaaattagttgggcgtggtggcacacaactgtagtctcagctacttgggaagctgaggcacaagaatagcttgaacccgggaggtggaggttgcagtgagcaaagattgcaccactgtactccagcctgggcaacaaagtgagaccctgtctcaaaaaaaaattttttttaaggttcacgtttctttatttaccttaaaagaaggcttaatgaatgttctcatctaaattaatatcaaagtagaaaaaaattaattctaagagacattggaacaaggtaatatgcccttaaccattcatttttagaataattctgaagcactattcagctcaacaaatgagttattgaatgtctgatatctgcatggcactgtaatggatttagcttgcaacttgataaataaaggtacttgaggctgggtgtggtggctgacgtctgtaatcccggcactttgggagaccaaggcaggcagatcacttgagtgcaggagttcaaggctagcctgggcaagataacaaaaccccatctctacaaaaaattatccaggtgtggtagcacgcacctgtagtcccagctactcagaaggctgatatatgagaatagcttaaacccaggaggtggagattgcaatgagctgagatcgcaccactgcactcccagcctggacaacagagccagaccgtatctc

SEQ ID NO: 240343 - DNA, 221 bp, Homo sapiens
ttatgaaatactatgcaatagttaaaaagatttaatatacacaaatgtctatttatgtagatgttaaccaaaacaaggaagttgcagagaaatgtgtacgtgaactcctattcacatgaaggaaaaacactccacaaactgtgtgtgtacacatgcatgcacaggtgtatttgtccattttgcattgcctgaggctgggtaatttataaagaagtttattt

SEQ ID NO: 240344 - DNA, 468 bp, Homo sapiens
tttagatttttgctgtagtgaacttgaaaaaaatactgcagtgagtattcttcaacatgtgtctttatgtacacatatgtgtatttgtaagataaattcctaaaataaatattttactcaaaaaatatctaaaaataccctggaaagcctctatatacaatcaggctttaaagaaactgaagggattattataatcatcactgtgtgtttgattttaagtgattgcccatttaaaacgcttgaagaattaaatagagccacgtttaaatcagtcaccattcatagactgttctctgtgcacatgactttttccataggggttggtaattaaccattggttcaatattcattagtgaatagttttagattagtttctgtcagttacaagtcttgctaggactatataatggatgataccaatgtttattttggcaaaatattaaagtataagacaaacataataaatat

SEQ ID NO: 240345 - DNA, 289 bp, Homo sapiens
ttaagtggaggaaacaatctcccagagggaagtaacttgcccgcgggcccacagctgtcaaggggagggctgcactcctgaccccaactctgcctgcctctggaatgagttaccctttgctggagccggaccgtgtgtacagcacttctgggtgctccacgaactttcccagcacagcgcttggcacatacaaggggctcaaaattatgcgtaacggagagaatttcacaacgtccctatgtggaagaaatgatcacctccgtttcagaaataaagaaatgacaccaag

SEQ ID NO: 240346 - DNA, 94 bp, Homo sapiens
atgaagctttcttcttggtggagaaatggggtatatagaaaggagagaaattattccaatttcacaacttggtgtctggaatttataggctgag

SEQ ID NO: 240347 - DNA, 626 bp, Homo sapiens
gtctgatattttcttcttcattttttgataggactttttttttcctgctcaaaagtgactatctggtagtacattcccagaggatcctggccaggtaacagagaagtctgaaaggctaccttgagataaggtactaacagcctgtggtagctttaatagaatattctggtttaaataacaaccttgaacatccaacttattcagattcaacaaacatctatcgagtatttaccctctgcagataagacaaggccatgtattagatgtttcctcatgtgttatatcatttagtgattacaacaaacatcaaaggtagcatccctactttacaaagtaaaacacagatactcagaaagggtaatttattcactgaaagtcaaagtgagatgaattcaaacataggtcctctaacacccagggcacagactgatgatgttcatgaccagctgagtttatgaaatctcttacgctgtctgtccctaatctgcctatacattagcaaggtgtagagaagcaccatgcttctgtccaacataacagggttagaaggtcacttttctgcatgtttctacattattttcaaaactgccattcatctgcgttttcaaataaatatcaacaaaatt

SEQ ID NO: 240348 - DNA, 6303 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacacttaaaacctagaacttcaaaatgttcgtattctattcaaaaggaaaaatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaat

SEQ ID NO: 240349 - DNA, 706 bp, Homo sapiens
tagtaagacaggtgccttcagttcactctcagtaaggggctggttgcctgcatgagtgtgtgctctgtgtcactgtggattggagttgcaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgaggtaaggacatcctttggaaacattaatttttcattgagtttggcttgggccagactaacatggtaatagacctgaatgcataatgagttcttactttgctatcatcaaaagacttttcatcacagttacatactttctaatttatggaaaaacagcatttggaaaacaaatgttttgtttttatttttttaaagatttaaaaaataaatcaactagggactaggaatcaacaactgtgagtgagttaaactgtgttgaaatactaaagggttgtgaaagattagtgacaaagaagaacaaaagtctaaacctgtttattcctgtctatttcccacagaaagaatgagcaataaatggtacctcatataaattaataaataagaaggcctttctttttaaccaagg

SEQ ID NO: 240350 - DNA, 759 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgaggtaaggacatcctttggaaacattaatttttcattgagtttggcttgggccagactaacatggtaatagacctgaatgcataatgagttcttactttgctatcatcaaaagacttttcatcacagttacatactttctaatttatggaaaaacagcatttggaaaacaaatgttttgtttttatttttttaaagatttaaaaaataaatcaactagggactaggaatcaacaactgtgagtgagttaaactgtgttgaaatactaaagggttgtgaaagattagtgacaaagaagaacaaaagtctaaacctgtttattcctgtctatttcccacagaaagaatgagcaataaatggtacctcatataaattaataaataagaaggcctttctttttaaccaagg

SEQ ID NO: 240351 - DNA, 5648 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaat

SEQ ID NO: 240352 - DNA, 287 bp, Homo sapiens
ccctcgagcctccggaagaaaacacagccctgccaaccttgattttagcccagcaggaccaatgctggacttctaatgtacagaactgtaagataatcagtgtgtattgttgtaagccattaagttcattgcaatttttcaaagcagccatggaaaactaaaacacgagataaaatgttgaatgcttggtgtcatttttcagagaggtgatggccattacttcagagaattttaactgtattattgtgtaatttcgcaacaataaacgaaatatgctaccaacaaat

SEQ ID NO: 240353 - DNA, 429 bp, Homo sapiens
tttttgagataggagttttgctcttgttgcttgggctggagtgcaatggcaacatctcggctcactgcaacctctgcctcctgggttcaagcagttctcctcctcagcctggcattcaaggctctgatctagccccaatccctcccctcaatgcggctaaaactccagctgtaggctggatcattttcccaccttcaaacctttgttcccaccatgtcctgcagaataccctccccactcctgtgtctggcaaaatccttaaagtttcactcaaatgccaccttccccaaaccaataaggcaactctgcttttaaatgctcccactgcatttgcatatgcttccaaggtatcagaactgcatatgcatctgtccattctagaaaagggtaaactccctaaaggcagaagctatgacctacagctcactg

SEQ ID NO: 240354 - DNA, 366 bp, Homo sapiens
aaaatgacttaggtctctcagatgtggtcacctcattcccatttgcctgtgtagccaagagacctgaggccacccatccatgttgttgtacaccatgtttatgttttgttgatttctcccacatgtctgtaattcagcttgcccagcaggctacgtggcatttccctaccttgcatatcttacctcaactctaagcagaagctgcttaacaattttggttaataaaaccatattttcaaagctggatgaggtggtgcatgcctgtaatcctagctactcaggaggctgaagtaggagaatcccttgagcccaggagtttgagaccagcctgggcaacaaagtgagaccccatctctaaaaagaaaa

SEQ ID NO: 240355 - DNA, 299 bp, Homo sapiens
agtaaatctgctttggctatactgagactgtcaacaaagacatctgttagcttagtagctctgtgagctatcagtcaagtgtttattgactgcttctcgggaagatgctcagtggtaaacattctatgaagacaatcacattatataaatgccatcaaacatgttggagagatttccagctaacctcgcctgagtacatctgagcagttcattaacatccggagaaacatccagatctgaaactcgttattttaaatctttccaaagtgagacactcaataaaaagatcccaaaataaa

SEQ ID NO: 240356 - DNA, 494 bp, Homo sapiens
catccaaaggttggtgcattatcagaatgatctgaaggaaaaataaattattcacatcaaggaagcacctgctctctctttcctcctgcatgtcccaactagaaaaagcatctcttgtgccagatggaaagaaaaagaggccagggtgtctgagaaggtccccagcatgcccacctgtacagcagcctgggaagcctcagtatctgacctgccctgggaaatgacttccaaacgccttcagggactaggcacttctcacagcttataggagtgcatgaggacacctcccagcctccagccctggaaaaagcactggacctctccagctacatgccttctttgtccttctcccagtcaaggctccacaggcaaggcctccaccccccatcttccattgtactcctgcgcagaagctgaggatgggaagcttagaataaattatgtgagccctcgccctggcagaagtgacagggtggacaccacacactatccca

SEQ ID NO: 240357 - DNA, 513 bp, Homo sapiens
ctatggaaaaaaagtaaatcttagttccacttttgccagttttgtttctgtattttttaaaaaattacatttctactaggcagaatttagaggtttattatcagtctatgcataactaaagttcaaagcaaattcgattttgcttaaggggaacatccataaagtagcaattcttggtgttacatgcttcacagaatccatttcaaaccacagagaattgcacctttgtgtgtcactgttcccaaaggcaaacaaatttgaaaagttaaaacatatttaaaatgtaccatgcttatgaagtctcaaacaaaacttgagttttctgcacatactctcgtcaaatgaagttatttcctgcatacaacttctcttgcaaactggtcttctatttcctttcattcaacttaaactgactgagacctagagaaggatcgggacggcttgtgatttctctcccaagacagtgatctctgtgttttctcctatctctagaaaagaagatactccccctgt

SEQ ID NO: 240358 - DNA, 407 bp, Homo sapiens
cctcccatcccccagcccctgctctctgggaagtctgctgggtgtgctgggccggctcctggacaagctgaagccgaggactgcagcaactcttcccatcatcaccctggctgctgtggggaagctggcagttttctggaagactgcttgcttggaatgcttagcatcctcccaggcttctgactctccactggggatgcagaaggtctgcattgcagtttaatccactactgagaattcctgtgcttctagaaaccatcctctcacctccgagggactccatcttgtcagctgcccagaggagacaaaacggaacactgccccatggctcagtgctttgcacagttgtcagctccttggctggcaagcatcagattgattaaaaggaggttttctcagacataatc

SEQ ID NO: 240359 - DNA, 270 bp, Homo sapiens
ggtagatttgttttacagtgaaagtaggtgcacacacacacacacaaattgctcatatttgttgtaactcatttttttaacttgtttttggacagtttttcgttatgttacttcatgtttttaagttttgtggtggtgtgtgcctgtagtcccagctactctggaggctgaggcaggagaatcgcttgaacccgggaggcagaagttgcagtgagccgagatcgcgccattgtactccagcctgggcaacaagagcgaaactctgtctca

SEQ ID NO: 240360 - DNA, 487 bp, Homo sapiens
catgcccatcaacttgcccagctccaggggggatgctgtgtgctttgcaatgagtggcaaaacacacagtgtggggacacactggggaccaaagtccacccctgcttgtgggattcagctccttggtgcccactgactcctttaatgccctttctttgtgagaaggaagaacatggctgggaacgtgttagccctcaactaaccagttgagtgttgtgcatatctctttagataactttccttcctaaaatgagcacattatattcctgagatctgaaactttacttttccaagactgtgttcaagtttggcaaaatgagcgctgagtccaaaaattaaagcaatttaaaagacccactatttcccgtatcataatttaggctacatatttttagtatggtttcctactcctgtgttttattttacaatataaagaaaaatacctgctgtaaaggaagtaaaattctataaattataaaaatgtttt

SEQ ID NO: 240361 - DNA, 381 bp, Homo sapiens
ctgagggtgctacctggtattgagtgctgaggcttaacatttttccaagagaggagaaaagagttaacagcatgaaagctcatctaattcatccctctcccatttcaagaagagctcctataaattgtcctgcacagataaaaccgatagtttttaagaccaccaaaaagggagatgtgaatacctcttattccaacttttgttggaaggaaaaacttgtgtctaaaccaaccctgcagataactcagcctaaaccaaccccgttaggctgtatttataatctatgtcttctagttttctcctcagctagtcattaccttttttgattaaaaaaagcacacttctttaacctattaattataagattttctttttctttca

SEQ ID NO: 240362 - DNA, 454 bp, Homo sapiens
ctttatcaggtttgttatggtggaacaggaaagagagtttgtttttttttttgggaaggatactaactaaatgtaatttaccagaaggatgctaaatgtaattttctggcctagcagcacttagccattcagggaagattatacgatttcagtaacataaatggcattttaattgggcaagtataaaatatttattttaattgaaattgcttttgttgtatcctcagccctttttgttaagatctaagagttaagacttttgtctaattcattctggtgttgcatttaatgtggttaatttgctaacctgttagataacaggctacattttacagtccttttttgacttgaaatgtgaacaaaatgagtgaaaagctgtagcgtattggctgagagaacaagctttggaatgagcctgtctgatttcacattctttactcttaccggctctgtg

SEQ ID NO: 240363 - DNA, 287 bp, Homo sapiens
ctgctacaggtcttacagggagggtgagctcttggagttggatcagaaggagaggggctggggaaagatcgtcttcaaattgtttctttggcggtagtatatataaacatatttaggcagggcatagtggcacatgtctgtaaccccagcactttgggaggccgaagcgtgaggatcgcttaaagacaggagttgaaaatcatactggtcaatatagtgagattgcagtgagccattatcgcgccactgcattcctgcctgggtgacagtgcgagaccccttctcaa

SEQ ID NO: 240364 - DNA, 477 bp, Homo sapiens
aaaattcagttattaaacatattttatgattaaaaagaagactgccaaaatcgtgaagcagttggaaaataaaaacattacacttgaaatttcaataacagtaagtttgagctagttgtatgtttgttttagaattttttggttatcatgagatttgacatcttaagtaaaaggtctgtttgttataccatgttctggtgtactctagtggttttgacaaggtatatacacacagatgttagaaaaaaaaaaacctttggttgttgcaattttctccttattgcatctaattgaaaacatagaggaaagtgtagaacacatctgtgggtacttttcataccagtgatagtaccatggaagccatggaagtctttaagagaactcctataggcttagaatgtagtgaaaatgttaggggactctataacatttgtattaccacccttacccttactccttacccacccacctgcaaaa

SEQ ID NO: 240365 - DNA, 389 bp, Homo sapiens
agtttgtcctttaaccattgtacgttcttgtcacctcagttagctgtaaatgcatggatttatttctgggatctctattctgctctattggcctatgtgtctttttatgccagtaccatacagttttgcttattgtggctttgtagtatatttcaaaggcagattctgtgatgccttcagctttgccctttttttatactcaattattttgactattgatggttttcttttgtgggacaagatgaattggggtattccttttgtatgtggagaatgtcactggtagtttgatagggattgcattacacctgtagatcattttatgtaagatagacattttcacaatattaattctaccaatttgtgaataaagaatatctttcttttta

SEQ ID NO: 240366 - DNA, 2882 bp, Homo sapiens
aaagttagtctaactattagactgtcagactctgaagtgtttcttattttggaaaggtgaagacttgctttagtttgttcatagtttccttggcagctgctgatggttttgatggagattcagatggatttggaactaatgctaacttctgcttggtgaagatgctaaccaagttagatactcttcagtgaattctggtactgtgtacgattaatcctcatccacagtattacgctgtgcaaggctatatatacacaggattaatctttccatgatttccactgccctgaaggaaattagaatgtagtctggctccaagaaaacactagaaactacttcagctggtgatggaaaatagtggaattctatacatcctttgagacaatggaagcagcaaaccagcgttctttggattggggaatatttttggtactaactgaaaaacatcattttaagcctggccctgcttagaggagacttgttttctcttccctctctccctctcttccttttttccctccttcctctttttctttcctcctttccttcttgtctccctcccttctccttccttccttcttcctctttttctttcctccttccctccctccctcccttccttccttttttcctttctcccctccttccttcctttttttcttccttccttcctccctccctcccttcttttcttcctttcttcctttgccctaaaacttgggggaccctgcctgctcattttgtttagaatagaagattactacttttctctgaattgtcatttatttttagagaggtaagaaaaaagggaatagctgccttccatatatacttatgacatggagattatctactcatttaactttgcactgctattggctgtttatttggcttttgaaaaatcaggtgctatttattcattgggcttgtggggaactctagtagccctgaatggcatttgtggcatactcaatgaagtctaattctttatcctggcattaaaggcttaccaagatctggcctcaatcttgcaaatgagcactctcttatatacctgaaggaaaagtgctaatttagccaactaatagagataggtataaataccaatatagacatagatatgaaactttagttgcaaagaaatgtttaatatgcttcaaagtgcatatttccctcttccatgctttattgtctattcttatcagcagaaatgttttcctatttttccttacctgtgatgtacctatccatcctttacagttgagttcagatgctacttctgtcatgaacccattatttatcctccctgtgagaattcatttttccctgtttttggatcttacagcctttgatttgagcccccatttcagtctgctttatactactgtcttgcatgttttcccatgataaataagatggtttttgggaaactgaactttggacttacttgattctcttataacaccaggaaattggccaattctagttgagttatggaaatatgttgtctgctgcataccaggcaagttcaagaataccagcaactcctgctacttagggtaatggtacaagtaggattaagtggatatagttgctatctatctgtagaagacaatgagtgagtgctgtcttaagtttggaaagtagttgattctctgcagaggggtataaactactgatgaaaggagagtgactcattactcctagagattctgaatgggaagaatgccagctttatgttttctgatactgattttttttttaataacttggtgcaaaagtagaacattattctaagatgactgttgtggaagaaaaaaaaggtagaacattagagttgtaaaaatgtttttaactataaagaggaaaaaactgaacttatttataattcatttacctagagagaacattcaacattttggtcaatgtattttttttctttatatctatgtagatatatatttcttcatttatttaacaaattgctactgacaccctatggtttgctggaagtgagctgtgtaggaataaccatgagcctctgctctgatgtaatttttagtgtatgttgtatttgttgacatataattttatattttgcttttttcacttaatgtatcatggaattttttcatatcattaaatattctctttgtgtggcacaatagtatttcagcatgtagatattttgtaatttattgaatgaatcctttttgttgcatattttcaattttgtctgtaattatatagcaatgcagggaatagtcccgtgtagcaggtggaattctaagatgaactccagtgacacttaccttgtataattccctctccctgtgaacatgatgggatattacttccatgattatgttatgttacttgcaagggaattttggagatgtaattaaggttgctaatcaattgactctgaattaatcaaaagggcaatattctaggtagacctaacctaatcaagtgagcactttaagaacagagagttttctcctgcttgtggcagtagaggaagtctgagagattcaaagtgtgaaagagactctacaggaggaatgttctccattgctgaaatgacaatttcccacagacaaggacctgagggaagcctctagaagctgagagtagtccctgccaacagccaaccaaaaaaactagggaccatagtcctacaacagcaaggaactgaattctgcaaacaatctgattgcgcctggaagcaaattcttccccagagcctccagataagagcccagcttctgaccaacatcttgatttctaccttgtgagaccctaaacagaggacccagttgagcccacctggacttaagatctacagaactgtgagataataaatgggtgttgttttaagg

SEQ ID NO: 240367 - DNA, 397 bp, Homo sapiens
caagcttggggaaatgccttttttctgaaacatttcctatgaaatagtttggccccacgcccactaactaaagaatgaggctggcagggcgtggtggctcatgcctgtagtcccaacactttgggaggccgaggcgggcagatcagctgaggtcgagagttctagaacagcctgaccaacatggagaaaccccgtctctactaaaaatacaaaattagccgggcgtgatggcgcatgcctgtaatcccaactacttactcttgaggctgaggctgacgcaggagaatcgcttgaacccgggaggcggaggttgccgtgaaccaagattgtgccattgcactccagcatgggcaacaagagtgaaactccgtctcaaaaattaattaattaatttaat

SEQ ID NO: 240368 - DNA, 2115 bp, Homo sapiens
  misc_feature (464)..(464): n is a, c, g, or t
  misc_feature (1909)..(1909): n is a, c, g, or t
ctttgaaaataattcggattttaacttctactgttctctccttcctttcattgcccactctcaagtactaattaaattttgtcttttctaccttataaaataaatatctcatccatcttttcaatagccacatcttcttcacaactcaccggaactgttgcagcagttgcctcctgcccatcccctcctccagcttccctgccaatcagtttgtaatcgacagtggtgatacccctcatcatggtgttgttctccagttgatattctcatctgggacccatcactggagccacagcatttttagaattaaaggctgaactttttagcatgacagtcacgaccatcataactgtcactcatttgtcattcagtcttatctctcacatctatgatttttacattccagatatcttacagtggccccagtatacctaccttcccctttatgctgtggctcacacagntgtctctagctaaaaaaaaacaccttcctcttgttaacatagataactcctatgggtccttttcactctatcaatatcacctcctccagaatgtctgttgaaaccatgagactcagggaaacactttttctgctcccataaagttccatgattactccagatagaaatagtttactattgcattggaatgtctttttcctccaaagtgtatccctgggtcctaacatagtatttggacatgtggtaggaactcaagtagtatttgttcaataaagtttttcagtcaactattgtatcaatgccttaattctaagacatatcattgatctaaacatttcttcaataaaaaatagacttctgttcatgattgaaaaacttcacaactttataaacattaatatataaaagtataatttagaattgagaaatatggcaaccacttttcttaaggagacattctattttttttccaaccatgaaaactgggaaatgtccttaaataccattcttaaaagctgtgtttttgcatttaacagtctccataatttgaagtgaaatgtcattcatttggatgtcaaatggcaaaactatatcttttttaaaatttaagcgtatattatataaaataataacttcgtgaaaggtaattttacagaattaaaaccctgagtactcatcaaaaccatatcagtcattttatggatgagcaagcttgatctggaagggaggtgacattagtttctcaggcccacagagcttgttagtggtagaattagaaccagaacacaagattacctggcttattaccaaggaagcttgaataattaaaaacgtattttttaatactaggtgtttgggtgctgtcttcagcattgagttataatgatgatcaaattgggaaggcacccagccctgtggaagttcgtgcagtggagaagaggagataatggcatagcagtggagacacccaaagtcatccacagtttggctttaaatagcatttctaatatcattttctccctccctccatgatgaggtctaaatttcaaccatttgaactccttgctattcctggttcatttccatgcttattgcctctgagcctttgctcctgcttgccctgctggttcatgtctgctggttcatgtgtccttccctttggaagcacatccaaatcctacctgatgtctaagacctatctgaaaaggcagctcctctacagagactttcctagttctctctgtcagtagtaacttcttcctcccttgagtcccatacaacttttctttcccttgtttgtagcacttctctagttaagctttgtgttacagttattttctatctatccaaatttccttcatgatttttagtaaatcctgctgtgagttatttgctgcataatttaatgaaattactgtagagtcagcaaagaagtagagaagaanaaacaccaagaatgaggagaacctagcaagggcaggcttttggaagcaagaggtagataatttaataaaaggatagttaatagtttcaaatgtgttatgactttttgctctgagtctctactttttgtagtttgtgttattctgatgtattatttaacctttgttccttatcacttttatttaaatataactttcaatttgttttc

SEQ ID NO: 240369 - DNA, 416 bp, Homo sapiens
cacaaataaggcacagatttttaaaaaatcatcaacttcctggctacctatatagacataattacatagaagctcaactaaatttgcaaacattccagagtttgggtttccaataattctttgtgattctttaaaaggtaaagtatttttttcccataaaacatagcaacatttaaaatcacccgtagaatgtcctgccatttttgtttctgtagtttcctcattttctgcaaagcctcgctgaggaaattgactttgaatatccttttacactcttctgttttagaaagcattgtggtaaaacattgaatcatcatggtcataagttctgttcacattctttcttgctttgaatattttttcccagtggccaatatttgattctgttgtatcatggctaaaaggtaggcatggca

SEQ ID NO: 240370 - DNA, 284 bp, Homo sapiens
ttcaattcagatgctaaatgagtccagtaatgccacaacaaaatggacaagtgcttgtggttagatgttggtttgcaaaggaacttaatatgctctgagcggctgcctagaccacaaaaatctgaattattatataattataatatgttttatattttataataaaaattttaaacacatatagaagtagcaagatggctcatgcctgtaatcccagcacttggggatgccgaggtaggaggattgcttgaccagcctgggtaacaaagcaagactgtctctac

SEQ ID NO: 240371 - DNA, 502 bp, Homo sapiens
tatgcagcagttttaaaatttcgaactagttcaagagctgctcggctgctcgtttactttcagttttgggaacagaggcttacacccctttctcctcctgtttctcctccagtccctcttcccctcaatctagtttcccaaagttagcaaacctactttcttgattttgtttcttaacatttaaaacaactggtgtagggctaatgatttcatctccttaccaccacccctaaccttaaaagcaataaataaaataaaagcccagcctgccaaccgcatgcacacacggccagcggtggtgggggtttgtagtttgcatacacgtcgcggggcagaagcctgtttgcaaaggctgaaatgtagctagcaggggaagacgctgaaaaaacagagtgatttgataaaaacgtgctgggccctgttacaggagggctgctgggagtagtcccaggtactcacatcagaaggggtgcaggggaataaaatttaaaaaagcaaaaca

SEQ ID NO: 240372 - DNA, 334 bp, Homo sapiens
aggttagtgaaacccaggtggtctatatgtgtgcctacacataaggaatgaaggctgtgaagcaggagagtaagaggatgtgacatagtcacatttatacagacgataactctagtggccaaggaaagaatgccctagaatacaaaaagatgggtgtcatgcagattacccactatctgcacagcttcatcttccctcatggaatccatcagcaagttctgttgactatctacaaaatatttaacatataccaaatccattcattttctccattttgcccagaagagtctaacagtttcctacatgttctctctgcttctaatattatcccctc

SEQ ID NO: 240373 - DNA, 441 bp, Homo sapiens
ccaaagaaactgcagtttcttttgtttagagaaaaggtcttgctctatcacccttgcattggatgagggtgacctcaatgggttgcatgttctaggctcccctgtcagctgggatggggctttgtatttctctctcccttattcatatttctgataagggtgaactgtggtgttaaaagcttggaattttggcatgtgttgtgttgttctgaattcagatatactataaactggggtggtgaatatgatggccatctgcatttgatgaccttgtttcttccgtccctgactttatcaaagcacacatcactcctaatgaaaagtctgactgttgatttcttcaaattcatgttgggggaaggtatatatattaattatgtatacattaatacataatgtatgtattaaatcacataaattagcattctttagtatcccttt

SEQ ID NO: 240374 - DNA, 135 bp, Homo sapiens
gtcaatgttaattcatttgcatgttaaaaaactataatatctggtataaatgtgaggctactttggatagggggaaagaacttgtaaataactgatagttatataagtagaaagggagctctagaaagacaagtt

SEQ ID NO: 240375 - DNA, 293 bp, Homo sapiens
gtaagtattacatcccagttagaatgctaattaaggcaagagaggagagatttttgcatgagtttgtattgagaattttcttaattatttggttttacccacgtaaacctatcccaggatatgcttataccctcctctctctctcccccaacacccacagtcatggaattatattaatgtaactctgttatcttctactggggacatgttctttgcctgtgagcttggacttctgaagctcaatgcttgctgacagactcaaactctaactcagttaaagaatcaattgagaa

SEQ ID NO: 240376 - DNA, 637 bp, Homo sapiens
atgaacttggactccgtctcacaccagccacacttggattggacctaagtgttaaaggaatatagtaacgctgctagaggaaaatatggaagaatattttcttcatggcttcagggtaaacaaatttttcttaaaccagactcaataagccctacctataaaagaaacagttgagaagttggactttattaaaaataagaacttttgtttatcagaagaccattaagtgagagaaatgtgaaaaacggcatgcaccaagaaaagatgtttgcaatacatatattaaccaaaagatttgtctccagaatgtatgaaaacgactgcaagttaattttttaaaaaaggcaatcaacaggctgggtgcggtggttcatgcctgtaatcccagcactttgggaggcagaggtgggtggatcatgaggtcaagagatcgagaccatcctggccaacatcgtggaaccccatctctactgaaaatacaaaaattagctgggcatggtggcgcacgcctgtagtcccagctgcttgggaggctgaggcaggagaattgcttgaacccgggaggcagaggttgcagtgagccgagattgcgccattgcattccagcctggccacagagcaagactctgtctcaaga

SEQ ID NO: 240377 - DNA, 100 bp, Homo sapiens
aaattgtttacagttgatgttcaaggaaccaagcccctaataatctgcagattaaaactggcagatgtcagtggctccaagacactaacataaatttgaa

SEQ ID NO: 240378 - DNA, 245 bp, Homo sapiens
caagcccagggtaggtgtgtaggagccctgagcggatggatgaaagctgtcctggtctgagtgcagagaatggggtgttcgggttctccatttgagtcttccactgcccaaacctgaggcccctttaaggttgccccttaaagttgccacacccagaaattgggccaaagaagttaagctgttgattatttcaattctgaataaaaatgaaggcatcttctctgccttctaaggcctggtctgat

SEQ ID NO: 240379 - DNA, 691 bp, Homo sapiens
  misc_feature (620)..(621): n is a, c, g, or t
  misc_feature (639)..(639): n is a, c, g, or t
  misc_feature (641)..(641): n is a, c, g, or t
  misc_feature (651)..(651): n is a, c, g, or t
agtagctgggattacagtcgtgcaccaccacacccggctacttgtatttttagtagagacggggtttcatcatggtggccaggctagtctcgaacttctgacctcaggtgatccgcccaccttggcctcccaaagtgctaggattacaggcatgaaccaccgcgcctggctaccaatatactgttaaaatctagatatttatttttttctgcaagtccactggagtaggaccttctaagtttttattcaggtaaaataaagtccctggatggtccctgcccagtactgaaaccctcttctgggataagagggtaaatataattcatcaagttagtttcatgattgtgagctccttgacactaccatttattcatcttgcattccctgcacacctcacagtacctggctcacagtagttcagtagatacttgctaaatagtactgaactgaacagtcatgagacgtagattttcagatttctttcctctccataggaatagtggagatcatcaaaaccttaaattttggagaagtgaagaaatccaaaaaataatgtccttggcctaccctttaaaaaaaattttttttttttgagacagagtcttgctctgttgccactnnacttcagcctggcaacanantgagactccntttccaaaaaaaaaaataataatgcctcttttacaacccc

SEQ ID NO: 240380 - DNA, 412 bp, Homo sapiens
atgcacgtgaaaagaagatcctcattatcagggcgtaatctcaactactcagcaggctgaggggggacgactgcttgagcccaggagtttgaatacagcaagaccccatctctcaaaataaaaataacaagaggtagagagacctgggctagcagttagtatgctcagcccccttgtcatgggacgcctgggaagcttcagagagtccacaccagcaagaaggctctcatcagacacacctcttggaccttgaacttcccaatctccataactgtaagaaataaattccggccaggcacagtgactcacgcctgtaatcccagcactttgggaagctgagatgggggatcccttgagctcaggagtttgagaccaccctgggcaacatgacaaaactccatctctataaaaa

SEQ ID NO: 240381 - DNA, 538 bp, Homo sapiens
atccatgtgctatatcctaacctctctctttgtgtcccatgttttcacattcaaccactgacccaaatgcagtccacatacataagcagagttaagcaaacaaggctctgtggaatgaattctgtaatgagaagactgttgatttatactgtcctctctgctgtaaataacatcttcattttaacatatgtacttttcactatgaatatatgtaaaattgtctctatattttaaagaataaaactgatagaaatttggctgcaatcctagccatttgggtgagatttaattattattgctagtttaatctcatgctacatatttcaaaaagtcactctccaagttcaggatatttattataatacttcattatgctaatttcatgttttataagatgacaagctattgtcatgatttattccttgtctatattcttttgaggaagccaattgaacgttaagttcttatggatgtatttctttaaaaagtggtagtgtcataccatgtactgtcattatttaaaactgtgacattctga

SEQ ID NO: 240382 - DNA, 439 bp, Homo sapiens
gaggcagaggttgagtgagctgatatcgcaacgctacactccagtctgggtgataaagggagactctccccaaaaaaattgagtcggaggtctcactttgttacccaggtggatcttgaacttttgggctcacgcgatcctcccatcttggcctcctaaagtgctgggattacaggtgtgaaccaccaggactagccagttgtttgaatttaaagttgaaaaactacattcaaaaaaaaaaatcacctggacctggtgttatgtacctgtggttctagctattcagggaggttgaggtagaaggattgcttgagccagggaggtcaaggttgcagtgagccatgatggtgccattgcactacagtctgagtgagacctggtctcaaaaaaggtaaagaaaaagaaagaaaaccaactctaaagaatttagttactagac

SEQ ID NO: 240383 - DNA, 272 bp, Homo sapiens
aaaataaaatctagtctcctccaggtaaactcactcaaattcagtgctactgcaatcatttcaggtttaaaaccacctcagtcacactaatgattgccctactcctgcccctccctgggttcttctgtgggcagcctcagtggaggatagcgcatccatccacttctcagtcctgacctgtcctgggttcatctccactgggaggcagatgtcagactccaatgtgcctggacatgtgcaggtgtgcgaggggcatgtcctggggcctgcag

SEQ ID NO: 240384 - DNA, 371 bp, Homo sapiens
tatatttcttgataagtcttgatatactcataaataaataaataaaaattttatgttaaatcatcccgtaggccatccagtggaataagaaaagtctgctccaaaaggtagcccagaaacccagataacctctttgtttcaccgttactttggggcttgccctccatctgcaaggtcacattccagtccatgggaagggggataagcatgtagagggcaagcaattcctagaacttgcatgtatcgctcctgctgacattccataggccagaatttagccttgtggccttacctggttgcaaaggagggcgggaaatgtagtctgtatctgggcagccacatgcccagataaaattttagggggtcctagt

SEQ ID NO: 240385 - DNA, 487 bp, Homo sapiens
taggcctgttggtgagggtggatttgtctctgtgtatgtagtatcaggtgttctcaagagcatctggttagctgagcagtgggggaaatgcgaagtctcagtagagaatggctttgcccttttcctttcttattctggagaacatgattgagctgctggggttacaggagaaatcttgtcctaggaaacaaaaggtttgtagccctcattctggctctgagccctgtagcaagcctcttggctttgagccagtatcgtctgtgaaatgggtaggtatcatgatacctaccctccctgactcagatgtgttccaagcttgtgccagacgatggacacttagatattatctaggagcactgccctgcagaaacaagaagtcgaatatgaggtggaatggccacatttcctagaatcacgacatcttcagcagttgtgatccatttgattgttacttagtactcctttcaatttgataggattttgctta

SEQ ID NO: 240386 - DNA, 435 bp, Homo sapiens
agaatatataatagttaatagaaagatagcctgggagtcagtcaacctgaattatgattctggttttgccattaacttactgtgttaataatattgtgggcttcattttcctcgtgtaatatgtaggggttggtctagtctagggatcagcaaacattttctgtaaagggcaaaataggaaattttgggggatttgtaggccaaacagtctgttgcaactactaaactctgcacttgtagtacacaagcagctataggtgatacataagtgaatggctgtgttccaatacaattttacttacaaaaaaacaggtagtggccaggcatggtggctcacgcctgtaatcccagcactttgggaggctgaggtgggtagatcacaaggtcaagagatggagaccatcctggctaacatggtgaaaccccgtctctact

SEQ ID NO: 240387 - DNA, 978 bp, Homo sapiens
caaggtgctgtacccacagtcatatcatttaaccctctctccagcccagatgtcctgatcctaagggccaggcagttagatgggtatacccctaaagtcctatacaactcagggcccctgaaaatgccccctcatccagcattttccctacatatggaaacaaacaccattgtttgaaaaaagtaaaaaaccttctttacactgagctgaaatttgcctccagtgatttcttcttggactacaccgaataagtttcttgctcttccactccataagcctacaaaatactggagaacagctgtcaggagagataacaaacccgaagcctggaaatcactcatcaaaccagttttcttccttttaagtgacaaatatgtgggttgggtcaaaactggaagagaagatctgctgccaggccacagtgccctttggtttttgctttccagatgctcgggagccattctgcaggcaagcagacctatttgcagggacgggcaattgttgctgtggtgcaatgaagcaagtggggctgggaaagaatccttaagaagatggttcctgccagatttctttctgccagtgccacaaactttaattaaagcgagccctcaggctgcaccagggactacaggtgctgtgatgttggtgtccaatggggtcaacagaaagaactgctaactgtgagtgaggcagcagccaagatgcaagcaccagccaacatgcaaagagaaaagagaaaatgaacctgtgttcccttccgataagacagtatttacaaaccggagatctggagactgacaggcggggtcccaaactcagctctggcacttgaataaaccagatgacttgggacaaactacttaatgctcctacctcccctcttccacaccttttcttcctctatataaggaggatgataatatctactctgtggagttgtttttaatgatttaccaaaatgaacaaatgtcaggtata

SEQ ID NO: 240388 - DNA, 1387 bp, Homo sapiens
tttttttgagaccgagtctcgctgtcacccaggctggagtgcagtagctcgatctcagctcactgcaagctccgcctcccgggttcacgccattctcctgcctcagcctccccagcagctgggactacaggcacatgccgccatgcccagctatatttttgtatttttagtagagacagggtttcaccgtgttagccaggatggtctcgatctcctgaccttgtgatctgcctgcctcggcctcccaaagtgctgggattataggcatgagccaccgtgcccggccacatctgtgagttttaaacaggtcatatctaatttgaatacactataagatagaaattattcatatactatgaggttatctatgacagtatgttttgttttaaattagtttcccatcagatataaagttggtgcttttctttataatgccatgagcctctcaagtctctcagggaagaatttcattcttacatttatttgctgtttcactttgcattccttcctttctattttgctttcttcctttgggagccttcatccttccagtgaaagaagactgaagttgtctcttcatgataaataattcaatggaaaatgtcagaatataataatttccaaagactagtcatgtaatgactgatttttggtaatgctaaaggcaaaataactttagcctataccataaaaaagatctagatattccctttgtatttgtggtaacttgattttaggtataccctttccattacccttcagaaatggaatgtttgatgtactatcgagaaaactgaatcaattctgcatttcgtgaaccctgttacttatctttagtagccatggaaataattccccagtaaatatatagttgcaaaatcactgcctaattacctttctttacatacaaaatgactaatatttgataaaatatgaagtttttaaaaatagttacgatattttgttacagtgaagcaatttatatattttcttaacatctccccaaaactctgaaacacagtgaatgcttctttggaagccaaggagcttgttgctgacatagtaataatttggttgtttgcacattttataaaatactaaaatgttgcaagttaccatattccttaaataacttatggtaagatcttattgctgaagtgttggcttgtgtgtaggagggaaattatgtgttacagtgttatataaaactgactcatatgagtaggtgaaagatcccaagaataccaggacacccacactagaaaaagccaatatgtacactttctctttacactatgttctagcaggctgcttaatggaactctatattcattaaagaaatttctgtaatttctttcattgccttggtggatatctttctggttga

SEQ ID NO: 240389 - DNA, 802 bp, Homo sapiens
ctcctataaatctttaacaaaacatagttagttgtttacatactttttaaatcccagagttggttttaaaacctgcatgattgccatttttgcatattatcttagtgctctaaaattatccttgcctatgtgcacaaatagggaaacgctgcctaaaaaatggagttagttatgttcttttgctacttcactgttacactattatctttacatacttatatgtgagatgaattgagctgctgtccgttcttggaaatctgttccttttaataccttttattacccgtatgtcatgtaagcactagtaaaattatttctaccaagtgggtcttatccctcagtgctgttttaacagccctcgtgctctgcatagcctttaaatactgcctgtctccccactccctggttctgacccactcaggagtacattagagttgcccattttcccagtgattgctgtccttctcaatagataataggcaatagaagcagacagataaaccaattattggagggaccttgagcctggaagaaagacttcaactcctttcgaatgaagataagacagtggatgaatccaatcaggaggaaggattctactccacagctaatttaaagtctgttcatcagtcatcagttgaaaacatgggggcccttggtcctcaggacagatccaagaaggtgtcaggcagtacactagaggaggaagtctttcttacttccctcacagccttgcctgaggttaatcaaatgaagatttgctctctactagaagaggactgtagaaatctcacatagtcat

SEQ ID NO: 240390 - DNA, 993 bp, Homo sapiens
agagagaaaaaatagaagagacatgccaagttggaatgaagcctcctgtccctggtggttatactttacaaggaaaatggataacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttaagaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttt

SEQ ID NO: 240391 - DNA, 406 bp, Homo sapiens
cttcaaagcaggaggaagactagacgactgcatgctttaaccatgatgtgccagattaccttaaaaatgtactttaaattacctacacacaaattttccttaaagaatgagatagtttgagtttgcggacttaaaatcaactcagtagttttgaaaagtgcccctccccccccccacagtctttccattttaaactgtgaacctaatataacttctaggcctttatacaattaattctgaacaatcaagggactaaacacttttacaatgtaattacagtagtacaaattgtttgcccaaacctcattctggataaggattttacaattagcaaacagttattacagttggggcttgctgagagaaattgcacagaggatgtctagagttgcaatatagtagccat

SEQ ID NO: 240392 - DNA, 111 bp, Homo sapiens
cctatcaccacctataggggccagaaaatgttgtcatggagacaacagctgttgggttatgagtgacaagtctcaagagagaagtgtcttggaaagggaacacctcaagta

SEQ ID NO: 240393 - DNA, 445 bp, Homo sapiens
tcagcgaggtgtggtggctcacacctatagtcccagctactcaggaggctgaggtaggaggattgcttgagcccaggagtttgaagctgcagtgagccaagaccgcacgactgcactccaacctgggtgtcacagtgagactctatctcaaaaaaaacacagcagtaaaaacagtaaaaacaattggttgcgatggctcacacctgtaatctgagcagtgtggaggatcacttgaggtgcggagtggatgaccagcctgggcaacagagtgagaccctgattcaaaataaataaatcaacaaacaaacaaacaactgagccaggtgtggtggcacctgtagttcccagctacagctagatcctgtctctattttattaaaataaaaaagaaattacttccagcctgggtctcaaagagagacactgtctcaaacaacaacaacaa

SEQ ID NO: 240394 - DNA, 496 bp, Homo sapiens
ataatttcagaagacatgttaagtgacttttaaggaatggagtaatcaaattttcttacaatatcagggatgtaaaaatattcatcattagatattttatatccaaaagtgtaacttccgggtaacaagattctacctttgtggatcaaaattagtcaccactttccaaagttaacatgtgctggggatctggtgttcctggaggtagcacctgatttagtctctgtgctctgtcacagttagtgttccattttaatgtttaattttaggtggaaagtttttaaaaaaacatttttttttggtggaaaatgcataagctactgttctaaatttatgtaaaaattcactgcactgtttctgtaaacctgccatacattctttattttaaatagacagcttttctaaatcattgtgctccgcttagacaagttctgtctccatggttgaatttatgagtggatttgaataataaattcacatttcagtgaacatattt

SEQ ID NO: 240395 - DNA, 485 bp, Homo sapiens
gcttcctccctaccatgcctacaccaagggaatgcctccctggggaagaaggtgctgatgataccacaatgttcaatgactaaggaaacgaatctcatggaatggtcaagaaaggcacaatactggatgcgctccttgctcaggacacacaggccagcagatgatcccttgttgtccctggaaagcaccccaatggactgggcttcatctgcaaattctcagagaaggaaggcaggtttggttttcaccttcccattcatcttctaaatcctgaattaagcttaccaaagtgtggtagggaaagttctgttctctatccagaggctacgtacgagtaggaagaatcaaagcatttgccaaggaggtagcatggcatggttggagaaacacgggctttggtgggaaacaaacttcaattgaatcatggctcagttacatcccagctgtgtacttttaaacaaaccactttcacctctcagagcctg

SEQ ID NO: 240396 - DNA, 474 bp, Homo sapiens
ctctgttcatatcttgaaggcagagtgctggctcatagtagacatttgatgaatttctgttaaatgattgagtgaatcaagagtatctgcagagtatagcatttatgatgagacaaagctaattgggaaacagaacaagattggtgtcctggggtaactgggtaggtcttaagatgaagattttggggtgtgctgggtgcagtggctcacacctgtaatcccaatactttgggaggctgaggcagggggattgcttgatcccaggagttcaagaccagcttgggcaacatggtgaaatcccgtctctacagaaaacacaaaaattagctgggtgtggtggtgcacatctgaagtcccagctacttgggaggctgagtttgggaggattacttgagcccaggaggcagaggttgcaacaaggtagatcatgccactgtactccagcctgggtgacagagcaagacccagtctgaa

SEQ ID NO: 240397 - DNA, 594 bp, Homo sapiens
ttaaaaaggaaagttcattcctcttgcccttgtgctttctgtcatgggagcacacagcatttctcttctccagagtatgcagtgtcaccatatggaatgcagccctcgccagaaaactgaatctgtccgctccttgatctcaggcttcacagcccccaggtgaaaccagcacaaaatggactaaggcatctagtatgcaggaacaaaggatatgtaacataacccatatttgaaataaccaaaaataaaattcttggcaattaaatctagccaaataagcaccaaatcaaaaagctatcaaaactattttgaaaattacagtttaaaatacagttatatatgtataaaacatacatagaatgtagatacatatgcacgtatatatgtgtatatacatataaaacttctcaatattgtcaataattgttatttttactttacagtaatattttaggaagtaatagcttaatattcttggactcacatagtaaaagttcagaaattacttcacctgattttcctttcatagattcaaattcacatttaaaaatattatgcttcctcatgtgtcaatatagttacctgcttcttgac

SEQ ID NO: 240398 - DNA, 648 bp, Homo sapiens
ttaaaaaggaaagttcattcctcttgcccttgtgctttctgtcatgggagcacacagcatttctcttctccagagtatgcagtgtcaccatatggaatgcagccctcgccagaaaactgaatctgtccgctccttgatctcaggcttcacagcccccagaatggtaagaaataaagttctattatttataaattacccagtctcaagtattttgtgaaaccagcacaaaatggactaaggcatctagtatgcaggaacaaaggatatgtaacataacccatatttgaaataaccaaaaataaaattcttggcaattaaatctagccaaataagcaccaaatcaaaaagctatcaaaactattttgaaaattacagtttaaaatacagttatatatgtataaaacatacatagaatgtagatacatatgcacgtatatatgtgtatatacatataaaacttctcaatattgtcaataattgttatttttactttacagtaatattttaggaagtaatagcttaatattcttggactcacatagtaaaagttcagaaattacttcacctgattttcctttcatagattcaaattcacatttaaaaatattatgcttcctcatgtgtcaatatagttacctgcttcttgac

SEQ ID NO: 240399 - DNA, 445 bp, Homo sapiens
gggacaggggaaggggggggtgttggactggaggggaggtggggagagatgggggaaatagcgggaggtagggaggaggtgggaggaggtgagggggaagtgggggcgggggggtagggccagggctccttccagaaggcaggcagggtgcacttagcccggggcagggacccccatgggccggcgggtcctcctagacccgcctcagtcctggaaaccccgaggggacgacagcggaagccgcctgggccctgcgctctgggccctggggtgcaacccctgaaactcgacagttagcgccactccccgcctccggggtcccctcatctggtggcggcggctggagaagggcgcaccccgcccgcggagacccacgcgctcaccttccgggggccgaggtccggctcgtcgtccggctcaaggctccgggccgtggtcccgccgg

SEQ ID NO: 240400 - DNA, 260 bp, Homo sapiens
ctaaagatttttctattaccatatcttgattttttaactgagtttttgcctacaggatatagatagactgataatatagatatggagataagtgtggatacaggcatagatatagagatagatagttgatgtaagagattgtcttacaagtatgtagccagaatcaagaatataaaagaaattatagaagagactccaaactgaaactcaggcattgagacagaaatcagaaagatccaaaagaagagtaaccagtgaaa

SEQ ID NO: 240401 - DNA, 510 bp, Homo sapiens
agcaccagttttccacagccctgtacacgttttaaataaatgaccagaaaagagatggcacctgagaattcccagggagccaggatgagggactggcagtgggggattctggaggaagggtccaggatggagggactgcagcaagaacatttcctaaggcatgcaaagcttgactgtgtgatctgctgtctaccgtcaatagtttactcttctaagcaggggtttgtgttgctttcaggaagatggcctgatagagtgctgctgttgggatgaaattacagaagcaagaacaatagcagaaatagggggaggcaggctgtgtgccctgggctgtaggcagtaggtcagactctcaggctctgctggtaggcaccattggttaggaactgcatggggtttccagatgcagaagagaagttctagaaggatctggagctaccctctccgtgtagctcaggcttcttcaagatgatcagactacatcaggcaatgtttgctgttaaaaaaaaa

SEQ ID NO: 240402 - DNA, 637 bp, Homo sapiens
aatatcaagcgcttagattaagcactctcttgagtctcatccaatcctgaatttgtgtttataaaaccgatccagagagtgtgagtaaatctgtgaacagctacttcagccccgaacccagtggtgttgagtggactggtcctgcacagagggacaatgcacctgcatgggcaaaaactggggctgggccagagtcatgggcttcaatccctgcttttcagccactagcaagttgttcatcttctctgaacttcaatatcttcattcgtaaaatgtggacagtaatagctcctttggccgtttcgagtttaaattagataatgcaagtagaagacatagtacaataatatctaataactaccatgttcaggaatataagtaccaataaaatggtacctattgtattaatagcatttgagtgagaatttttaagtctttttatttctcatcttttcatttctacctttattggatttgtagaatctattacagtcaaatcatatagtttggtgttgtggtggtgatgttttttgtttgctttttaacacacttgcctttacttgttttggcagaagggatcctaattcattcagctttctcgaatgtcatataaaaacacataacacatgttcacgtt

SEQ ID NO: 240403 - DNA, 1090 bp, Homo sapiens
tggaggtggaggttacagtgagctgagattgcaccagtgcactccatactccagcctgggcaatagagagagaccccttctccaaacaaaacaaaacaaaaccaaaaaatcattttggaagttttcagactggtcctttttttagtataaaagggaggagctttggctttatcaaaaacctgatctgggaggattccctcagtatgtctgtaacatctccttttggcctgtgctgtttatctttaaaaattctgatcactcaagaatattgctgtgtcattagaagttaaccaaagcttatatttaaagttttattttaaatattttttataaataaatttgaaaaccttaggaagataaagttttgaaaggagtttttattttaagggactataaaagtcactatttgtcgtattattttagaacatgcttttcttaatatggaatttgctgctgttatttctaaagtttctgttctttggtcccattttatcagcaaaatcagtttattaatgaaacaaatctgttatttaccttttactcctgtatgcaaaatactgaatttttattttcacttgtaaacttaggaaaaagcagatattgtttttaaatttaatttctactttgagttattaataaaaagtttcacaaaaatatgaaaactttcaagtttatacacatactagaaaataaaagcattcacttatttcttctactgtattagttttctattgctgtgtaacaaattgtcacaaacttagcttgtggctaaaaacagcatgtacttgtttcacagtttccataggtcaggatctaggcgttggttagctgggtcttttgctaatggtttcacttgggtgatggaggtgttttccagggctgggctcccatttgaaacttcgggccctcttccaaattcattcaggctgttggctgaattcaggtccttatggttgtaggactgaggtctctttttttgtttactggctgtgggctgggggttactctcagtttctagtggctaccctcatgtcctagtagccattggtcccatttctggtctactacaatagttatcatcggagtgact

SEQ ID NO: 240404 - DNA, 413 bp, Homo sapiens
gggtgtggtgtgcatgcctgtagtcccaagtcccagctactctacttgggaggctgaggcagaaggatcacctgagcccaggaaggccaaggctgcagtgagccctgatggtgccactgcacttgaccttgggcaacagaatgagaatgagaccctgtcaaaaaaaaaaaaaaaagaaaaaaaaaaagaaagaaaaagagagaaagagagagaaagaaagaaagaaaagaatgcatagtgagattttacagtaaaactctttcttagaggctaaaaactctggggatctcacgatgtgggtacatttctagagataatattttagatctctatagatattattttaatacatctttttctttttggtttgactgtgtatcatatggcttttcttcttggaagttatcaaactt

SEQ ID NO: 240405 - DNA, 1251 bp, Homo sapiens
  misc_feature (237)..(237): n is a, c, g, or t
  misc_feature (487)..(487): n is a, c, g, or t
  misc_feature (538)..(538): n is a, c, g, or t
  misc_feature (1127)..(1127): n is a, c, g, or t
gtgctgttaggttactttgaaaaaaaaatgatgttgtatgcttgtccaactgagtaataagcaacttgtctttggcttaaccttttgccagacgtggggtgttcagataagtaatcagatatgtagggataaacaatatgggaaataagaggaaactacagcaaataacctttttaaatttgagctgaagtcattgtgaaggaatgtgctttgtctgtagtgttgctccttgttcanattgaagcttatgtacagcacttagctgtctgacctttcacggcagctttgaatcatacattttcttttgaggaatttgttaggcttcttattgaaataaagtctcagtcttagacatcatcaggaagaataatatctcccaaataaatgtttacatgagcttgagaaaagaacagtggcttgattgagagaatgcttctttacaggtaagtatcttttggtgatcttggacaagtcgcatacatttaantgttatggggtaattctcagtgaaaggcctaaaaacacagatctcaccacnaaaaaaggcagcctgcttggattgcatcagactctgggcttattttcctttctctagtggttcctgctcatgtcctgaatttctcatacaagttatagatgtggtagaagtaggtgtttaaagaagggtggtgagagacgatgagtgatgtttctttgccttctttttgtagatctgctgcctcaggcactagtatagtggttctcaactctcactgcacattagaatcagtcagggtcaagaagctccattaaaaaaatatataacagctgggtgtggcagctcatgcctgtaatcccagcattttgggaggccaaggcgggcagatcacctgaggtcaggagttcaagaccagcctggccaacatggtgaaaccccatctctacaaaaatacagaaattagctgagcatgatggcgggtgcctgtaatcccagctacttgggaggctgaggtgggagaattgcttgaacctgggaggcggaggttgcagtgagccgagattggtccattgcactccagcctgtctcaaaaacaacaacagcaaaaccaaaaaaaaaaaaaagccctaaagattagctgggtacagtngcaggtgcctgtagtcccagctactcaggaggctgaggcaggagaatcgcttgaatccgggttgcagtgagctgagattgtgccactgcactccagcctgggcaacagagtgagactctgtctc

SEQ ID NO: 240406 - DNA, 397 bp, Homo sapiens
gtacgcacagtgtctgcacccatcacctgcctccctctgtgtttcttctccctgcctccagcacgttatttttaagcgtgtctcttacacatctgtagcctgtgcatcttaggacgcactgactcacagcagtgttataaatggcttttggaatccaccctgcctacagtatcccatattttcatcaggtttcagaaattactccactacttgaatcttctagattctatgctttttcgaaactgttatattgtgactgtgctgtttttactggaactatagttacttgatactgtcactgacataggaatcatcaggagagattatatttttttctggctaaccagaaaagtttgtttttcctgtgaaattttttttttttgaaggcaataggtgt

SEQ ID NO: 240407 - DNA, 368 bp, Homo sapiens
caggcattgccctgggttttgtgaatataaaaaacagtccttgacttccagcagcctgtgcacaccactgcctcctccttgaagttcagatgcatcatttaaggtatttgccttaactcaaattatattttcttaagaagcttctggaagcttttcattttatcagcctcagaggacaatctcaccagactgaaaactaaatgcctgtttactaagccaagtggttgagaccttgaggaagagcaaaaggacaacccccctgaatgtgcacattgaccttgtcctcccagcagccctgcagtcaatggctatgatttagtctggagcatctgccagatccagattagggagaccctccttttcacttc

SEQ ID NO: 240408 - DNA, 1222 bp, Homo sapiens
  misc_feature (2)..(2): n is a, c, g, or t
  misc_feature (4)..(5): n is a, c, g, or t
  misc_feature (9)..(10): n is a, c, g, or t
  misc_feature (237)..(237): n is a, c, g, or t
  misc_feature (715)..(715): n is a, c, g, or t
tngnntatnnagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatttttttttttttttttttgngacagagtgagactccatctcctaacagtaaaaaaaaaggaaagataccacatttttaaccaaaatgtactttatacatattactgatgccttatacaacgtatgggaccaatgggaactcctggaagttatccaagttcatttcaaggcactatggccactgagttttcaaggccagcataacatatctctgtcagagggcattaataagctgtaagtgcaccgtgtaattaggctaattaaatgtactacaagcatttttcaaatattagcaatagaccactcctcagctcttaataagtcttctctggagtcttccttttcctgatggcattacttttactgagtgttcagtttctcagaagccttcagaagctagtttgatttttaaatcctgttgtttttactagtgaaaatgttctgaattaaaacattgtgaaatgctgttaggtatactggcatttaacattatggatcncaatgaaataagaaacaacaaaaacaggtaacaatacagttgagctcaccaaaaccttacctgctgtggggaaagaatactgccccatgaatctttcacacgtttctctattatacacttatcaaagctgtaagaccaaaatctcttagaaatctttaaaaggcacagttaagcaagccaatgttgtgtgggcataagagactagtgatgaatgatcaattgatgaatagttttctaaatgtgtttttcgcaagcatttttaaatcacatgttagacgtaagcttttttaaaagcattgtggaaatcacagcaacatggctttcttgtttgattttattaggcaaaaacgatggatggtttgatattctcttagaaaggctgacagctactatatagaaccactcaggaacaataatgataggtatcaacgatactgattagatgaaaaattcatttatgtttttctgctgaaatatcaatcttaataaatagatggcttttaaacc

SEQ ID NO: 240409 - DNA, 1907 bp, Homo sapiens
  misc_feature (1047)..(1047): n is a, c, g, or t
  misc_feature (1052)..(1057): n is a, c, g, or t
  misc_feature (1062)..(1063): n is a, c, g, or t
  misc_feature (1253)..(1253): n is a, c, g, or t
  misc_feature (1346)..(1346): n is a, c, g, or t
  misc_feature (1485)..(1485): n is a, c, g, or t
attttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgtttttatttatttattttttgagacagtctcactgtgttgcccaggctggagtncagtnnnnnnatctnngctcactgcaacctccgcttcccggggttcaaacagttctctctgcctcagcttcccgagtagccgggattacaggcacctgccgccacacccggctaatatattttttttgtatttttagtagagacggggtttcaccaagttggccaggctggtcttgaactcctgaccttgtgatccacctgcctcngcctcccaaggtgctgggattacaggcatgaggcaccgcgctgggcctttaatgggttctttagagaacattgtaaccgaaacctctgggagnatgaggctgtaacagtgtcaacgtgacatttgtctatcttagacatagaatgacttcaggtatcttttgaattatagttttctaatgtatgtatatatctccatcatgcagggtagttcaaagggttggagataatgtntgaagtccctggcatgtaataaggcaacttaattgtcatcagtgcctctatcatcactaccatccccaccacaccatcatcattatcatcatcaggattagaggcagaagctcatttatatttcagtttctgcctcattgggaaatggagaatcttcaccaatgccatgcttttctgtggttctgcagagggcccatccagagcccacattctttgaggtttaagacatttcactgcaagaaaactggaaagctgttagccatcctgttttgtgtttaaaagaacttcttaacaagaagtaatcccagtgggtaattcccactaaacaagacagaggtggtgcctgtcatcaggaacttacattctggaacaaaatattatcagatagtgtaactgtcctgaaggaaacaagtaagagcttc

SEQ ID NO: 240410 - DNA, 375 bp, Homo sapiens
agaccgattccagcccttcccagggtgcacgcatcaggcatcctcttcttcaccagggctggggattctgttcctctacgggacagtcagaaatcagtattttcagagcagaactcctttctattctgaaaatccttcagaggaactccttcatttgcccccaacccctacacacacacacacacacacacgcacatgcatacacacacaggctctttaaaggctgaaaagggagccgagtgtggaattcagggaagtgatgacacacacaacaatgctgttacacctggctgctgcagggctgagcagcggaaatgcctgtgagaagaagaaagaaagacagagagacgcagagagccagcctgggtggtcaaa

SEQ ID NO: 240411 - DNA, 391 bp, Homo sapiens
gatgaagcaggtccagtggaatctcattcaaatgctaaggtgagtggagataactcacagaggaatcaaaagacaggctatccagttacataaagttacaaaggggtcatagttcaacctgatgggcatccaaatttatgtaatatcaaccacactctaaagatattctacttttgtggagttaaatcctgtatcacttgcaaaagtatcccaaattcatgtgacttaataacataagcaagtaatgggcataacttaaggcgtaagatctatttgagcaagaactgaagggttcagcaagccatacatacaacaccaccctctagtttttctttctgagttagccttcactcagccaaatgattcaaaacattgtgtcaagtaggaagcc

SEQ ID NO: 240412 - DNA, 528 bp, Homo sapiens
tttgtgcgtggagtgtgtagtgagtacactttttgaaaatcctgggtcctctccaggaagaattcaaatgtgttgaactttcagtccctggcattgggatggatggggtgttgtcactaattagccaatcagctcagcacatttcaggaatacttccagacagaaccttgaaagatttcaacattgcattgctttgcattgcgcattttgcacaccgtcctcataattataaatttttgaagcagtagcccgtgtggtatagactatgatgtgagaattattagaatgcttttgaaagtgtgattaccctttaacctggtagtagaacagtgcacttttaaattttctgaagtccaaccacttgtctttggatagtaggattcttatgctcagaaagtgtcaactagccaattattcttatgaacaaacctctttagatctgtaagagataactcacatagctcagatggtctcagctccagtgcttgctttttatattttgaaaataaaagagtttctttttactat

SEQ ID NO: 240413 - DNA, 429 bp, Homo sapiens
ttaatttgtttaatgaatagttatcagacacctgccatgtgccaggcactgtgctgggtcctgggaatagagctgtgactaagtcacgtggaatttctgtgtttatggcatttacagtctagtgaaggaaccaagtgataaaggagaaacaaaaaagtatgacaagtgccatggggacctgaatggtgtgcatgctgggagggggtgggcttgatggcattctggggttcttcaggaagaaacatttaaactaagatctaaaggatccaaaggaagcattaactagatacaaaatatagctgtgtggcctagcgcggtggctcacgcttataatcccagcactttgggaggctgatgtgggaaaatagcttgagcccaggagttcaatatcagctaggacaacatagcaagatcccatctcaacaaaag

SEQ ID NO: 240414 - DNA, 440 bp, Homo sapiens
ccgagcagggtcattagggccctatgagatttccttccgactccgctctgaactcactctcgtaggcccaagctgggcgcctcccccagggaacaccgtagtggcccggaaaacagagagcacaggttacatttggctcacattcttggtgtgtccactgtaggttgctgtgaagtaaattttaaatttttatataaaaacaaacagataatttcttgagtgggacataaaagcatgaatttgaaagttaaaatgtaagatattgaccttttacttaataataatgtaacaatattgctttattaactgtgacaaatgtaccattgtaaaataagataatcataatgaaaactgggtgtggagtgtgcaggaactctgtattatctttgtaataatatggtaaatctaaaattgttctaaaataaaaatttttctcttta

SEQ ID NO: 240415 - DNA, 358 bp, Homo sapiens
ccacacaagaaagaggattatcggggaacctgatgcaagcccaaaattttgtcagtctcaggtgggatctttaaatccgttaagttgcaatgtgtatagagcaatctgtttaacaggaaaataatatggaaaaggtgggtatttcacagaacagcagcacttcacagaagtacactaaggccggccgggtgtggcagctcatgcctgtaatcccagcactttgggaggccaaggcaggtggatcacctgaggtcaggggttcaagaccagcctgaccaacatggtgaaaccctgtctctactaaaaatacaaaaattagccaagtgtggtggtgcagacctgtaatcccaactcctca

SEQ ID NO: 240416 - DNA, 501 bp, Homo sapiens
atgttgaaatgttctgactcttctctaatacaacaatagtaaagtgaattcaacagcctactgctcactttaaaacaccggggtacctctgtgcttcccagatattatcgtttcccatggcaggttctaaactggtagtctgaagcctagctctggtctgcagacatgttttatttggactccacagtatttttacaaactttgagccaaaatgtaaaaatagggagatttcacaccaaaaaaatcagagtcacttcactttaatgagaatatgtgacaagactagactctcgtgtggcatggatccttcttcgtatgacagtgagcagctggaactggctagtgactaccctaagatgccacagtttccaccgttccctaccattgacctgactttggggctgagttttcatttactgatcttggggccagttttcatttactgatctttgtacttgctatgttatttatctcaaagtaaagaaatatttatctggccca

SEQ ID NO: 240417 - DNA, 579 bp, Homo sapiens
gcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtttcaagaccagcctggccaacatggtgaaaccccgtctctactaaaaatacaaaaattagctgggcatggtggcgggcgcctgtaatcccagctactcaggagaatcgcttgaacctggggggtggaggttgcagtgagccgaggtcacgtcactgcactccagcctgggtgacagagcgagactccatccc

SEQ ID NO: 240418 - DNA, 711 bp, Homo sapiens
gcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactag

SEQ ID NO: 240419 - DNA, 475 bp, Homo sapiens
attgttgaccaaaatgagatatttcttcatagatctttcatgcttctgcatatcttactgtatgtgcctggaatgcaagtcccagacaactctttacctggttcatttctcaggtctgaattcccagtgagcaaccttgaggaataaggtaacatctccctctgggacaaagagcaagcttgcttcctcctaactataaaagtgatgaattcccaaagctcagtactcttcagctgtaatacaaactcagtgcagatgcagtgtttatttgaatccatattgctttctccctttgggactttcagggaaccaaactgatacaaacatgctcatttacctggtactgcctatgctgtgaatatttataatcatttgtctctgaacttggagccttttgtcttcttccagcatctatgatactaacagcataacttattaacttgtaaagaggctaaaatataatatcagacctgga

SEQ ID NO: 240420 - DNA, 412 bp, Homo sapiens
ttttcttctaattctagttgaatattttcattaagaaaggatgttgtattttgtcagtgcttttcctgcaccaattgagatgatcatgtggtttctgtcctttattaatatggtgtgttgggccgggcgcggtggctcacacctgtaatcccagcactttgggaggccgaggtgggcggatcacaaggtcaggagtttgagaccggcctgaccaacatagtgaaaccccgtctctactaaaaaaaaaataccaaaaaattagccagacgtggtggtgcgtgcctgtagtcccagctactcaggaggctgaggcagtagaattgtttgaacccgggaggtggatgttgcagtgagccgagatcgtaccactgcactccagcttgggcaaaagagtgagactttgtctcagaaa

SEQ ID NO: 240421 - DNA, 663 bp, Homo sapiens
catacatattaattacatacttcatgagcaacaggtctttgagtataggataactgattatgtttttacagcaaaaacctttaaattttttcttcttctgtacttatatttactccttgttatgcctagtacagtgtggaccacaggtaagcactcaataaaatgtctgagtaaatgaatagtactaatataagaatatactgagaaaagagataaaagactatcaaacaatgatagaaaagattgttaggaggaagatagcaattgattagtagttgccaaaagtcgttcaatagtgttcccacatcaacaaaagaggacaaacacagacaaagatcaatttttcttttgccgtgcatttctaaagcaaactcccacatcactttctccctctaacttagtaaaagcagaagggcatttttgccccactcctggacaaggtaaattagcatcattacctattcacttcccctctctgcctccactgcccaacagtgacattatcatacacaaaaggaatgtgtggaaagacacatcaagaaatacaattgacttcaatctacattaaaacacattttaccccttgggtctcatatagcaatatattgaacttcctttgccaatttcctcttatttgcaaagcactatctctacaactacatt

SEQ ID NO: 240422 - DNA, 465 bp, Homo sapiens
tcttatattttcaaggcttgaggcataatctttcagtatagtccataagcactgtttataatctgacagtgttaatactgttttgagtataaatattttgctgaaatgacttgacaaaataaaaacgtattaactttcttttaaatctgccaaattacatattcatatagccaagtgggggaggggactctaacaggccttaattcctgaaaggaagacattaaatatacttaagttttcctggttgtgaagcccctatcatttacactcaaatgataataagaaatgtagtttgggccgggcatggtaactcacacctgtaatcccagcactttaggactctgaggcgggtggaccacttaaggtcaggggttcaagatcagcctggccaaaatggtagaggttttaccatttctactaaaaatatactccagcctgggtgacagaaggagactctgtattaaa

SEQ ID NO: 240423 - DNA, 202 bp, Homo sapiens
atgtggaaaaagacacacggaaacaaattggggagacaggaacacttttgtaatcagaatcatctgtcaaaggaaccctgctgcgtggtggctcacgcctgtaatcccagcactttgggaggttgagtgagtggatcacctgaggtcaggagttcaagatcagcctggccaacatggcgaaaccccatctctactaaaaata

SEQ ID NO: 240424 - DNA, 457 bp, Homo sapiens
tcattttagaatagctttctaaagtccatggagctccctaatgccccacatggcttcccccattgccaacatggttcattaggatggcacctttgaactgactggagcgatgaactgactggatatattgccgtgatctaaggcccataccttattgaggcctccttagtgtttacacaatgccctcctcttccttcctccccatccaagacaccacattgccttgagttgtcacgtctccctaggatcctcttggtgacaatttctcagattttacttgtttgggattacctgagaatgtacattttaggtggtgctcatgctgctggtcttgggaggacattttatggatggctgattgagctgacgggcagagtcctgcaatctgcagaggtctggaaaggtcccttcccaaataggctggattcatttattaaagactacttttgtaagaaaa

SEQ ID NO: 240425 - DNA, 335 bp, Homo sapiens
ggacatactggggttattcagttatttaaaaaattatttgaccaggcgcgggtggctcacacctgtaatctcaacacattgggaggctgaggtgggcagatcacctgaagttaggagttcgagaccagcctcgctaacatggcaaaaccccatctctactgaaaatataaagattagccgagcgtggtggtgcactcctgtaatcccagctacttgggaggctgaggcaggagaattgcttgaacccaggaggcagaggttgcagtgagctgagatcacaccactgtgctctagcctaggtgacagagtgagactccttttcaaaaaaataaaat

SEQ ID NO: 240426 - DNA, 555 bp, Homo sapiens
ttacaggggtatctgggagacacagctgtgcccaccacagatgccctcggtttactgaggatttttaaatgattttttaatgaggactttgtgtctttgtatgtatgacaatcttcaaaaagtaacatgaaaatctggggccatctggatggcttccttatatcaagtatcacctaagattttcatttcatttgtattccaatcaggttgtccatctgtggcactatattaattgttgccaaataacgagaaactatcacaagcagagttaatacatatatgatgagtttgtacaaatcaaatgcaaaaagaaatcctacaggaagtgtataaagggtaggttcacagtagtttgaataaagtggcaagagctgagtcactgtgtgactcatagtgagaaaggcctattgaacataaaggaagatgcattttagcaggtagaaccatgctcagggttttagtggtgatttattttttcaataaaatattatccttaccattaaattaatttaaattctgttgggtaacttttctgtatttaacttataaatttgt

SEQ ID NO: 240427 - DNA, 406 bp, Homo sapiens
gcagttttgtgtcaccctaatcttacaaaaccaaggagatttagatctctaatacagaggtttgagatttagctctttaacttcctaccccatactgcttgaaaatctggcagtgtcttggcctggcgcagtggctcacacctgtaatcccagcactttgggaggccaaggcaggcggatcacctgaggtgaggagttcagtattagcctgaccaacatggtgaaaccccatctctacttaaatacaaaaaattagctgggcatggtggtatgcactactaatcccagttactcgagaggctgaggcaggagaatcgcttgaacccaggaggtggaggttgcagtgagccgagatcgcaccattgcactccagactggggaataagagcgagacttcgtttcaaaa

SEQ ID NO: 240428 - DNA, 287 bp, Homo sapiens
caagagaaataatagtttaatgcagtattataaaaaatcaaaatcaatgcaaaagtccataatgaacacactatcagaaatttaaacaaagacatgatgagtatggaaccatgtaagatggatttgggctaaatatatctaagttaaatttctttactttgacagttgttacttgtgaggcctcagaaaatttatattctccaaatctctgttttgtcatttgcataatggaactattattttctgtgggttatttaaaagagtaaataaaataaggcataaactac

SEQ ID NO: 240429 - DNA, 314 bp, Homo sapiens
ttgtttctttccattgggttggtatagaaaatatgctcagataatataatttcattgatgtgatttattgcagtattgatggttttattacagtatttatggacttgataaaaaagtatataatgtaatttttgtcaaaatcttagaaagttttaaagtcaattatattaatacatttaaggccattaattatacttaaaaggattgagcatgctaaattaaattttaaagaactataatacatttgtataatcttaaagtaataattacattcaatttcaatccagcaataaaatattgagtgcctatcatca

SEQ ID NO: 240430 - DNA, 326 bp, Homo sapiens
aatttacagatgtcaaataataggctaatttgtcataatgttctagtttaagataattcctaggctggtctcaaaactcctgacttcaagtgatctgcccacctcagcctcccaaagtgctgggagtacagggatgagccactgagccgagccaattttgcttgttttaaagggttgtttttttttttttttttttgatagtcagtaattgttcaaactaggaattgtatccccatctttcttttttcataattactcaggtaattgatgagtgtaacagaagctcctcaaaacagttttattaaattgcctttcattttttgtgg

SEQ ID NO: 240431 - DNA, 386 bp, Homo sapiens
attttccctgctggggcttaaaatcaatcagttctccaaggaatcttgacttctttaattggagaattgtatttaggaactatgttcttggtgccaggtgtgctcaatgctattgtggtgtcactgcttctactcacagaagagacacatgtataatcacacatgcttatacacagacatgtacttattccaccttttctgtatttttatacataaaatgagtacatattgataccactgactccaatctagcaccacaccatttattctagcctgtccactttttatttataatgtctctctctaacaactgtttttgaatgtttaactcatacctttatgagaaatttatcaacatacaacatatgtatggcatcctttttgtc

SEQ ID NO: 240432 - DNA, 435 bp, Homo sapiens
gatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctgggattgcacccctgcattccagcctggcgacagagtgagactctatctcaaaaaaaaaccaaaaaa

SEQ ID NO: 240433 - DNA, 493 bp, Homo sapiens
gctcatttcagttcaagaactatcaccctttataaacaggaaattatttatggattgtagaaaaaccctgccagatcttacacataaaatcattttatttcaggagataaacctaattttcctctttccttcaaaagtaagaaaatagaatgtcctcaatgatggtcttctgggaaagtttataactgcaagtcacagcaggccaaatgaggatgattctctctccagtttagtcagaggtcagatggatgggatgacttttgtatggtactctcattctgccctgttggctggagtgaaagaattctttaagggacagaggattctatagtgttgattttcttcatttccttccttccttcttttcttccttccttccttctttccttccttccttcggcagagcgtccctctgtcactcaggctgggattgcacccctgcattccagcctggcgacagagtgagactctatctcaaaaaaaaaccaaaaaa

SEQ ID NO: 240434 - DNA, 735 bp, Homo sapiens
actggcagagaccataagtcctggattgcttgggacacttccactttattctgtggttatatgtaattattaacagcatccccttttactctcaaaatgatccagtatggatgataaatatgatcaccctatgagttggccaaagagcagcttatcataattttgatgagaagtttttaagcagcagccataagttggaatttaagtgttaagtttaaactttaggaaaaactgaaatctaaacatgtgttttgacataatgcagaatataatatggatttttgtgtatcagtgttttattaaccccgatttaattgttcttgcattagagcaagatacatttttctaattggagttttaagcttggacttactaattcataagccataaacatgaatattattattttttaatttaaaaagtatttatttttcagttttattgtggcataactggcaaataaaaatgacatatattcaaggtgaaataatcctttccaacagttttgcaacctggatggggaagggaaattgtaagggttgttatttctgcaaaatcccgcgtacattatggcaaaatcagtgtattttttaaccatttgggcaattatctgcataatccttattaatcacaagaaaagaccccgaattggtcaagtttttttccagttcctaacaaaagcaatttttaaaaaatcgtgaattcaacggagaaggttgatacccctcttaaggc

SEQ ID NO: 240435 - DNA, 424 bp, Homo sapiens
atgagatcatgtaggcagctgctggaaatagagcttgctctgttaaataatgtagcagacagtacaggctagcaccaggcacagcaaatacagcaatgcagcaatgcagaaggcagaccttgtctaaactcctagtattgatggattctgcagacagactgcagaagggtgtggcttcttgcctcagctgcagtacagatgtccggattataatatcaagtcctattcagaggaaactttcatctttatttaaaagggaagaaagcagtaaaattaatcccaattaagtcataattggatttacttcattttacaaaatttgtgctttgaatactgaatactttttaaatatgaaaaatcttctattcaagcatggtagtaggcacaatgggctggtaccacgtgctgaacagggccaaggcga

SEQ ID NO: 240436 - DNA, 938 bp, Homo sapiens
attgtcattgtgaaccatcaccctaatgcattgcatgcccaattatatttcataataaaaaccttgattcctctctctctgctcctcagttaacacctagaaaattctgcactgtgtctctcatatctgttatctatcttctcttttgctttctcacttctgcttgctactccatttcttcattcacaacaaagaaagaaatgcagtgatagttctcttcctcccaaaacctccgctagaaaacattggccatctcaaggtaaacagcaatgggagggcctctcgtgatggccgggaatgatatgcattaccagaaaagcatgagctactactgctcttcactttccttctgccatccatctgcagtgcttccctaaagggggtcatggattcatattctcccataaattttccagtatgggtctgctatgaaccaattcagatcttcaggaagagtaaaggtgaacagaaatatgtttccttctccttgtattttgaaggccagtcttatttcaattagaaaataatgctggaaaagttactttgagaagaagggcaattgacctggattatgagtgacagaatatttttccttggaaacatatattttttcttaagtataactctaacatttggtcttaaaaactttttgaaggccgggtgcggtggctcacgcctgcaatcccagcactttgggaggcccaggagggtggatcatgagatcaggagattgagaccatcctggccaacatggtgaaactccatctctactaaaatacaaaaaaattagccgggcgtggtggtgcgcacctgtggtcccagctactcaagaggctgaggcaggggaatcgcttgaacccgggcagtggagattgcagtgagccaagatcgtgccactgcactccagcctggcgacagagtgagactccgtctcaaaa

SEQ ID NO: 240437 - DNA, 745 bp, Homo sapiens
ctctcgttgcccaggctggtgtgcagtggcacaattttggctcactgcaacctctgcctcccgggttcaagcaattctcctgcctcagcctcccgagtagctgggattacaggcgtgagccaccactcccagctatttttttgtatttagtagagatggggtttcaccatgttggtcaggttggtctcgaactactgacctcaggtgatccacccgcttcggcctcccaaagtgctgggatgctcctcttttacagacagagaaactgaggcctcctgacccccaaagcacccttcttccggtcacattttcatttgcaaacctattcccacatagaagaaagaagctgagggcttttaaaatatgtagtaaaaagagacatcaaagaagaaagaagaccagagacagaagaaatatacatagaaaaaaatatgtgtaaagtgcagggcttacttttgctgtgaaagagaaataattacagaagggcaaagtagatgttctaagtaagacttttttttttaaagagagaaaagtctggaacacatgctcaaactcaaagtagaaatcttacaaattcctattgcaaaataactcctggtcagccaaccacaatctctataaatatatcacaagatcaacagcccaggaaaatagggggagggggagaacaactgcatgaatttttttcaaaatcaaaatagtatacgcaaaatagttcctctcacagctggaaaggaaggaatca

SEQ ID NO: 240438 - DNA, 447 bp, Homo sapiens
  misc_feature (129)..(129): n is a, c, g, or t
  misc_feature (180)..(180): n is a, c, g, or t
acctctaggcaggagtccctccctcccgtgtgaccattgtcaaggccttgaccgtcttctgcctctggagtttcctgccccacctcaccaatgtggccagagagatctcccaaagtgcagctctgaccntcatgcccctaattcaaaaataactgatgggctgggcacggtggctgacancctgtaatcccagcaatttgagaggccagggcaggtggatcaccagaggtcaggagttcgagaccagcctggccaacatagtgaaacccccatctctactaaaaatacaaaaaattagcttggcatcgtggtgcgtgcctgtaatcccagctacttgggaggctgagacaggagaattgcttgaacccaggagatggaggttgcagtgagtcgagattgcgccactgcagtctagcctgggtgacagagtgagactccgtctttaat

SEQ ID NO: 240439 - DNA, 892 bp, Homo sapiens
tcttgttgccctggctggagtgcaatggcacaatggcgcgatctcggctcaccgcaacctccgcctcctgggttcaagcgattctcctgcctcagcctcccaagtagctgggattacaggcacccgccaccaccatgcctggctaatttttgtatttttagtagagacggggtttcatcatgttggccaggctggtctcaaactcctgacctcaggtgatgccccctgcctcggcctcccaaagtgttgggattacaggcgtgagccaccacacccggcccggggctcccttctcagacatgtgaaatgcaggtgggacaggttggagacaagaagacatccagctacacagcactcagcttgagtgagtgtggcgtggggctcaggaggcagctggagctccaggctggagggatccaggcaccatcagcagggagatggcagctggcatcaaggagggcatgcagtgcatggggccaaccatgctggggatacagagctctctaagaactcgcaggcctctctccaggagcaggcacccctcccacccacccgctatttcaggagtgaatgtggaagatgtcctatgcacgagcagcagaggtggaggctgacctacgaggctgaatgaacgaaaggagtgagaccaacactactaggacgccccactggactcagacgagatgaggctggagacacagccactggatgagcagtcctgggcacaggtgaggccacagtgggactgcagaggttaagtgaatgccctgaggaactgggtcagtggctttttagatggagatgatggctcagcaaagggagagagcaaagaagcaggcagacagaggcaggcaactgtgcatgctcacaccaggaacatggtttacagaag

SEQ ID NO: 240440 - DNA, 671 bp, Homo sapiens
ttttctcataatcttttatcttccctgccaccacataaatagaagtccttggtacatgaatccacgagatacatgagactcagagaaatgccagcaaattggagcaatatcaaattggaacacagctccatagagtagaattgactgttttggttgtttggcatatcagaaatctaagggaactaataaatcaagcccaccaaaattttattctgcttcaatatagtcataaccgtgtattctaggccaaggcccacaataattgggctgtatctgtgccaaaatagtcttataacaatttaatttaaggttctgtggctgccactcatctttaaatccatgagtctgtccctagacctttttcaaaagttgattaatttgtgttttttgagagaaaacattaccactgtgactgaactgatgtgtatcagagtcagataagtgggcagcgcagagcacaaacatctcagacattcccacacagaatttttagggaacaattactagtggctgtctgtgttactgtggagccttaaaatatatggcaaaccaatgcacatgcacaaaagtgaaacctggaaatatcacaggtatccaaccatgagaatttccgtatctggtcaagatggagtaatagggcccaaatttaccctcctgccttgaaacagcca

SEQ ID NO: 240441 - DNA, 503 bp, Homo sapiens
ttacgaaaatgactttaataaaaattacatgcctatgtatttttcctttatgtattataatattcgactatatgtgcatcttaagtgcattgatttcgtgcttttccatcttcataatatgatttctgcctaattattgctgtatactagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatcattccattttgacaccttttatcaagctttaatgaaatgacccaggcaaacaaattgtcattaaactttccatcacttcgt

SEQ ID NO: 240442 - DNA, 412 bp, Homo sapiens
aatttcacctttttaaaccgaagaaacatttgttcatacgtaatagcttgaggtttctgtgcccaactcacgtgacaaaatggctttagaaaaatattttttagcagtaattttatagtaatttcaataatatatggtaacagaaagcttgtcagttagaatctttagcttttcttgccagcttctacccaattcttccccctcaacccccgacgcttgtttttagtggtaacattgctaccaccgtctctacaaagttaggataactaatatttgaaagtggagttgttttcaacaaactttagtatttctgcccaagatgaacaagtataatgatggggatactttacttctctcataacagagcttgcagtgctcaatattaaagaataaaattacagacctttaccaa

SEQ ID NO: 240443 - DNA, 379 bp, Homo sapiens
ccgtaccaccacccaacactgcggtgggggtgcgggagccgtccgagcgcgtcctgcaccgcgaggagagccgggcctccctagctctcgcaagcccaggaacacagtccgagtcctacaactccgaggtctgactgggaagcaggggccgctgcccgacaattacccttttccgccgcccctattccggtgcccccctctgggaagttccgaatggttcagaccgcaccagctggggatgctgggggaaaccatttcattaagcgcgggagtatgctgaaacttaaaaatcattttaaaaagagatttgagggtaaatatagccaacctaaggcttcctgtccacataaaagagaaaaataaagaaaaaacgttataa

SEQ ID NO: 240444 - DNA, 537 bp, Homo sapiens
ccaaatgatagttattgccaactcagagagttctgttttctactttgtgacaccccttcttcatcagaaattctttatatgatatatttgtaaatgcaatacctgtgtcactcaaggtacaaatgagtacatgctttattggactttttagtgagtccatgtttacctaagcattgctgagtggaatggaacatcgaggggtagaaggccaggtctctgctgcagagacctgacagtcaaagaatgccgagtctagtgtttgaaagcagatggtggccatgtgaatcctggttctacctctttctacctgtgtgaaccccgggtaaggtggtgagctcaatttccttccttttctcatatgtaacatcaataatacttccccacaggcatggtaagatgactaagtaagatagtacatacaaattctcacaagagtgcctgccactctgtgagtttggcaaaggtgaggtgtatttatttagaaactactgtgccgcctcaccattttgattaaaaaaataaattggttttgtcttt

SEQ ID NO: 240445 - DNA, 376 bp, Homo sapiens
acatagagtaaaatccacttaatgtggctgacagagtcttacacggtgtgcttttcatccaccactttgggccatagatcgggtgattgggggaagacctgaggtatctgagcagaaatctggttggggagtgagccaacagttatctggagggaaactggttcaggcagagggaagagcaaatccaaagctcctaaagcaaaagcatatttttggtgtatttgagaaacagcaagaaggtcaatgtagctaagagccggaataagagaagagatgcaggcaggagaatcacttgaacctgggaggcggaggttgcagagtcgagatcatgccattgccctccagcctgggcgactgagtgagactccatcttaaa

SEQ ID NO: 240446 - DNA, 664 bp, Homo sapiens
acatagagtaaaatccacttaatgtggctgacagagtcttacacggtgtgcttttcatccaccactttgggccatagatcgggtgattgggggaagacctgaggtatctgagcagaaatctggttggggagtgagccaacagttatctggagggaaactggttcaggcagagggaagagcaaatccaaagctcctaaagcaaaagcatatttttggtgtatttgagaaacagcaagaaggtcaatgtagctaagagccggaataagagaagagatgcaggcagggatgagattgtttttggcttcttaggtcatggtaagaacttggattttattttttgtgtaatgggcacccatcagatggtgttgaggaggggactgacacaaaatcatttaggtattaaactgatccttccgctgctccatggggacccagagtggaagtagtagcaggaaaccaattaggcttttacaatagttcaggtaagagatgacagtgacttggactagggtgtagtagctatggagatggttgaaaatggctagatgtgggatctattttaaaggtaccaccaacagcatttgcagactcaaggatgatttcaaagttttgggtctgagcaactaggtgaatgataacattgtttactgagacggggaggcct

SEQ ID NO: 240447 - DNA, 724 bp, Homo sapiens
cttgaacttctggattcaagtgatccgccctcctcggcctcccaaagtgctgggactacaggcttgagccacctcgcccagctgaaagtgacactttaatactttcaggaaattataggagatgattgttaagagctcaggataaagagaagtttctggccgggaacggtggctcacacctgtaatcccagcactttcagtggcggagcacctgtggccaagagtttgagaccagcctggccaacatggtgaaaccccatctctactaaaaatacaaaaattgaggtgccgctgttgctgctcgtgttaaatctagaaccgtagccagacatgggactggaggacgagaattagtggatcccctaacaacagtgagagagcaatgcgagcagttggagaaatgtgtaaaggcccgggagcggctagagctctatgatgagcatgtatcctctcgatcacatacagaagaggattgcacggaggagctctttgacttcttgcatgcaaaggaccattgcgtggcccacaaactctttaacaacttgaaataaatgtgtggacttaattcaccccagccttcatcatctgggcatcagaatatttccttatggtttcggatgtaccatttgtttcttatttgtgtaactgtaagttcacatgaacctcgtgggttttggcttaggctggtagcttctatgtaattcgcagtgattccatctaaata

SEQ ID NO: 240448 - DNA, 2230 bp, Homo sapiens
ggcggggagggggcagtccacgaacttttgtcattcagcctgggagaccacggtgacattcctgtctgcgctgcgggcaggccagcctctccggccctggactagggggcgccgccgagagaagccgccgcaggctgcagagtcgccgaccgcgctgttcgcaggcagaccccgggctgcccaccgcggcctagcgcgcgccggatggcaggagaagtgtccgcggccacgggccgcttttcgctggagcggttgggcctcccgggcctggccctcgccgcggccctgctgctcctggccctctgcttgcttgtccggcgcaccaggagacccggtgagcctccattgataaaaggttggcttccttatcttggagtggtcctgaacttacgaaaagaccccttaaggttcatgaaaacacttcaaaagcaacatggtgacactttcacagttcttcttggtggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaatttgatgacaagtttgcatatttagtatccaacatacccattgagcttctaggaaatgtcaagtctattagagagaaaattataaaatgcttctcatcagaaaagttagccaagatgcaaggatggtcagaagtttttcaaagcaggcaagatgtcctggagaaatattatgtgcacgaggaccttgaaataggagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagaggagtttagatatgatcgttttatagaagatggtaagaagaaaaccacctttttcaaaagagggaaaaagctgaagtgttacctaatgccgtttggaactggaaccagcaaatgtccaggccgattttttgcacttatggaaataaaacaattgttggttatacttttaacttattttgatttagaaataattgatgataagcccataggactaaactacagccgcttgttgtttggtattcagtatccagattctgatgttttatttagatacaaagtgaaatcttagagaagctaaaaggaaagaaaataaatctatcaaaattaccctaaacatcctaagctcatctatttctttttaatttctgcaaagtaattgatttatttgtttaaaaagcgctaatttctatttgatctgatatcagtccagtttgtccttagtcacaaagcccatataatataaaacaggatggtggcaggaaaatggacatcaaaatcaacttaagggtaggctcaaaacagggttgttgttgtttttttagtttctccttgttgtgattttcacctgttataataaatgtaccttcacaccaatagattgggcactgtggaatttaaatcactcaaattgttctctaatatgtaaaattacactttgaactactagaaaattgtgctggaaatggacacagtctaacaaattccaaattctcacagaagaaggaaattgaatttccatgagttacactggatgaaaatgtttcccttaagcatatattaataatacctatatc

SEQ ID NO: 240449 - DNA, 233 bp, Homo sapiens
caatgacatgtgacatatactgagaattcttatgagaatgggattaaattgttgtgtcatgtattttttgaagtggcacaatattaatgccaaataactaatgataagttaggacagcgtgtattaagccttgagcaatcactaaaaataaaataaggatagctaaaaagccaagaggaaatgaaaaatacttttaaatatttaattaataaaataataatggaagaacagaa

SEQ ID NO: 240450 - DNA, 293 bp, Homo sapiens
tccccttcccagcgccgcgtactgcggcggccttgtttgattacctgcctttccatttcttctgtatttacaaccctcccgactcccggggagagggcggcataggcagccaatcaggatgcagtcgtctctaaaggtcagggtgacacacatttcccaagatcattcacggacttcgcccttcgatgccttgttctcatgacaaaacctggctgccagcacttaatgtgatttccccccatctctggcaactgagagaataaaaaactgaacataaaaattaactcttttat

SEQ ID NO: 240451 - DNA, 434 bp, Homo sapiens
acatctgcactgaaactcctctacttacaaacattcacagataagaacaaagccatgcactaaaggaaaagtaggccagctccgcctgcttccccacagatggtgagcagcagtcatgcgcatccattttagtcttggccatcacgttagtcattagtgttggcccatgagctgtttaaagaagtgtcttcttaccatgaaaagaagaaagtcaaagtaaaaacatctttggatacatttctgaatcgctgaaaagcaccaagtagagccagaatcaatgccagcacatcaccggtccttttgagaaactcaactttatacagacatgtatactgcagagacttagaaagaaatagacttaaacacagccttttggatatgatgtatttgtacatgaatgatttctaaatttctaacagcaaaaacaacactga

SEQ ID NO: 240452 - DNA, 435 bp, Homo sapiens
gcatgtgtgctttgtgagcagctcttgtattctgtgtgtgaacacatgtgctggatggaagattctcctcacgttctgtgaatgtctacatgaagacctgcctctggtgaatggctctccttactttctatgcgtgtgcattagcacagtgtttggtggagattctcttcacgctgtgtgtgtctatatggacgcaaatgtttgctgaacagtccccctcttgttctcttttttttttgagacagtctcgctctgtcacccaggctggagtgcagtggaatgatctcggctcactgaaacctctccctcctgaattcaagcgattctcctgcttcagcctcccaagtagctggggttacaggcatgtgccaccatgcctggctaatttttgtatttttagtagagacagggtttcaccacattggccaggctggt

SEQ ID NO: 240453 - DNA, 427 bp, Homo sapiens
gtaacctcaatgtgaaatatattgtattgtaattggaaggctgggtcaggagccccaaagctttgaaagaacacctcctgagagtacagtgggaaatcaaccaccagcagatgatggttgagctagaagaaccacgtgtttccacagggagctgcacacgaggacccggtggtccctgacctgccctctccaggggggacctgcactttctgccaccaaagaggattctctgtagggaggccaggatgattctccagaatttaccatgccttgagatgaaatttcctttcaaacttccttgtgtccttttgtcctcattccatgttcaccagtcttctgactgtttcattttccagaaaggagaaactgaataacatgtatattttaaccttgcctgcaattgtaaatcaataaattggtgtattta

SEQ ID NO: 240454 - DNA, 621 bp, Homo sapiens
accctggcagggtgtggtgggtcatgcctgtaatcccagcactatggaaggccaaggtgggcagatcacctcaggtcaggagttggagaccggcctggtcaacattgtaaaaccctgtctctactaaaaatacaaaaaaattagctaggtgtggtggcaggtgcctgtaatgccagctactccagaggctgaggcaggagaatcgcttgaatctgggaggcagaggttgcagtgagctgagaccgcgccactgcactccagcctgggcaacagagtgagactccatcaaaaaaaaaaaaaaaggatgtacacatatatacttctgttacagcaaaatatatttaagaatcttcattttcttcaattagtaaaaacgacaaaaatgtaaggataagaaaacagttaagaaacggtaacaggccgggtgcagtggctcacacaaagtgcttgtaatcccagcactttgggaatctgaggcacgtggatcacttgaggccaggagttccagaccaacctgggcaacatggtgaaagtctgtctctactaaaaatacagaggcacaagaatcccttgaatccgggaggcagaggttactgtgagccaagattgcacactgcagtc

SEQ ID NO: 240455 - DNA, 506 bp, Homo sapiens
agctagtatagccttcacaccatacagactaatctcactgatgaatagaagtatgtaattgttaattattaatgttagcaacttgaatctacaggtgactatgaagtatttttttagtttgaagatagttttttccagaaatccaaggatggcttaatcatatggaataatcaagggcaaagccaagccaagaaggcttgaaagaagaacactagagatatattataatgctctaataattaaaatggtgtggtattaggttatgaatggataaacagaccaatggaacaaaattgcgaagccagatagaaatcaaccagtctgtggatctattaatttatgggaatgtcttttgtgagatatatcaattaatgggaaaaagactgtttaaaacataattcagtgacagttgactgtatggaagaaaacaaaattaaacccttatttcatttccagatggatttaagactcatgtaaaaaagtaaaactttgaaactcagagaaca

SEQ ID NO: 240456 - DNA, 129 bp, Homo sapiens
gtaattacctctttattagcggtcggcggtttgtaaacactcggcccgacgccgggccgcggaacggaagcgcccgcgctgccaaccctctgtcttccacgttaaatccgatttgctccagcagtgaca

SEQ ID NO: 240457 - DNA, 3552 bp, Homo sapiens
aattcggcacgaggcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtctcccacagggcacgtggacaacaaccaggtccacctggggctgcgtggggagctgttcggccgtgctgacccataccgcccagtggccagcccgcgcacggacccatacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatggggaaaaaattgcaaaatatgtatttttaaagttcatgatttgtaggcaaagatgttaagagcattgtttccattaaaatcaataacaatga

SEQ ID NO: 240458 - DNA, 307 bp, Homo sapiens
tgcctcccaaagtgttgggataataagtgtgagccaccacgcctggcccaatccctgtctttcacctttggccaccatcaggccaaaggttgccggcaggttctcaggagcagcgtctggggacacctccaccagatctccccgcaaccccagaatgcatcccagaagggtcttgcagttgggggctgccctcttgccccttcctcatgtgagcccctcactgtggccatgacacaggcctggctctgctggcccttggcagggtggggactgagccccaactcctggtgcttcctcccagtattat

SEQ ID NO: 240459 - DNA, 615 bp, Homo sapiens
ggggagtgctgactgttcaggttggagatggaaatatagggggtggaagtgaggttttcttggggtcttctgctcctgggtgggatcgcagaactggttgagccagattaccagctaggtggtatcagctgatccatagagtgcagggtctgcaaaatatctcaagccctgatctttggttttacaatagtgatgttatcccgaggaacaatttggagaggttcagactcttgcagccagaggccgcatgactcctaaaccaaaatttctaatcttgtagctaatttgttagtcctacaaacgcagtctggtccccaggcaaaaagtgggtcttttcaggaaaaggttagttcagcctacacccaggaatgaacaaggacagcttaaaggttcgaggcaggatggaatcagttaggtttgatctctttcactgtcataatttcctcagttacaatttttgcgaaggcggtttcaacttcctactgttgctagtcctgaggacatctttttggctcttttaaccttgcccttacctgtttcctgattgataacaggtatatctgtatcataccattagaatggctggcattacaagagatcttccaatagataaat

SEQ ID NO: 240460 - DNA, 460 bp, Homo sapiens
gagacatatattattcttgaattttcagaacctaccaggaggagagggtatatgaaatatctagcagccccactaaagtggggacttctgcctcctctctgcaggtataagatgagcctctgttatgttctcagctgcacaggaacgtgagggcaggagcctgctgctcacctgcccaccatcctgtgagtcagttcaccagtaatccagagctaaactaaggggttaagaggagagtggcctttttaaagtaaaaatcttacttaccttagggccgggtgtggtagctcacacctgtaatctcagcactttgggagccgaggtgggcagatcacttgaggtcaggagtttgagaccagcctggccaacatgatgaaacccatctctactaaaaatacaaaaattagctgggtgtgatggcaggtgactgtaatcccagctacttgggaagctgaggcag

SEQ ID NO: 240461 - DNA, 355 bp, Homo sapiens
tttgcaaagctggtgttaaaaggaagatttttctgaatttgccttggagatgtttttatattttctcctaggttacattttattttccccaaattaaggaagtatacaaatatagtgacttttcctaaccttgagaactttaatatgtgttgctacccgggttgctgaagaaagaatcccttagtcttaacagcctgactctgtacaaactatgtttaattactccccttctatctccactttaggtgggttcttttgcaatgaacagtgtatgtcatttaaagttggcttgctggacctgaagtgtgtcaatgtatgatctcaaataaatgaaagactgatactaaaaaaatgc

SEQ ID NO: 240462 - DNA, 415 bp, Homo sapiens
taaatttaagttccttatctcctgagttatgtgaaaatatccctcagtacaaaacatttgtgtgtttcacagatgactctcttgttttgccgtaatgctaccaagtttatggaaactagtcaactgaaggatttttctgttgtgttatgtgtaaatgtctgaacagtaaaatcatctgtgtattcctgtaacattcacgaagtatgaggaagtgggtttctccttgtttgatgtgagtggttttgcttgttgcatgggttccctgtgctttgtaacttgcatgaacacaaccaggtttctcaacaatgatttgtctgctgactcttttcagagatagtgaaggaaaaaaaatgtattaaaaccccaaattatctaggtttccaagtaggaaaaataaagatacatatgactttta

SEQ ID NO: 240463 - DNA, 628 bp, Homo sapiens
tccagttctaaatccgagcactcttacccattctaattctttcagtaactcagcgaaacggatggggcccttccttccccggagcactcctccagggactgagaatctgcagagccaggctcagcgctcgcctgcagagcctgcggtctgtgggacccgccagcaagatgaggaatcactttcgggaggaagggtcgtgctggggagggtcgcgccggcggggtcaagagaacctcctctagggtgggaatcagagcctccgggccgcggtgtttgagggtgagtggaattaatcccgtgatggacgtggggccttctaagggggaccaggagtttgcgaagaggtgactttgggaggggttcaggatggccagaggtggaggctgtgacctcagtgaggctggatcaagggaggggcaggtggagaagaaaccgttttaacgaggtggctttaagcggatcctaagggccccaggagatttaggaggaaggacaagaggattaagacaccgctttctggtcgggtgcggtggctcacgcctgtaatcccagcactctgggaggccgaggcgggcggatcacgaggtcaggagatggagaccatcctggctaacactgtgaaaccccg

SEQ ID NO: 240464 - DNA, 1331 bp, Homo sapiens
ggttcctaatttggcaattgtgaattccagataacagaagttttcttcccaagttttctttgaagttcctagtttgagatttcacttcaccagtcagttcaccctgttggtcagaatttggttaacttttgccttgccatttctctgacttttaggagtgaaattgtcttctggcagaattagactcccagtagctctccaaataatcaaaatttctgaacactctgccagttttgtactgtgtgtcaggaaacatcattcatactttcttagatagatgagcagtgtgggtattctctcacttctctgtccattttcccctaacctctctcagttctttaccatgatttaccttcaggtttccatcaaggaggactcttaaaatacaagagttgaggtggagattccgtatctctactcctgtttaaaccctatctgttcaaactttggtgattcctatgaagttgtatttattcttgtattaaaaattttaatgcatcttcttatttataatctatatgttaatatttggctatctgaggcacaagttgtatttctgagagtttccaggtactttcttgtgagtttatgggtattttctccacgttcttcttgtagctcttaagttctattgcatttggtttatggttttttaatgcctttttaaaaattctgttgcttatttcagtttgaacccattttcttacgtcaacacatatccttctaaaacctagtttttacagtgagacatgttccattcctgttacagagtccctagactatgaatctgggccaggtctgtacattagctagaactgctctgttgaaatctacttcccaaacccccacatgtgctaccaattcctcattcctcagttctttcattcctggaagcggaaagcttattcagatgtgtcatcctactgtatttaagatattttggataatatcttaaatcttggtcaaaaataaaattcttcatttttaagcatgctttgtagccagctgtttatttctgtgacctcccttttccttctcagtcacagcccttaaggcaatgtcctaacctcctggtgttttgttatctgctctgggttaatcacgtaacagtagtggtggcttctctaaaaagctgaaggttcttattcttttcccttgagattgcacacattcatctgctaaaagataaggggaggaaaaaaactgttaaaatgttatgtgggattagataaactataaatttatttccagttcaaaaattgattttatataatgaatataagagggacctgtgaatttgtgtttaaatactctcacactatacagcttta

SEQ ID NO: 240465 - DNA, 1050 bp, Homo sapiens
catgttgggagagcttctgggtgagggtctgttaatcttggttacattgggtgtgcaatttgtgaaattcattgtgctgtacgctgacagtagattttatgtatcttatacttttagagttaaaaaatgtacttttttttttttgagacagagtctccctttgttatctaggctgcagtgcagtggcacaatctcagctcattgcaacctccgcctcccaggttcaagcagttctcctgcctcaacctcccgagtagctgggattacagatgcccaccaccacgcccggctaatttttctatttttagtagagacggggtttcgccacgttggccaggctgctgtcaaactcctgacctcaggtgatccaccctcctcggcctcccaaagtgctgggattacaggaatgagccaccttgcctagcctaaaaaaaagaaaaaaaaaaaaaaaaaaaaaactttgccctcgtggatctcatctggggtgagactagtgactccaaaatggtatctccagttctacctgaccactgagctccaagagactcacatgccactgccccgcagttatccacctggatgtttgatgggcatctcacattaacaattctacgtagaaatcttgatttttatatctaacttgttctgtccccagttgcactaaataataccgcctacccagctacttaaacctaaaacataagctgattcctctttccctcaccctgctgccattcagttacatagtcctgttgtctcttcttgtacactccaaatatatccacttctatttctgctctgagccaccatcatctccatcgcagacttgtgcaatagcttccaatcggtctcttcagctcttcccttctgacaatctcttttccacacagttgctttagtgatctttaaaatcaaatcaacttacatcattacctgctgaaaacctagtaacttcatatccaagttccttatgtgtgtctacatttaatccctaacacacttcgtattcaccatctagttttcttccccaatcagtctaatgtcagaata

SEQ ID NO: 240466 - DNA, 654 bp, Homo sapiens
  misc_feature (16)..(16): n is a, c, g, or t
ctagtgcgatccccgngctgcaggaattcggcacgaggttccttggtgcactgatgtggtctttgaaactcagaacaaatgttacctgggccgatgttacatgagtatttggccattaaaatcagataaagaggccaacctagcaagttactctcattgaagtgtggcttgtctgccatcctcattgggagcacgtagaacctccccaagctgagtgggcagggtccgtgtggctgtgtgaagggccccgtcgtcttgtgtagctgctcccgtgttgagagtatagcacgttgaaaacagccttggcaggaaccacgcttgctgttaaccagctcgtccactaaccagctgtgtataccctaggtcaggccagctgtttaaaaaaaaaaaaagtgaagatatttgttaagagagtagatctcaagtgccatcatcacacgcacacaaggggtgatgatggcagttgataggtatgttagttagcttgatcatggtgatcattttatgatgtatacatatatcaaaacatcatgttacgatgtatacatatatcaaaacatcatgttacgatgtatacatatatcaaaacatcatgttgtatacctaaatatataccatttttatttgtcagtcatacctcagtaaagcttaaaa

SEQ ID NO: 240467 - DNA, 331 bp, Homo sapiens
tgtctcctggtttttgcttgaaagaatctcagccttgcttggactaaaccatgctccagctgaactttctcattgcttacatccaaacagcaaaagctgctggagaaaagtcagtcatataacaagctaactggttttaattcatgacctcagtcctctcaggagcactcaacactggctggcaatgctattccagtctctgggttaaccattcatacgttcacatctcctcaaatttcacatcctttttccctacctctcatttttagctggtgaccttgcctcaacttcaaaaaataaaaaccacctatgaggaatgcttcaaatcaga

SEQ ID NO: 240468 - DNA, 431 bp, Homo sapiens
ctgggcttgctcacacttgacccagaagcctgagatgtggcatttctgaagtgtccaatttatgaagttgaaaactggggcaagctcatctgtttgtgcaatgttgattgccaacggttaatcaccaagggtaagtggaagaaatcattcctgttcatttgcaaatggaaatcaaatgaggactgtgccgaaatgcatcagcattttcacttccaactgcaaggatttcagaagacagctgaccttgggctgcctggcaggcacgggcctggcgccgatacttctgctcagagtgcctgtgctttttggtgcatgcatcaagtcctgaagtaatagccccacgtatcagatgtgtaatggatttctctccatgctgcgggattcattaccatgatttatggctgttttaatgtacacagccttcttaaaca

SEQ ID NO: 240469 - DNA, 631 bp, Homo sapiens
ctgggcttgctcacacttgacccagaagcctgagatgtggcatttctgaagtgtccaatttatgaagttgaaaactggggcaagctcatctgtttgtgcaatgttgattgccaacggttaatcaccaagggtaagtggaagaaatcattcctgttcatttgcaaatggaaatcaaatgaggactgtgccgaaatgcatcagcattttcacttccaactgcaaggatttcagaagacagctgaccttgggctgcctggcaggcacgggcctggcgccgatacttctgctcagagtgcctgtgctttttggtaaggctcaggacgttccctgccattcctgcccgtttcaaaggcagacccatttagtttggaaagtaggaagcattttcagatgctgtgaattcatgtgcacacaccactgccacttcttgcttttttatggctccgcagagacttgggatgcacttcaccttgctgaaggggctcagctaattatgctgaaatccttccaagaggcgaagtgatgtgtttatacatcctccttgctgaactgttggcctcaagaaattttataataataaagcatttccatgttgggtaggttctctcccctccacccccggaaagtgcaa

SEQ ID NO: 240470 - DNA, 334 bp, Homo sapiens
tccattctccacattccttcatccagtgccttcccacctgttctctttcctattgtgttcccaggacgatgggagccttttaacaccaatggagcaggagatgcactgattcacatgcacccaaatacaacaccaaccccacaagctctcagctcaccagtcacagacatcaccttctacggacatatttttatttcactgagctacaactacgggcaaggcaacgacgagctgtgtggagacttcaaaacatagaggacaacctctgccctcaaagacaacatccaactgaagaaaggatcaagaaagatgaaaataaataagttgtttgatt

SEQ ID NO: 240471 - DNA, 451 bp, Homo sapiens
gcgtcataacaaagcaccgcagaccgggtggcttaaacagcagatatttattttctcacagtgctggagcctgggagtctgagattaggtgtcagcaggtttggtttctcctgaggcctttctccttggcttgcaaacaactgccttttcactgtgtcctcatacggcctctcctcctggcatgggcatccctggtgtgactcctccttttaagggcagtagtcctgttggaccaggaccccaccctaatggcctctttttcatctcatcaccccttaaagactttgtcttcaaatacagtgacattctgacataccgagggatgggacttcaatatatggattttggggggatgcaattcagcccataacacttctcaagggactgacgccccatcccagtgtggggttggtgtttctctgaggatttgcagggaactctatcaggaaag

SEQ ID NO: 240472 - DNA, 486 bp, Homo sapiens
taaggattaattgagcctaaaagtttgacgttgcaatgagctgtaattgtgccactgcactccaccttgtaatctgtagattgcattgagcaggatagacacatttacaatattaactatttcaacctttctacaagagcacaatcaagagtgtgttaatttttatatatttgtgaatttttttagtttttttctcattatttatagtctcattccattttggtcatataaagtaatttatacaattttagttttaaaaaatttggtaagactttttttttggcctaggatgttgtctatgaaggaaaatgttctatgagctattgataaaagtgtgtatcctaaggttattgatgggtgccctctatacctttgttaggaataattgttttatactgccttcaagttgtctgttttcttactaatattctgtcttgttttatttttattacagaaagtgcaatattaaagtatacaataattata

SEQ ID NO: 240473 - DNA, 1020 bp, Homo sapiens
catgggggtagcagggacccaggcactgtgaccatcccccctgccatgtgggaactgcgatcagcctccttttggagggccatattcgctgagttctttgccaccctcttctatgtcttctttgggctggggtcctcactgcgctgggctcctggacccctgcatgttctgcaggtggctatggcatttggcttggccctggctacactggtgcagtctgtgggccacatcagtggagcccacgtcaatcctgcagtcacttttgctttccttgtgggctcccagatgtccctgctccgtgccttctgctatatggcagcccagctcctgggagctgtggctggggccgctgtgctgtatagcgttaccccacctgctgtccgaggaaacctagcactcaacacgttgcaccctgcggtgagcgtgggccaggcaaccacagtggagatcttcctgacgctccagttcgtgctctgcatctttgccacatacgacgagaggcggaatggccaactgggctccgtggccctggccgttggcttctcccttgccctggggcacctctttgggatgtattatactggtgcaggcatgaatcctgcccgctcctttgctcctgccattctcactgggaacttcactaaccactgggtgtactgggtaggcccaatcattggagggggtctgggcagcctcctgtacgactttcttctcttcccccggctcaagagtatttctgagagactgtctgtcctcaagggtgccaaacccgatgtctccaatggacaaccagaggtcacaggggaacctgttgaactgaacacccaggccctgtagaagctccagctgaatagagggagtagaaagcttctgagtttacgtggaggggtttagccagcccctagatgaagaaagagactgtggggaggggcatgtacttctttattttttaacttatgtatgtggttgtttttttttttttttttccttttgctgtgtgaaatctttcaagttgcattc

SEQ ID NO: 240474 - DNA, 736 bp, Homo sapiens
gagtcagaatgccaagcgggcaagagagtcgcgaggtcgctttactacggatagctcacggagctgaaaaactcggattgagtgtactgggtaggacccatgctgggcaccattcttgcaggcctcacctcgaatttctgctctctggtgcttcatgatggagatcttcctgacgctccagttcgtgctctgcatctttgccacatacgacgagaggcggaatggccaactgggctccgtggccctggccgttggcttctcccttgccctggggcacctctttgggatgtattatactggtgcaggcatgaatcctgcccgctcctttgctcctgccattctcactgggaacttcactaaccactgggtgtactgggtaggcccaatcattggagggggtctgggcagcctcctgtacgactttcttctcttcccccggctcaagagtatttctgagagactgtctgtcctcaagggtgccaaacccgatgtctccaatggacaaccagaggtcacaggggaacctgttgaactgaacacccaggccctgtagaagctccagctgaatagagggagtagaaagcttctgagtttacgtggaggggtttagccagcccctagatgaagaaagagactgtggggaggggcatgtacttctttattttttaacttatgtatgtggttgtttttttttttttttttccttttgctgtgtgaaatctttcaagttgcattc

SEQ ID NO: 240475 - DNA, 395 bp, Homo sapiens
gtaccacccaccagctgaccttcagtcgtgtcctctgggaaatgtgcaggagtttcttgatgttgggtgtcagaaggattaaaaatgctgaagaggaaattcggatgcccagcaggtgccagtctgcaggagcctttacgtttggtgcctgctgcttcctagacacacttgactctcttcactcgctcgtgatattcccctcacctgatgtgtctttacctctacttggcaggtgttttagtgctgactctggggacagactcctgggttcagatcctgcttcaacacttacaggctgagttaggcaaactactgaacatctctaaatcgtataataaaatcacaggtaataaccatgcctccttcatggaggaattgtgggaattaaatgagct

SEQ ID NO: 240476 - DNA, 547 bp, Homo sapiens
attatatggttttatgtattttcaatctcaaaatattctctaatttttttgctgatttatttactaaagaaatttgagggatttgctataatgttagggatttttctagatgccacattgttattgatttctaatttaattatattatgctcagaaaacatattctgtatgctttcaacacttttaaatttattgagacttgttggagggtccagcatataatctatctcagtgaacacactgtatttacttgaaaagatgtatattctgcagttattcagtgtagtgttctataaaatcatttaggtcaaggtggttgatagtttgttcaaatccatctacgtcttcattaattttatttatctggctctatcaattgctaaaagaatgttgttaaaaattgtcaactatgattttagaatcatttatttctccctttgattaatgaatgttgtttcatgaattttgaagctattcagagacaaaaaaaaaactatttatgaatattgtcttcctaaatgaactgatgattcttttggcattatga

SEQ ID NO: 240477 - DNA, 590 bp, Homo sapiens
tcaagtttccatctctaatatatagaattgctattgatttttatattccatgatcttgataaacttaatatttccagtagtttttttttttgtagatttcaaaagttggtctacatataattatgctctctgttaaaaccagtagttttaattctttcttctcaatctttatgctttctaattttatttttatttcttcacttgttgcaaagcagttgtcccaggtgggagccaaaatccttatctcattactaatcttaggaaaaagtaaaatgtttcactattatgaggtcacctgtaggtttcttatagatgttctttatcagattaagaaaggtcatttctactctcggttttctgatcgttattaattcagaaagggtgttgaattttgccagatgcttttatttgcatttattgagataattacatatttttatttattatgtggtgaattatctaaattgggtaaaaagaattaaaatcattgtccaattgaacattttgcctgtcggctatgggtttcccttttcctttggttaaataacagttctgccacaaaataaaaatctagaaacacacattcccct

SEQ ID NO: 240478 - DNA, 395 bp, Homo sapiens
tgaatggctgcaagtttacagcctgtgacgtgtggtgaaggtcagagttagacaatccacagctggagtggaccagtgagtttttcaaacatgaatcacaagacatgaatgtctgataaaatcaatcattctttaaaaatggaactatatatcatgcctgtaatcccagcactttgggaggccgagacggtcaagaccatcctggctaacacggtgaaaccccgtctctactaaaaatacaaaaaaattagctgggcgtggtggtgggcgcctgtagtcccagctacttgggaggctgaggcaggagaatgccgtgaacccgggaggcagagcttgtagtgagctgagattctgccacagcactccagcctgggcaacagagcgagactccgtct

SEQ ID NO: 240479 - DNA, 500 bp, Homo sapiens
agctggctttcagtctcaaatgccacctctttagtcattcatgcttatctcaaggcatgaaattcactttcatataactccttcagcactctctgtgacccttctaatgttcttccttgtattcttgttaatgtgtcttgtttctccgtaggagatcataagttccaacatgacataaaaatattttatgcatctttgtattttctgcagtgtggagcacagtcctttttgtattgggtcacttagtacatattctagttgaaggcagtttgtcatgtgatatggtgtctagtggtatgatagtttacaggtcaccaagctattgctgatgtttctaggaacatttaagttttgatgtaagaaattaagttaaatttgtgttttgtttgtttgtttttttgagatggagtctcggctccagcctgggcaagagagcaagactgtctcaaaaagaaaaaaatgtttaatatgtatctacttgtggcagtagtctacttatt

SEQ ID NO: 240480 - DNA, 414 bp, Homo sapiens
tccccaatctttggtcagggtcaatatgtttaatttaattcattcaaacagttggtcagttcagccatcaccaccaccactaggtcgtcttgttggtcattgtttaactattatattagccaaggtaatgcaagctatcagcaaacaaattctccgtctaagtggcttaaatacattagaagtttatttcttgctaatataagttcaattggtaacagatccgggaatggtggattttctgctccactgtgggctcaggctgatggagttaccatgaggctcacaagcttgcctagctggcaaaggggattaggagaattgcttgagcccaggagggctcaagtggagattgcagtgagccaagatagctctactgcactctagcctgggtgacagaacaagactgtgtctcta

SEQ ID NO: 240481 - DNA, 240 bp, Homo sapiens
ccgtcacccccggagcccggcggcggcagcagcagcagcagcagcagcgcggggaggagacagcagccagccgcagtagccgccgcagccgcgggagcaatgcagacagcaccttgagaacgcgctaaagcactccaaaccgtggaccatgccgtgtccctgcaactgggaggggggaaaaccagattttttttgacataaaagcaagccagccaaaaatatataattttgtccttcaag

SEQ ID NO: 240482 - DNA, 487 bp, Homo sapiens
tatttcgtcatcctccccgctcctcaacagcgcagaagatgccgaaaagcaattacaggaccttacagagctgctccgggggccgcgggaaacttaccagcatcctggaaaagacaaaaccagtggggtgcacttggcctctcctggctgcagggtgtggccgcccccacctttcaccttcccatccttaggaagcaaagtgacccctaagcctagacaaagctctcgaaagcccaaagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgc

SEQ ID NO: 240483 - DNA, 682 bp, Homo sapiens
ccagccttctttccttccacctctccctcttggccatcttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctcctacaccatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctccgcctcccaggaggctgaggcaggagaatggcgtgaacccgggaggtggatcttgcagtgagccaagatcgcgctactgcactctagcctgggcgacagagcaaaactccgtctcaaaaaaaaaaaa

SEQ ID NO: 240484 - DNA, 491 bp, Homo sapiens
gagacctatcaataagcagtgaggggaatcactctccttcctcaagcagcaccagcaagaaccagtgggagcccgagaaacaccagacatgttaagtagtccaatgtaacaccacaaagtctctgaaaattaaactgccattggaaccatagcctaaaaaagttggccaagacttacgtatgtgataaatctaaacagggtgactgccacttaaaataaaagatttaaagaggaccccagagtctcttaacatactagacaaaatgttgaggatacagtagaaaattacccatcacaccaagaaccaaggaaatgacaactcgaatgagaaagaaaatcacctgacactgcactaagttcaatgttggaattatctgacaaggattttaaattatatttgatcattgaaacaaaaattataacacaatacttaaggtaatgatatttaagagtgaagaagatggcttcctaaacagaatgaagtttccata

SEQ ID NO: 240485 - DNA, 1774 bp, Homo sapiens
  misc_feature (1110)..(1110): n is a, c, g, or t
  misc_feature (1248)..(1248): n is a, c, g, or t
  misc_feature (1335)..(1335): n is a, c, g, or t
  misc_feature (1692)..(1692): n is a, c, g, or t
tgagacggagtctcgctctgtcgcccgggctggagtgcagtggcacgatctcaagtctgctttttcagtttcatctctacccacattattctcaatcctgaccacctcttcttacctcatttatggtggcttgtgggtacctaacactttctaaaggtgaaatcagagttcctttatttctctgggatccctattctcatgctttttgagctcagtttcaatttcatccagcaagagagcacatttttgtatgtgcagatggtgcaccttagattgctccccgtgcgtgtccactttttccccaccatttttttatatcccttgtccaaggaagatatcttatccacctggtattctccaaatttactcgtactgggaattgagaggtaatagtctccaggcatgtcagtgagaaggtctagtcaccatcccccaccacagcttaccattggcctctcaatttcctgtgaccaatgactgtctttccatcatcagaagcttaggggctggaaaaaggatgtcagagctcatcattcctactccagttaagatgcttaatgatcattagaaggtcatcattttttaactgcttccagtgaggttttattttgcatttctatttatatattttctttttacaatacatttaggggttacaaaggtagttttgatacatgatatattgcataatggtgaagtctgggcttttaatgtaaccatcccctgaatagcgtatattgtaccaattgagtaatttatcatccctcaccgccccctcttcctcctacccttctgagtctccagtgtctattattccacactctgtatccacgtgtacacattacttagctcccacttataagtgagaacatgtggtattttaactttctttttctgagttatttcacttaagataatggcctccagttccatccatgttgctgcaaaagatattgtcagttctaagtgtgagttgtactgaggataccatcctaaagtggagataggaagttacttgcctcttggcaatgtattaccctttgtagcgtactccagctcaggaatttctaccctaaaccgttaaatgacattcactgttgtctgttgttntgtgtcatagcgtagctatttcatagtaaaactgtggctaagagagattgtttgcaatagtgcttcagtaagataaaggattgagtcagggaaaaaatgaatactgtttaattcatggaagatagggaaacgtagaanactcatgaaaaataatagacaagacagattttaagaaggtagaagagaaggatgacatcaaacaaataaaatatgtagaataagacngaagtaataggcaagtttatgttgttttacttgaatacatttagtgccaacataaacagattgctttttttttaatgctgtgctgcaatggaggatgatcactttgcatccagcctatagttttgtggttgatccgctaagttccctgatcgatgtacttaagcttaatagaaatgccctgtaatccaagcactttgggaagctgaggtgggtggatcacctgaagtcaggagtttgagaccagcctggccaacatggtgaaaccccgtctctactaaaaatacaaaaaatcagccgggcgtggtggcaggcacctgtaatcccagctacttgggaggctgaggcagtagactctcntgaacccaggaagtggaggttgcagtcagccaaaatcacgccattgcactccagtctgggtgacaagagcaagactctgtct

SEQ ID NO: 240486 - DNA, 570 bp, Homo sapiens
tggggtatataagcagaagtggcattgctggatcatatggtaatcatgtttttaactttttgaggattaaattgaacattttgcgtaattaatagttgtacacttttcaaaactcaaaaagcacaaaaagaaaacagtcaaagcagtgtttttactacccctctccccagccatctagttcatctccagagaggaagctactgttgtcaggtctttatacatccttctaatctggagatattttattcttatacaggaaaatatgtatgtttatgtatttgtttttctaacaaatgcaagcctgttatataaactgttccacatcttttaaaatttaacatatcttggagattatttcatgtcagtacatagaaggttgcctctttctttttaatggctctattgtattttgttgtacggatatcccatagtaaattcaaccgttcttctatcagttagacagaatttccaatcttttgtttttcatgtattgatggagtaaatgtccttgtagcgatgtcattttgcacatgtctgagtatgtccgtaattaaattccttcaggtgaaa

SEQ ID NO: 240487 - DNA, 473 bp, Homo sapiens
agctccacctcctatcagatcagccatggcatcagattctcataggagcgcaaaccctattgtgaactgcacatgtgagggatccaggttgcgtgccccttatcagaatctaactaatacctgatgatctgaggtggaacagtttaatcccaaaaccatctccttgcaacctcgtccttggaaaagttgtcttccgtgaaacccgtccctggtgccaaaaaggttgggaaccactgcaataagatacaaccttacacccattaggatgggtactatccaaaacaaacaaatagacactcccctgcccccaaaataataagtgttagtgaggaagtggagaaattgaaactcttgtgtattgttagtgtgaatataaaatggagcagctactgtggaaaaaagtacttaagttcctaaaaaaaaaataaacagaattattatatgatccagtaatttcacttctaggtatatac

SEQ ID NO: 240488 - DNA, 1033 bp, Homo sapiens
atcttaaaaaaaaacaaacgtagggctgggcacggtggctcacgcctgtaatcccagcacttggaaggttgtgatccaccctcctcagcctcccaaagtgccgggattataggcgtgagccactgcagccagcctagaaaatgttttgttactagattgaacataaatctggagccaaggggttgggggggcctgcaaaacttgaagttaatttacttcagttacagcaaagtaataaggtttggctttcctttgaaaaatcctttggaaaacatcacagaatgagagcacattacaatcagggaagactacaggaataagattgacagccttattttaaaagctggaattaagtcttgccaacttgctcattaggtattttttttatacatgaaaatgaagtaatggggtgttttctttttttttgctttctgtcctaggctggagtgcagtgcattgcagcaggctcccccaggctcaagcagtcctcccacctcagcctcttgagtacctgggaccacaggtgctcaccaacacacctagcttgtttttaattttttataaagacaaggtcttgttacgttgcccaggttggtcttgaattcctggcctcaagcaatcctcccacctcagggctcccaaagtgatggggttacaggtgtgatccacttcacctagccagattgtaagatttttaatgtactttaataaacctttcattttcccagagcacagaaattctatggcaaaatggcttttcaccgtgtttcagtgacaaatctaagccttctaaggaaatgacactatggatccttcatttcgtgatcatcaacatttttcaattaagctctgcctttttaaatcaatcttattaaaaatgttcatgaccttctaaggcagtgtggacgcaaaagcttcctgtgtgtctacagttattttaggagctgaccatacatgatgagtgatacagcctgtactttgctcatctagagcagcactgtccaataaaatatgtgtgtatatgtatattggt

SEQ ID NO: 240489 - DNA, 453 bp, Homo sapiens
gaagtatcatctattctaatcaatattaatttactttactgagatgcaattatcatactaaaaaatgtatagaacatacatagattgtttgtgatttcatagttaaatacattcatattaccaccaccaaaaataaaatatagaataatatctcactaaagtttctttctggtcatcctccttaacctttattttttatttgtatcaccatacattaattttgtctgttcttgatttttcacaatggaatcatacagtatatattttgtttgtatgtgtgtctggtttattttgcttaacatgatatttttgtaatttatccaagtcattttgtccatgtatagtgtgaaaattctgtatgatcaccgtaatccttggaagtcccttaaacatgtcttaagccagcaaaagcagtggcaattgattcaggaattccagcttctccaccaacat

SEQ ID NO: 240490 - DNA, 284 bp, Homo sapiens
ccaggcacgatggtgtgtacctgtagtcccagctacttgggaggctgttgggatgattagtttgggactaggaggtcaaggctgcagtgagccattatcatgccactgtgatccagcatgggcaaggaagtgaaaccctgtctcaaaaaaaaaaaaaaaaaaaaaaaaaagaccctacaccctgtagaacagaaagcattgcagaggctgacaccactacttcagataaacagttggaaactctaagacagagtagagagtactccaggaagaaaaaaaaggga

SEQ ID NO: 240491 - DNA, 396 bp, Homo sapiens
ttcaggttcaatttatgtttgtctgagaaagtctctgtttctccttcacttttgaaagataattttctgccagctgagtttttaatccaagcttttattttgcaaatcagtgagacttcgtgctttcaagatactgaacactgcagcctaattactgcttctcccaaaccaaaactgctttcaaattttggaagggtaaatatttactctaaatcttcaacaatcccttcttttctattcattgactcaggtatgtgagccagataagtatatgtaatcttcagctgagtatcttattagtgatttcctcacagttcaagagatgctcaggcgctgttgttcatttgtttctgtccagtctcctcaatatcctcttaaaaaaacaattctttgctc

SEQ ID NO: 240492 - DNA, 371 bp, Homo sapiens
aaaatgcctcctctactaatctgcagtatattgcttagcaagtactgtctgtatgtgtcatcagtttctgttttgttttgtttcattttaagaacccactatttcatacttcaacgcatacctattttctctaattgccacaggcaaaggggaggtccctgacagaataaagaaggttattgtgacagatgaaacataattcacaatgagtactcttttcatccagctctaagtagcagaggattacttccaagctgaattttgtggcagaatgtatgagctgattttattaacacataaggatagggcaaaggcagaaaaactatttctcctcagctggatggtggttattttgtgtgtgtctgtttggg

SEQ ID NO: 240493 - DNA, 419 bp, Homo sapiens
tctattccctgtccatctggattttacaataagcagcaagatagattcatccaaaagagctcagttttttaaaagatattgagcaaagatgagcatgtacaaaaacatgaaaaaccatgctctgaggaaagactcatgcgttcattgaacaagtaagataattgagctgtagaaagaaatatggtgaaatacccttgcaaagaaattttgaaaaatgtcatgttgccttttatgttatcttgatgtagaaccaaaaccacaacaaaattgccagctttgcaagaaaagtcattatggctaggggaagaaaaaaagaacatacaagacaaaagcaatgttggtaaatgacaggaagcatgccaagttcttcagtcacatataaactacaatgaaataaaataaatcttacattaataaga

SEQ ID NO: 240494 - DNA, 440 bp, Homo sapiens
ttaaaaaagcagccatcctaaccagtcaaagaaaattaagaaatttaaataatgaacatgtatttcctgttttgattacttgactgatgaacagagattttaataaaatcatgagtaactgtattatttatcatgccttcagtgatgtatagtagacttcagaaatgtgttcaagtcatagagagtcagaaagtcattattctttaatagcaacacaataaatcctgaggtattaattattatcaattatcatgtgaattaacaaaatatataaaaaataaagtctttaaggtgtataggactatttaaataaatatgacatacaacatatatcacaacgaaaagcacatggttaaaaagtaaatacttcagtgaaataaaaatcttggctatttggaagttatttttttatgttattattgtttgtaagtcaaacaaat

SEQ ID NO: 240495 - DNA, 548 bp, Homo sapiens
cgagactccgtcagaaaaaagaaaaaaaaagaaaggacagcataacacttgacccagcactcaataaagcagaggtgcagaaaacaccctgtaatgtttcccctgtgcatcccgggtggtaagaatatcccacagatgaatatggccagggatgttttctaggaaccgaggcccaacctgctgtgattttcctcccacgaccaccagagtaccgagcgcagatccaacccagcctgaccccctttgggcaccgcagctgccttcccattgatcggcactgtaatggtaaatagctctctgcaggcctcctcactgggacctttagtggctctctgcttgcttctgtctgagaaaacaggaaagaaaatgcaagctgacgtggattcctcacttcattttgaaagaaatggctttccctaggcaagacaggaaagggaatgaggtttgctgaaggaatccagagaaataaatgttcatactcataaaaaattgagcatatgtagtcatactggactgacctcaaattcagtagcttacattgctttaga

SEQ ID NO: 240496 - DNA, 594 bp, Homo sapiens
ttttgtatttttagtagagacggggtttcaccgtgttagccaggatggtctcgatctcctgacctcatgatccgcccgcctcggcctcccaaagtactgggattacaggcgtgagccaccgcgcccagccagaaatagttttaaaaaaagaaataaggagcgtgcggcccgcgggggaagcgcctttaccagctcgagcctgcagccccccaggccgcgccgtcctcggctcccccgggcagcgccggggttttgtcaggcgcgcgctgctgtttgcctggattgcgctcattctgaccctgaagccagcggccccactgacacgccctgaaaagtgggagccacacgcgggatccggagaccgcgctaaagtcccacgcacgacggcgcccgccggcgagtccacgcccgcacgtcggcgcatgcgcgcggccaagccggtgcccgcgcccaccagcgcgcatgcgcgccccgtcccctccctccccccgtgctctgccccgatggttcggtccgcgccgggggcggggccaggggggatttctttagcccaagagtggaggctaagctacttacttccaagcctgggtgatc

SEQ ID NO: 240497 - DNA, 329 bp, Homo sapiens
ttgctgataccaataataatctttttattacagtcttaacaagagtcatgccagtcagtgaggttctaaggatgggagtggtgggagcagtccaggctgcaggaaggaacattttgtcactggcattgtttagaattgctggtgcatgcatgctggtaataaaaagcagaccaactttcagtgtcaggctgccctaacgaagtaccatggactgggtggcttaagcgatagacatttctttctcacagctgtggaggttggaagtcgaaggtcaaggtgttggcagggctggtttctcctgaggcccctcttcttggcttgtggatgcc

SEQ ID NO: 240498 - DNA, 307 bp, Homo sapiens
tgacgcagttggaaacattcagaatggaggagagaaagctaagggttcccaaggacattatctgcactttccaaactgaagaattagagcaggtgggtgagaatcataatcacctctttctcctcttcctcttcttttcatcctcgtccatctcctttttctatgtgttgttagtatgacacaatttacaatattacctactttattcataatgccccaagtctgaccttttctgaactaattctatttccaaattagatctcaatttaaaataaaacagcaatttaaaaaaattggtctagtccca

SEQ ID NO: 240499 - DNA, 391 bp, Homo sapiens
agtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaa

SEQ ID NO: 240500 - DNA, 599 bp, Homo sapiens
aaagaatatctgcagtacaaatacctggaaatggatttgcttggtaagctgatctgtgcacttaagattttgaaagacattgctaaattgccctcactagaggttatatgagtctgtatcctgtcagtgtataaaagttcctatttccccactccctgctagcagaatccttcatccaacttttctgtctttgccaatctgacaggacatgtagtatctcactacaatattaatttttatttcccttattgtaagtaaggttgattattttatatgcttaggagctagttgtatttccttttctgtgaattgattgctcataaactgattaaatctttgatattctggatggatcctgataaaaaaattttccttatttataagagctctttatgtattagggagaaaagccctgataaaaaattttccttatttataggagctctttgtgtattagggagttgttttagtctttgactttgcttatgatgtgtttttcttttatcatgcagaagctttgcactttatgtcgttgactttgtcagtcttttatgacttgtgtgtcttatgacatccttagactttcctcactccaagat

SEQ ID NO: 240501 - DNA, 472 bp, Homo sapiens
ccctcttgggtcttttggaagagtggacatcctaaaaaaaattttctttttggagacggagtattgcttttgttgcccaggctggagtgcactggcgcgatctcggctcactgcaacctccgcctcccagattcaagcgattctcctgcctcagactcccgagtatttgggattacaggcacccgccaccacgcccatctgatttttgtatttttagtagagacggggtttcaccatgttggtcaggctggtctcgaattcctgtcctcgtgatccgcccgcctcggcctcccaaagtgctgggattacaggcgtgagcgactgcgcccggccaaaaaaaaaaaaaaaattaatttgggattgcgtaatcaaaaagtcttttagacatctcaaatgcattgcaacttattcgaataaaaagggctcctgacacggacaaaaaggcagtataggttgaaaattagaatgctta

SEQ ID NO: 240502 - DNA, 370 bp, Homo sapiens
catctccgcgctcactaactggcctcaggcctgggaggattctctgagcctccataggctctgagcccatctaggggatagtgttaggagtgccaggtcgcgtacctcccaggatggctgagggtttccaatgagaaatacatggaaaagtatagagggctacaagtgtgtaagaattatgcttttacaattgaagagaattgcaagccactctttcctttatatactcccagcatcagttacaattgtttttagtattcatgtactgcttctgcctcaatcacatgaatacaaatagtacatcctgatagcctactctgttcacccaatggcaaaaaataaatacaaagaaagacagccaataaatcat

SEQ ID NO: 240503 - DNA, 507 bp, Homo sapiens
accatggaatgctgtatggcagtggaaataaatgaacagctacccctacaggcaaacaggaatcacagcaacagctgggagtgacggcgtgaagcagagggacaagaatgtgcactcatgcccggtctgcctggcttacaatcctggctctctgcttgccagctagaactatcatgcaaatcatttaaccactcggtgcctcagttccctcatatgtaaaatggacatggtaacagtgtgtatcccacaggccattatgaggatttaaatgatttaaaggattgtgggctgggcacagtggctcaagcctgtaatcccagcactttgggaggccgaggtgggtggatcacctgaggtcaggagttcaagaccagcctggctaacatggtgaaacctcgtctctactaaaaaatacaaaaaattacctgggtggcgggcacctgtaatcccagctactcgggaggctgaggcaggagaatcgcttcaatctgggaggtggaggttgca

SEQ ID NO: 240504 - DNA, 446 bp, Homo sapiens
cttaataattctgaaatttcctgattttataaattttatatgcatctatgatataggttacttgaagaccaaatgcaaaactttaaagttttgtactgttaaataggaatactaggcacatcactcatctaattttaaattgtaaagtaactacatttttaaaaattttaaatttaattttaatgtctttgacttaatatattcaaaatattatattaacatatagctctaagttattaatgaaatattttacattctattttttgtattcagattgaaattccaggtatattttatatctgtagaacatctcaatttttgtttggacacattttaagttctcagtagccatatatgtggctagtggcgactgcgttggctggcatagttttggacttagatagcaacttgccagcatttcactacacagaaaattgctttaaaga

SEQ ID NO: 240505 - DNA, 287 bp, Homo sapiens
agggagccatagtgtcccagtgtggaggcagaaaggtagaaaggggtcattggagtagcttagagtaatcttgtgagctttaggcttaaatcagctgactgagcagggtcttctcttccactgttcaggatgaggctatgcctggggtcaaaaagaaaaagcctccaactattttacattggcagctatgaggatggaaaaaatagtagtgatggtgtttgttttttcattaacaggttaacctgaccattgtgggaatgtcattaaatatttttctaagatataat

SEQ ID NO: 240506 - DNA, 128 bp, Homo sapiens
tattttttagaacagatttaggttcacaacaaaattgagcagaaagcacagagatttcccatattcactcaacccacacacaaaattggcacgatcattgttcactgcagtcttgaccttccaggctc

SEQ ID NO: 240507 - DNA, 232 bp, Homo sapiens
ttttatagtggtctttatcatattttaagaatggaagcgagagacaagaacaggatatgctatccaggttcttaatttatcaccaactaggattgcaatagaatctattatctgccagtaaaaccaatgtttttagaagtcaaaaacaggtggaccactagaagtctccctttgtgaaagtggtagaaattgcccctgattcaagtcagctaatactagtaagacttttaga

SEQ ID NO: 240508 - DNA, 413 bp, Homo sapiens
aaaatgtgctataaaatttcttaacctcttgtttacaaggtacatatatatatatatatatatatatatatatatatatatatgtgagtttatggtttgaaaaaatatttcactgcactattagaaagagtctattcctgtgacttcttggagttgggatgtaggggaagcaaatttaattttgtctttacaagtaaaattcatgcataaaatacaaattaaagttaaattacggattgccaagtttgcagaagtaagtgaatctttctttcttaaggccttttctgtggccctttctgataaggaaactcagaagttctgttttcagtttgttattaggcagttataaaattacagtgaaatttttaaaatattgatactaaaggcaaggcatggcagaaaatatcttaaag

SEQ ID NO: 240509 - DNA, 389 bp, Homo sapiens
gctgcacaaaacctttcacttacaggccagaaaatagaaaaccgcctcttatagaacctccactgcttttaccactataatgagatctccagtgtatctacgactccctccactctggaagggacagcgctccatcgcttacagctccctccatctaactccacgcttacagctccccccatctaactccacactggctactacgtctcccccttttcccacgtaccaacattgcgcgagccgcctctgagcaggaccccttcttcccttgggtttagtattatcctctctattgggattagcagggacagctacgggagacagagccttgggaatccagcataaactgtcttgggagactgaatggccctccagcaaacggcagaggg

SEQ ID NO: 240510 - DNA, 474 bp, Homo sapiens
tcagaaattccaacatctattaaagaaaaaggtaaaatgtattttaaatcaataataaatgtacagaatattaaaatcataagaatgcacagtgatgcatgcctctaatccaaactacttggaaggatgaggcaggaggatcacttgaggagcccagaagtttgagaccagcttgggaaacatagtaagactctaccttcgtaaaaaaattgtgcacacttgtgtgtatgctttagatcctgttttttgttgttgttgttttggtttggtttggttttttaaagcataagactgacgttttgttacaaagcattcctttgggagcatgcctgggaacttattagaattaacattcattataagtattggtaggtaattaatgcagtaagaactcttccctctgtatttattagatgcaaagaagaataaatttattaaaatttggtatctacaagtgaactgaagtatacaagt

SEQ ID NO: 240511 - DNA, 368 bp, Homo sapiens
atgtataaagtgtttaatgcgtaccaaatgagtgtctagtcactcatctcctgtttgagtatttatgtgtcttattattctgagttagggcatccttttacctcctgtgtctctttttctttatgcccaagttccatcggcagatactgaccatagagctttgcaatgtagacagttttgcctaaaggctaagacaggggctcagttccacttcactgacacttagtgacattacgcgggctttggaatttaggaagtgaccaatatgttgactttggtttgttatttcagaatgagaaccctaaaggccacccaacagttcaccacagagaaacttgtttccagccacataggagttgacaagctgc

SEQ ID NO: 240512 - DNA, 295 bp, Homo sapiens
agaatggtcctgtactcgagtttgagttttaaactaggaaaatgactaataattgaaaataatgggaactctgtggaattttctttgtatgtcatcatgaaattgctgtgtaacaaacaaccaagatccaaaatagcaagactgggagagtttgtgtgctgcaggaagagaccaacaagaaacagaagatcagtcagtgcatgggtagatgacatctgtgcatcccattgtgtgaaaaataatctgctgattttgccctttgttctaaaataaattcattacataggccatatca

SEQ ID NO: 240513 - DNA, 404 bp, Homo sapiens
agaatggtcctgtactcgagtttgagttttaaactaggaaaatgactaataattgaaaataatgggaactctgtggaattttctttgtatgtcatcatgaaattgctgtgtaacaaacaaccaagatccaaaatagcaagactgggaggtacgactgcagaaaaaaattcatcccatgataagaaccaatgggttgaaactgtccaataaacgttgcttaatgaagcccaggagcgattataaacatccaatgaatgagtttgtgtgctgcaggaagagaccaacaagaaacagaagatcagtcagtgcatgggtagatgacatctgtgcatcccattgtgtgaaaaataatctgctgattttgccctttgttctaaaataaattcattacataggccatatca

SEQ ID NO: 240514 - DNA, 626 bp, Homo sapiens
gtctcaaaattcctctgcctctttcttatacatgtgattccattcagggccaggataagctcctcctctgaagatccttaacttaataaaattattttgccatatgaggtaatgaaatggaaaagtgctccaaagctcaaatctctaggggaggatacagatgggcaggctgtggggctccgactcccatggcagtgtctaggggtgaatgtttacagctgaagtcccagtgggcgtgtgttacagggtgctcttttagtttgccgtctataggtgacttgtattaaccagctcaattagaccccttccttatcacaaggacagagggatttctgtatcccaggtttttgccttgctgtactggaagaattggatcacacatgggcttggagaatgagtgcaaggttttattgagtagaagtagctctcagcaggtgggggagccagagggagatgattttcctctggagtcccaccactcagtggccctgggtctccgactgccccggccaaactccgcctcttcccatgtctgtcagtgtgctcttccactggcattctccctccacgtcctctcgctgtccagctgcttgtatctttatccgctgatgtgctcctctccacgt

SEQ ID NO: 240515 - DNA, 371 bp, Homo sapiens
ggattaataatggatgcagaaaaaaaaagcacttgacaaaattcaacacccaatcatgatataattaagaataaaacaaacttcctcaacctgataaagggcatataccatgaatctacagttgatatcacattaaatattgaaagactgcatcatttccctgtagtatcagtagcaaagcaaggattacctctctcaacacatctatttagcattgaaatataggctctggaggtctgatgtcttgtcagatacatttgcccttctgccaaagacctatgatctaaagattaaaattatctgcttcatattcacattctacaacaaaggtacagacatagcaactgcagggcatttttctttgaaaatgg

SEQ ID NO: 240516 - DNA, 169 bp, Homo sapiens
gaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggt

SEQ ID NO: 240517 - DNA, 327 bp, Homo sapiens
tgatagccttttgcatttcaggtttcttgaagtatctctgcttgtttgcttctgtttcaaagatcataacaggcagcaggccccattgtgggggaaagtggtagcaaatggatctgtgatagcaggtgtcatcctcatcatctctttacagtaatcgaattggttgaagatacatggaaatccaactagatacacttgtaaaaatatcacctgccagtgcagtggctcacacttataattccagtacattgggaggctgaggtgggaagattgcttgaggccaggagttcaagaccagcctgggcaatgtagcaagactccatctct

SEQ ID NO: 240518 - DNA, 492 bp, Homo sapiens
gatagtgaacatactgcttttgcctgtgttggcactagactaaaataaaaaccttttcctttatgttttcccagattccaaaccaacttggcctaacctttcaagtctctaagaaatttatagttttatatctattaaaaaaatcttctggtagacttcataaatatgacttagatttttattaaacttttttgctcgtatctttctgtatctcagaaaacctttaatttttgagacagtagctatttgtgtaggctgtcttatatgttcacagatggcattattttatcagtcctcaaaccatctgtagcatcaacttagtctattccaattggtgtcatctttcatttatgcaggagtgagttattaaagtaaaactttatatttgtataacattttgggtaaatgttagagtaaaacattggtttattttatcacaacaatcctttgcaaagaaaatttattttttccagctcatcttgatttacttta

SEQ ID NO: 240519 - DNA, 447 bp, Homo sapiens
tttgctaagataaacctgataacctattttcccactcatcacaggacagtgaatacaggcattctaaatgctacctctcaaacagccaccaggagtgcaaactgcctccactcacgtcacagacgtgatcctgccggtcatcctttactctttagaaagtgagatctggttgttttaaaagtaggaaggttctattatggcacttctgcagtaaacccacctataaggcacatcgatttcttgtcctgtgaatttattcccgtacaaatctatatcctttatatcctgggttgtcctaacacaaggacgacctgtgtttccagtgacacgtgcccatccccgtccagcgggtgggaagagactggaggagagggactaagtgagtcttgcatggtggagagacgaaacctgtccagcagggaatagagcctttggtgtctaaaatac

SEQ ID NO: 240520 - DNA, 410 bp, Homo sapiens
aatgacttgctctagagcatgcattttatatgcaaaccaaataaccccaagttcatactcctgcttgtttccttttatctgctacgatatccttttgccctaaacaccgcaaagctgggtgctggacaactagggactacccctagagcctagagcccatccaaactcttcaaactatccaatcctaaacctgcttagcttgcttaccttgtttcaattgttccttcctgcaaaaaccacaataaagtcacttgtccacagttcctctctctctctctctctttctctcttttcctctctctctgcctgctcatctcacctgggcattttcctgtgtgatcctgcatgacataccatccctcttgttcttaggagactgtgagtataataaaaacttctttcttcatgga

SEQ ID NO: 240521 - DNA, 469 bp, Homo sapiens
acagctcatttatttctcagatagtcctatgaaacaaacattgccaatgccaatttcacaggtgagaaaatggaagcttggaggagtgaaggaagttgcccaaggccctatagctagtggatggccgggctgggactccatcgccaggcctgcagtcctttcacttctgccacgctccctggggagtgaaggcagagggaggcgttttcatgtccaagggccctgtggaggactcaccataggagggtctcaggggccatctactatcatcttttgaagcctgccaagtgccaggcatgcaggtgtggggacagggttatgaaccaatatggacagagtccatggagtagtagaagacatagaatcagcaagtatatgtgggtcatggggcggtaggtaccatgaaaacattaagtagggtaaggatgatggtgctatgtttacagaaagtcaaggaaattggaatggc

SEQ ID NO: 240522 - DNA, 415 bp, Homo sapiens
acagctcatttatttctcagatagtcctatgaaacaaacattgccaatgccaatttcacaggtgagaaaatggaagcttggaggagtgaaggaagttgcccaaggccctatagctagtggatggccgggctgggactccatcgccaggcctgcacatgtccaagggccctgtggaggactcaccataggagggtctcaggggccatctactatcatcttttgaagcctgccaagtgccaggcatgcaggtgtggggacagggttatgaaccaatatggacagagtccatggagtagtagaagacatagaatcagcaagtatatgtgggtcatggggcggtaggtaccatgaaaacattaagtagggtaaggatgatggtgctatgtttacagaaagtcaaggaaattggaatggc

SEQ ID NO: 240523 - DNA, 2615 bp, Homo sapiens
  misc_feature (596)..(596): n is a, c, g, or t
  misc_feature (637)..(637): n is a, c, g, or t
  misc_feature (2234)..(2234): n is a, c, g, or t
gttttcagtaacattcccacagtgcttgccacagagccctgcttaaagaaagcaccagttcctggcctgcagacccactaaatgaagatgatagtggtacctcttcccctgcccaacaccacgccctctggcacaaggtggatggccactggcagtgatggggatggagtaagtgctatgagactaggagaggaacaccccaggaacacctgaggtcacagagtgaatgaaggcaggtaaaggagcaaagggaatgggggcccccacatacgtgaccccagggcagcagcttggcctgcaccgagtcctccatcacacacactcccccgccccacccccgcatcctggctgtctaaccacaatccctgctgccttcagttaatcaaccaatgagtggtcattcattgcacatctgttctgggcctcatgggggcagcgggaggtgatgaagaagcaagggttctacaaagaggtcaaagctacgtgaggagccggggaatggcttgcttttttttttttttttttttagacgggctctcactctgtcacccaggctggagtgcagtggcatgatcattgctcactgcagcgatgtntcatgggctcaagggatcctgccatctcagcttcccaaggngctgggaccaaaagtgtgtgccaccatggcctgctatttttttttttatttcttggagagatgggctcaagcatctacacacctcagcctcctaaagtgctgggattatagctgtgagccgttgcacctggccaggatggctttttttgaaagtgaggacacgaaagttcagaaaggggaagaaactggctgtggtcctgcagcaagctggcagccgtccctcacctagccctgcgcttcagaaccttactcacagatcatcttacaaatgcctctttgctactttgtgagggaggcaggaattactcttcacccttatcagatgagaaaaccaaggcccagtgaggtagctgaggctgtctaaggttacatgggagtcaggaagggtcaagactaaacccaggtccacgtggttccagcctggcttcatccctgtttgcagaccccccaatcccaacccgccactggccagagcctggcccagctcttaggccaatgtcttattccaaaattaaatggcagcagcagaggaagggatagattggggggtagctgcccccagatgccaggacctatgccctggagaaacccttgggctggggatagctgtgacatgtacacacataccttgggccccttgtctcacccactctgagccaactcaggacccagtgggggctcactccactaatttggagcctgggctctgcctccacttctctctgccctgggaactccatctgcctccagggcctcctgaagacacgcaggggagagttcagtatttctcccttcctgtctccagtgtctgcaacagcaaatcctatcattgccgctccaaatttttctcaaagaggaagccttctttcttgctgaaatagaaactaaaccaagctacataatacagtttgagaacagcctggccaacgtgatgaaaccccatctgtactaaaaatacaaaaattagccgggtgtggtggcgcgtgcctgtagtctcagctactccagagcctgaggcaggagaatcgcttgaacccgcgaggcggaggttgtcgtgagcctagatcatgccactgcactccagcctgggcgacagagcgagactccatctcaaaaaaaaaaaaaaaatgatgaggtcatactacagtgtgtgaacccctaatcctataggactgttcgcctttgaaaaggggaaatttagacacagaaacagccatgcaaagagggaagatgatgtgaagaggcacagctcagacacccatcttcaaggcaaggagagaggcctggaacagatcagaaggaatcaacctgccaactccttcatttcagactgctagccacaggaactgttgtttaaaccacccagtctgtgattctttgttatggcagccctagcaaactaaccagcaatgccatcttcatctgattctctttaaatactccaagcaggagaccagttaccatttaagtccaactaccccaagaatatcagactggggaggccacatgtaggtacaatggtcaacagccccggctgaactcaacagccagcactagcatgcgaatgagccttctcaggcatcagcccagtggatcnttaaccacaaccctgccaacctctgatagtatccgcatgtgagactcaaagcaagaactgccagggggagcacttcctgatcctgacccacaaaatcctgagtgatgtacaatggttgcttgaagctgccaagttttagggtaacttattatacaacatagtaaccagagtgcttaccttccccttccctcccttgccactggccggaacacagatgaggccatggtgggctgtcttcagtcctgtaaatgacatagatgagggcatggggaagccacaaacgaggagcctgggctcttggatgccctcatggagcacaactgccaactccccacgtgccactcacatttcatgcaagagaaataaatttccatcttgttt

SEQ ID NO: 240524 - DNA, 429 bp, Homo sapiens
aatatagaaagacaatcatgatcaagtggactttatcccagggttgcaaggctgttttaacattccgaaaatcactcagtataattcatcatattaaaatagtacaaataaggctgggtgcggtggctcatgcctgtaatcccagcagtttgggagactgaggcaggcagatcacctgaggtcaggagttcgagaccagcctggccaacatggcaaaaccccctcttgactaaaaatacaaaaattagccgggcgtggtggtgtgtgcctgtaatcccagctacttaggaggcagagacgggagaattgcatgaacccaggaggcagagtttgcagtgagccaagccactgcacgccagcctggacaacagaacaagactctgtctcaaaaacataaataaataaataaaaataaaaataaaatagtac

SEQ ID NO: 240525 - DNA, 689 bp, Homo sapiens
aagttgtcaaaagagtataagttcagtgttctgcaagccaaaataattgtttcaacaagcaatgaaaactcaacactgttataaatatagagtccagttagatgtgggctgcacaacaccaactgggttgagaaattaaattgtttagaaattaaatcattgttactctaacaagaagattggaggtagcattcagattctggtgaattgcattttgaaatgggataagatgtaagtttttaatactagcaatgtacactactctttttttttaaagtttgcatgaagagaggtagagtgattaatagctatatagatccatatgattaaggaagcattttagaaaacctttccaaataaatgtctggagacagacttttaaatcaaattaatagcgtctacttagcaacagcatcacctacattacttccaacttaaagaaaaaaatgtttgtggcatacctggggagctcaccagatccctgaaatgtagatattattcacatttgatggatcagaaaactgaagctcccatgatttgggcaatttaaacaagatctgaaggtcagttaagcagcagaggtgaaacataaacccatttctgcctatattagttgtaagttcttgttctcatgcacatgttatcatatatgacaatgtttcttaaatttaagacagcattaccacttc

SEQ ID NO: 240526 - DNA, 578 bp, Homo sapiens
tttagaggttcaccattcctcctttgcaattcttatgtccagtgagctccttcaaggaaaaggtttcccccccccccaggcttgttccaacccccccaaaacaaaaaaagaaacatgtaggtccaataaagaaaggagtgtcatggagctctcatgggtacaggctggaagctccaggcctggcgtgctggagtcacgagatgagctgtccaggcagcatggcatcgtgagtgaactccgaccgtggcaggtgaggcttctgcacttagctggctgtcttcatgtgggccgattctgtggttagtgattctgatttctcatctgaaaagtggtgcatcacttagcccctcccacacttggagggttctactagtgtgcctgcgtggctgggttctgcacactcagctactttagtttctttagtctatccttaaaaagattcctaggtgtgttcctgattttgaggttccgtttggtcattatgctctttcagagttcatcttttgcaggtcaacaaattgggactctgaatgtgagtgtgtgtgtccacacaccactagggcttattaccttattgt

SEQ ID NO: 240527 - DNA, 485 bp, Homo sapiens
cctccgtggggactgcaggtctgggtcctctgtgtgccccggggccaggccaaaaccaggctggaacccgccggcagggcccccgaggcgcctctgcctgctctctccgttcttgccggcggcagcgattcggactcccgctttcgacaaagtctcagctccgcagcagcacccggcgcggactcgctgggcgcgcggactgagctccgggtggaaccaggaccctcgcgccctcgccctcgccctcgccctcgcccgagctggaccaccgcgagcaccgccgacgccagccgcagagccgcgggtgcgcggggaagaggaaacgaaagcgcgggctccggagctgaggtgagaagtgagcagaaagtgaaaagagaatccatcggaaacagataaaaaaggaaaaacaaaacccactcgaaaagaaagaaaacgttacaacaaaaaggataaagtaacgctaaatgaaataaaaaggagccata

SEQ ID NO: 240528 - DNA, 515 bp, Homo sapiens
tccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcact

SEQ ID NO: 240529 - DNA, 177 bp, Homo sapiens
atgttgcccagactggtctcaaactcctgacctcaggtgatccgcccacctcggcctcccaaagtgctgggattacaggcgggagcgcccagcccaggttcagattttaatggtaactttgttaagtatagggtaggaaaaaagagagatcaaacatagcttccaaagtattagaaa

SEQ ID NO: 240530 - DNA, 369 bp, Homo sapiens
ttgcccgggtgtgagctatagtctgctcaagccgtgcttgttacagggaactgcgacccactgcgctgccttgagtgaaggggtgttgctgattgtcaaagatgacaaacaggcagcctcaaggctgtggaatgggcttttggaggctggagctggatgagcagggagcccttctcctgggccccgtcagcctactcacttttcataaggtccaacttagcggccactgtcttttccccctgtttggtttcagtctccattcctgactatggatttctatgtgtctcaatgttctcaaaagagaaagcatttctaatgcccttgaatcagcctatggatgggagagtcacttgctcacctctcatccat

SEQ ID NO: 240531 - DNA, 330 bp, Homo sapiens
atccattgttcttagctatcacacaagaaatgtcaaacgtcagggaagtctgaagcacctgtgcttttgtttccctttttgtggatttgagtgggaagaatggcccacaaataatggggtaagaggcacgtcctagaggattggaacctgactgtatttgggagagggttgcttatttgatgactactgtaagactctacttttacacatagaggggccaaatatctgtctgattcactcttacagccccactgtctaatacagtgcaatgtgcaaataatatttttgaatgaaatattgaatatcaaataaactagatgagtgataata

SEQ ID NO: 240532 - DNA, 585 bp, Homo sapiens
  misc_feature (381)..(381): n is a, c, g, or t
  misc_feature (394)..(394): n is a, c, g, or t
  misc_feature (429)..(429): n is a, c, g, or t
  misc_feature (443)..(443): n is a, c, g, or t
  misc_feature (470)..(470): n is a, c, g, or t
  misc_feature (475)..(475): n is a, c, g, or t
  misc_feature (489)..(489): n is a, c, g, or t
  misc_feature (491)..(491): n is a, c, g, or t
  misc_feature (499)..(499): n is a, c, g, or t
  misc_feature (557)..(557): n is a, c, g, or t
  misc_feature (559)..(559): n is a, c, g, or t
ggattcaaacctctctagtctgatgaaccccaagttgcctctacacctgattcccccatccccacttgtcggacctcagagacctgctgccccttgaatcctgtcatccataggcccctaaaaccccaaggttccagcctctggaattctggtcccaaggatcccagcccaagcccccagcaatcctcagaattacccctttatcttagggtgggatccctaccatttggaactcattgtaggaccacccagggtggggcacagtggctcatgccttgtaatcccagcactttgggaggccaagggaggaggatcgcttaaggccaggagtttgagaccagcctgggcaatgtagtgagaccgtctctaaaaaaaaaactncggaggggggggncccggtacccaattttggcctataaggttgagtcngtattacaaatttnactttggccgtaggttttacaaacggncggtnacttgggaaaaccntngggggtancccaacttaaattggcctttcaaggaaaattccccctttttgccaacttgggtaaatnangggaagaggccctgaaccgatttgcc

SEQ ID NO: 240533 - DNA, 687 bp, Homo sapiens
gattaaagttttgtgaagaatgtttctggcctgctttacttttgccttagttacttggaaggggagaccttaatttgttagcagtttgtgctcatttaaaatatcttgtgccaaacctagggaggccttcttttcattgtactggtggggcatcggtgaagttaaataactcgtctgctcacactgctggggtaaggatgaagctagggtgggacaggtgctttgactgcagagccacatccttaatccctgtgcgggctgcctctgcaaagcccaccagctggcaaactcaaagtggcctctaacgtccagcccaagaaccaccttttggaagcttttcctcacacttgtccttgcccagtaaaaatctttgatgtacttcttgtaacttctgacagaaactgtgggctgtaaaggctgtacttacagtcatttgacactaggtggcatctgtttctagaaccgtgaatggctgtttgagtcctagagaaaacagtaacaaagaaagcatccttgattttatttctaggcactgctaggtaagcagatggatcaaatgtggagagatgggggaagcaggcattttttgttttcttctggaagtttttttgaggactttccctcaacaaccccatcagtgaaaacctttgtttaaaataactactgagatgaagacatgaagtcttt

SEQ ID NO: 240534 - DNA, 1751 bp, Homo sapiens
  misc_feature (135)..(135): n is a, c, g, or t
  misc_feature (186)..(186): n is a, c, g, or t
  misc_feature (247)..(247): n is a, c, g, or t
  misc_feature (532)..(532): n is a, c, g, or t
  misc_feature (890)..(890): n is a, c, g, or t
  misc_feature (1301)..(1301): n is a, c, g, or t
  misc_feature (1520)..(1520): n is a, c, g, or t
atacagtaaactgcaaaagtattttccaaggtgagaggtttaggttctgtaagaagaaagcaagagcaaaacaggaagagtgtattggggtgttacagtggctgggggctggaggtgaagaatcctgatgtagangggaatttcccaccagcctcaaaggataaatggcacaaagtgactctctcntcttggaggccaattgaggagggtcaaagaagagaggtgggaatggagtccacctgcttgntacaaaaataagtgtaaacgtagtaatgcactttattttagcagttacagtcaaaggaggaaaacataaacaaaacagggcttgagttagacagtgatgcttgtacatgtcttttgggtgcaagaaaattctctataagcctgagactttggcaaagcctgagcactgtctcagggggatacttttgtagtgtcctggtagtggctagcagctgggctgtgctacattaagaagtctttgtgaagaacagattttaatgatgaaagacaagtttcactaactgcncatacttagaatgataagaataattgttaaagtgctttgcaaaaatgagaaacatgatttaagcattttgttagtgatgatgatgatgatatcagataaaaacatattaagaatatttaaatctaaaattacaaaacgaaaacataaatatgtttaaagctcaaatgtccaatagcttgcattatctgtactggtgtttccaagtagtaacaagaaattatgtatattataaataaggttgaaatactggcaaattgttagtcttatatcaatgtattaatagaataaaaaagatcacggtagttctatttatcaaaagtgttttcttaaaatgcataaaaatcttagtagaagctangttattaaacaaaattggagaaaaatagttatattcaaaagatttatacattttggagatgatcccagttatgatgtgattgacaaaggactttttttttcatttttgtttaataaaaattgattgcacttattacagcgtcatgcatcattctattactggagctaggagacatttcttccttattcctatttgcagtcacttttagccttcaaaaacacattggcttgaaattcatcatcattgttctcctgattcgtaaatgagaattttcattgaaaatttggtgaaattccattctccattttttgagttactggagcattaaaattagatatttttcacctgcatgtcgttttaggtacaatttggagtatttttctggtgaaggtcattgaagaaaactttggngtgagcatattcctgaaagtagaaaactattttgaaaaattttatataaaatttttggtatttactttggatattatagtggaaacaaaatttaaaaaacactctaaaactacaatttctgtttattcttaatttatagtatttattcaattctcttttctaattcttatcgttgtactcacatctttctggggacactgacatgtcttttcctacatnagattcagtacaaaaatacactgtattttcattataatctaaaagagtaagtgtttccatattgtaatgcatatcaattaaggtattttaaagattatattctatgttaaaaataaatgtgtgtgtaattttttgtaacttttatcatgacttaattccttgaaaaaaacaaaaataatgatttcatctggatttcatgcctagttacatgacccagtagatttgactcag

SEQ ID NO: 240535 - DNA, 359 bp, Homo sapiens
cgggattgtattgaggattaaatgagatcatgaaggttagaaacctggcacaaggttggcattcaaaaatggagcttgttggctgggcgcggtggctcactcacgcctctgatcccagcactttgggaggccaaggtgggcagatcacctaaagtcaggagtttgaaacgagcctggccaatatgatgaaaccccgtctctactaaaaatacaagaattagctgggcgcagtgggatgtgtctgtaatcccagctactgaggcaggagaattgcttgaacttgagaggtggagtttgcagcaaaccaagattgcaccactacactccagcctgggcgaacaggacaaggctccatctca

SEQ ID NO: 240536 - DNA, 844 bp, Homo sapiens
cttttatccattttaagttaaattttgtatatggtgttgggtaagggtccaacttcatctttttgaatgtgaatgtccaattttcccaagcaccatttgttgaaaagactgtcctttccccattgcatgactgtggcaccattgtcaatagcattttaccatatatgcaagggattatttctgggctgtttattctgttggtctgtatgtctgatttgccaataccacgctatagctttgtagcaagttttcaaatcaggaaggtatgtgtcctccaactttgttctttttttcaagctgcttttgactattcagggtcctttgagattccatatgaattttaggatggatttttttatttctgaaaaaaagaagtcatttggattttgataggggattttattgaatgtacagaatcaataaaatccatattgatcaatacagattcaatatctgtatcaatctggggtagtgtggtcatcttaacaatattaagtcttccaatccatgaatgtggatatctttgtgttttctttgatttctttcagcagtgttttgtggttttcagtgtacgagtcttttgccttcttgattaattcctaagtattttttattctttgtgatgctattgtaaatggaattgttatcttaattttctttttatattgtttattcttagtatatagaaatggaactattttgtgttgactttgtatgctgctactttcctgaattcacttactctggcagggtttttcgttgtggaatatttagtgttttcttcgtaaaagatcttagcttctgaaaacagataagttttcttcttcccaatttgggtatcttt

SEQ ID NO: 240537 - DNA, 426 bp, Homo sapiens
ctcattgtgcaacaagtcactctgtagacggagccccttctgttcccagcagcgggccagatgcaagttttgtggtctccacctgctctcagcctgcaggccagctggacagaaaacagtttctcacctgcagttcaacaggcccacccacagtagcccaccttcccatggaaagtccctgcaagcagagctcagtggcctcgccaggaaccccagctctgagggcgcttctcctctctggctcagtgcttcctctgagacggggataagtccgcccaccgcatagggcagctgtgaagatcgaatgggaaaggcacaggggctctgagcacagggcctggcagccgacgccgggtaaaggcgggctcctgtgatcatcagtgctagtagaaatactgctattccagggtagatgctgcagctttt

SEQ ID NO: 240538 - DNA, 313 bp, Homo sapiens
cagagagggggctaagggtcgggcttgatgacggtgtgtgaccactcatgggacagagtggtctttaactggagggaaaatgctcgtgccttgatgtgaagtgggaaaagaccaatacaaagacatggtggtatcactgcaagcaaaagactgcttacagacaagaggaaagactggaaggaaacacccagaatggccagtggtcagctttgggacatgagtatgactgatttaatgtattcctttataatttagaaaatgttctgtggtgggcttttgacaattgttgaataaaggttgtataacaaaagtg

SEQ ID NO: 240539 - DNA, 358 bp, Homo sapiens
aggagggtttcaaaccaaaagatcccctggttaaccttcagctaattataagatttaattaactagaaaaactcaatccttgtttattctatttaattgagattttaccatatttaaaatgatgttactcaagtgttctcattaatatttaatgaaagtgtgagagaattggctaaccaaatttactgtgcttaggtaaactgtaattaggaagggttagcagagcatcccaagggacctatcaatcacaaaatgaagcgatacaattacagatgaatttcaacaaggaaacacacaaaacagtgatcctcaaaaaagatggaataaaattacttgaatgtggtagtcggttctgaga

SEQ ID NO: 240540 - DNA, 762 bp, Homo sapiens
gcaatccacccacctcagcctcccaaagtgctgggattacaggcatgagccaccacgccagcatcatgtataataggaatttagtagaacgtaaagatggcaccacaagtcgaaggagaaagggcatacaggctcgttggatgaagctgaacaaaactgagtccatccctaactccaggtacaagtgtagaattcaggcagactaaagatttaaatgagactggtaaaattagaaagtaaccaagaaaacaaaagattatctctgtggcttggtgcagcagcacttcgggaagatgaggcaggaggatggcttggactttgataccagcctgagcagcatagtgagatcccacctctacacaaaattacaaaattagctgagtgtagtggtgtgttcctgtagtaccagctactcgggaagctgaggtggaagaattgcttgagtttgtgaggtcaaggctgcactccagcctaggtgatagagcaaaaccctgtctcaaaaaaaaaaacataataaaagattatctttgtgaattaggtatctaagggaaggactaaacaaaaccttaaaggcaaacattgtaggcaaaaagttgatgaacttgtttaaatctaatttaaggattttgtgctattaatgacatcatagacatggttaatacacagataatttactgggagaaaacattttcaatgtttaaaattctcaaggaatgtacagggaattcctgcaaatcaagaagaaaaagaacaaccccagta

SEQ ID NO: 240541 - DNA, 447 bp, Homo sapiens
tttttggttggtattgaatgttgctgtgttatgttccagcctttgagtcatcagaactggaataaaagccttactaactagacatcatacatttttgtcccgtgtaataaatagcatgttactatctgggagctgaggtgagttttctttaaaaaataattttattctgattacccttgccttagaattctgaaaagattaaaatagctcttatctgaggaacttggattctgagcatttaaactggaaaaatgttctagtcagttatcgacaggctgatgactaacatgtggacataatcattaccaaagagtgtgctaacttgttgacagcatgtacttttaaaaatgtataaccgctataggaaatgttggcagataaataattaccttgagagatttcagtattgacttttaaattaataaaagttacgtttattttcttaag

SEQ ID NO: 240542 - DNA, 401 bp, Homo sapiens
gctatagactctccaaggatttctttcaatctgataaatgagctattttcctttagcaatctgaatttggataagaaagcttacaggatctagaatccactattattgtcagtcccataagcctgtaacccttggacactgagaaatgctattaacagcacttgccatttgagtgacattcaggtaccatgtactgcacagagtgattctatcatttaacttcttaaagtttcaagtcatccaaaagaaatatgctccacctactgaagttgcagtatttaacaaatgacaattttctgcctgtcttgccccaggagcaccaaatatttgaatgcaaaattttcataagagcatgagacaatttaatacatttatagaattctttaaagagaaagagagag

SEQ ID NO: 240543 - DNA, 452 bp, Homo sapiens
ataaatttactaaatcacaatccagtccttttatgtagctcattctttataaaagaattaaaatcttcttcagtaacatctacttaatactagttattcttcttagagccatatataaagatatttcttccttttatgttgtaacctgttacatattggaggagtactatcatattcttcatgttttttttttccaggtttaaatatatttggtttattttgctgttccttttatttgtcatggtttccagaccttttgctttcctatttttccttctgtttcctgtaatttgtaacaccagaagtgaatttttattttagcaaccacatttcattactggattgtaggcaactgaagcctaagctattttcacatataataccattaaacaaaatgcctcttaggctgtactttttcaggtgcaattgtatgtgtgtagttaatgcattga

SEQ ID NO: 240544 - DNA, 2080 bp, Homo sapiens
  misc_feature (866)..(866): n is a, c, g, or t
tcgcaatgaatactgtttttatagtgctgtttttcaaaatttctcacctccctaccctttacttcatttggggtctgcattttctttgtatttccccttgcccttactttcttcttataatacgtattacatttctgtagcatttaaacttttgatgaatactttcccctggtactatttcttggatactcacagaaaccctacaaattaagtaatgtccatcttttccagatagtgaatccagtactgaaatgttaaattaattgttcaatattccttagctagtaagtgggaagagccagaattcaaacctatctcatcgctttatacttaaattttttttctatcggtcttttttcagtatttgcgattttattaagaaggaagtttagaccatgggtggcttaacatgccctaataggtgaatttttttttggctttccagatggcttttatttatttgcattgcaaatgctttttttttaaaaagagattttctgaggctcttagttgtttactacttaatattctccactgtcatttctctttaatgacttcattaaaaataattgagcaaagtgttataaagtttgattctatctcctaacatatttttccattattgctaactactatgtaggacagaaaaaatgcttgaagtttcctcaaatagattttattatttaattctgtctgactttaaaagatttgcttcaaaaatgtctgttaagcaaaaagtatgcttgaattactaatttaaacacttcctgccagaatgcatttttttgcgtattaaacatggcattccagaagaacatagtggccttatatgagcttggtcagaacttcttttggctatctgaatntgtaaattgtcattggaacacaatgaaagtgttttatgaagtgtatttgatggataagtgagtaaatcaatgaaaagcttgcacatagttttttttacaataactacttacttgaatgtgtacctttgtgatgttgctgatattttagaggtaacaacagaacaaagacttctagatgaagaacactgacaagaactttgtataaattgtttattgtgatatttgcttatattaaaagtcatgtatctatttctgtaatttgcagatagtctaacatcatttataaatatttaactgaagagttggcaatggcttttttaatatgaaaatattttcaaatgtgtgaaagccggttctgacaattaaaaaaaaagttttctatttagtttctacacatacaataaatatacacacttggtaattttgtactggtaacccgtaaagaattttcctgtcctattgcggttaccgttactgttaagtttgcatacagtaaaacaattttaccttaatgcattagtttattggaaatttactgttagctatgtaaatatactagcataattaaaatgttatttgataatctgaatgtaaatacacttaaaaattacttttcaattaagaaatgtcgaaggaggccgggcgcggtggttcatgcctgtaatcccagcactttgggaggccgaggcgggcggatcacgaggtcaggagatcgagaccatcctggctaacacggagaaaccccgtctctactaaaaatacaaaaaattagccgggcgtgtggcgggcacctgtagtcccagctacttgggaggctgaggcaggagaatggcgtgaacccgggaggcggagcttgcagtgagccaagatcgcgccactgcaccccagcctgggagacagagcgagactccgtctcaaaaaaaaaaaaaagacaaaggaaattcttctagttcctttaaggatttctctagcacaggatcagagaggatcttggttattggtgactggtgagattctgttgggtgtttggaagcttcaaatgcatggagccaccccttaaaaatgtctcactggaggcaggcacggtggcttatgcctgtaatcccagcattttaggaggccgaagcaggtggatggcttgagtatatatacttcgcgagcaccgtgggcaacatagtgaaaccctgtctctacaaaaagtgcaaaaaaaaaaa

SEQ ID NO: 240545 - DNA, 1105 bp, Homo sapiens
aggagtctggtggcagcatgcccaataccatgcacctgccctacctcaggcagcgtggtggactgtgtggggcctccacctgctctgtctcccttccaggctgcctgatggagtctggctcctggagctgagccacaataatctcagccatctgccggctggcgccttccagggcttttggggactgcgggtgttgctgctttctctcaatatcctgcgggatctgtctgatggggccctagggggcctcagtttcctggagcagctgaacctcagccataaccagctggcccatctgcccacagacttctcggctaccctgggctctctgctctgcctggacctctctcacaacctactcacttccctggaccccaccagcctgtggcgcctggggggcctggagcagctcaacctgagccacaaccagctggctgaactggccgcaggggtctttgggggcctcttccacctacactggctctcgctggctgggaaccagctgcagcgggtgaagggtgctgccctgaccactgtgccgggcttggaagtcctctctgtagctgggaatgacatcagtgagctggaggccgaggcgtttgcaaccttaggagcactgggccttctctctcctgggtaaccgactgcagcacctggaggtcaaggcagtggcaggcatccggacagcaggcatgcggctgctgttgttggataacccctggacacgtgactgtgacctgcagtgagccttcggaaagttgggtcacctgcggcacttgagtgtcgtagacctgggcatcctgacttgcgctgggcccgaaaggctgtcaggggcagtgctgagtggtgtggaggcccagctttgcctggctgagactgccactgtgctgggcatcacaggcaccgtgctgctcacagtggctgtggctgtgctgatggctgagcgcaagcgaagacagggcccgcaagaagccggggagctggggagctttctggagagactatttaatcagcaggcagatcaacaggccaaaatttccaccataactgcaaacttgaatgcggatgaatggattacaacatggtcaaaccttgcaatgagagg

SEQ ID NO: 240546 - DNA, 468 bp, Homo sapiens
gccggggcggcgcgtgagacccacctgctccagagcctccgcccgcagctgtcggtgcctctggcctgcgcccaccccgcccgctcctcggggcgctttggaggaggcggcatcggcgctcgcccaggggaatgaggttctaaatgaatcacaactggcgggtctgacgtcgggcctttgcagctgctgttcccctgcctggagcgcacttatcacaagatgcctcagcagcccccacacacctgggatgagtatcaggtgctttgttgatcccatgctgtgtgctcagggagacaaagcatgcacgcatggggctgtatccacctgcagcagctggtgaatgactgcagaaggcagccccagcccacatactgctacttcagtgtgactgccactcctctcactgagagtccgggggcgtattccttccccttgactgctctaacaaataaagaatggcagaagtga

SEQ ID NO: 240547 - DNA, 455 bp, Homo sapiens
ccttactctgtctcaggcccccatccctgtggccggaatgtcaaaggacaatgactactttgtgggtttccgtatagctctcctttcccacccattccctgggatgctcactggggaaagagaccaggcctctctgctgaagcagcagtgcctggagcacaggaggccctccatttagtgatgagatgcctcagcagcccccacacacctgggatgagtatcagcccatgcagaagagtccccatggaaaggaactgaggccccagctgacagccaacatcgaccaccagacacgtgaatgaatgagtcctcggataattccagctcccagcctttgaattttccagctgaggcccagacatcctggagcagagacaggccttccatgctgtgccctgtgaattcctgacccatggaatccatgagcaaaataaatggttgttttacaccactca

SEQ ID NO: 240548 - DNA, 750 bp, Homo sapiens
taaagggcaaactaaatcctggtgacacataagatgaacactctccataaaagatattatggcttccaactttgttactgtctgctcagtcatttgctctgagagagatcagctgctatggatgaagagaggttcacatagtgaggaactgagacctcagaccaagagccacgtgtgtgagccatcttgggagcagctactatgaccccagtcaagccttcagataactgcagccccaaccaacatgttaatggctgtctcatgagagatcccaagccaggaccacccaactaagctacccctgaatttctgaccctcagagccagtgtacgaaataaatgtatgtgtttttattttattaatattgtttattttaatgagcactctcttgtcccagcatttgggaggaggagccaacgtgagagtcctcttccagttacatcaccatccatcctgaggtctggaacacacaccattcacaggatgcaaaacccagcacaggggttgtggacctgagaacctagatgagggtatttttatcttcatgcttttgaatacagataaaccacctataaaaagcttagcccagaggacccacttagtggctcttgtcgtggtatatcatattgacttcctattttctccatttaaatatgtgtcttctcagaaattatgggcctttattccgtgatctgaaagttcgttaattcaaggagaaaagatttctgaaaaccaagttactattaactc

SEQ ID NO: 240549 - DNA, 437 bp, Homo sapiens
cctctttcctttataaattactcagtctcaggcatttctttatagtactgtgaaaatggatgaatacagacagccgactgcatggcagcacttcacacatggaggggggccttgagggccgtgcacaggcaagtccatgtgactgaagatgaggtgtccattcctgggttcttgatgtgaactgcaggtctccacaattccttcctcccagagaacttcatgaagtaggttctcaagatattatcatttatttatagatgctttttaaaattcaaaatataataaaccatacaagggaacataacaaacacctgtattcccaccacccagaactgttagtatcccatttaaccctcatttcttgtcccatttttttccccaatacctccaaaggcaaacaccatcaagtttggtgtgtgtcatatatacctttatta

SEQ ID NO: 240550 - DNA, 440 bp, Homo sapiens
tttacctaattctcaaaccaaagccagcccagtaacaaaatgacagaccatgtaataagtcttggttgtgtaaacactggaagaaaaggcaaaaagccagcacagcatcttgcttttccaaagccctaggctattactgaaggatgcctcaactgtgccttcttggcaggagaaggtcatggcgacatagaatcaggtcaagaataagatagaattctaaaacaaagggatggttaaaaaataaaccacattaactatttagtttttcttcctagagctattggcacaattcctggttctgtcctgaaagataggttgtagtcatctggtaatatttctgattttttaatatctgtcttatgccccagtttgataaagcgtttttttaaaagacttaatagtctttgataactaaaaatactatctttatcacttatatc

SEQ ID NO: 240551 - DNA, 453 bp, Homo sapiens
ccgggcccgagagaaagaaactgcactttcgttttttagcagcaaagtttgttgatgtactttacaacttatcttttctgcttctactcaggacagtcaagacagtgctcagctagatgttcacataactgtagacataaatgtgaatctatttaacgcagtaattaattcaaaaagtgtttttagcatcctagcatgcatcagttgatatgaaagtagtaaatgttaattgagtggtcttgtgcatcctggacttctcatctgtgcatattctcattctttgcctgcaaagggccagtaaaagcacagtgatggttgaacgaatgtgacagcctcctttgctgatgccttaccccaaggtaatttggggaaaggttcagggaaacagagtatccaatccaatactctggactgggtgctggcaggaaggagggcgattgtatgattaagtat

SEQ ID NO: 240552 - DNA, 371 bp, Homo sapiens
gcgaggccagttgtaaatatctctatagatccatatagctagatataatactataccttaaaaaggatatcttgccctgacgtgctgcaatgagagcagttgaactctactgcgactcatactctgtaggttaagtgtcatttgctatggatttggtcattttagcctgcacgttgccagatctccccttgttgagtcttgtatgtggtctgtcctctgtgtcatttgagtcctcagctgtccccaaccccttcccagcccctccccagcctgcagtcaccccctgtccagcaagctgcctccatcccatccctctcctcacctcacaccaggtaactctggaagtgcagaatgcttggtagtttggagct

SEQ ID NO: 240553 - DNA, 428 bp, Homo sapiens
cagccagtagctgggcttgtagctcagacctgggacctcttccacataagtttattatcaccttactgcccccactagatgcatattgggagctggagatggtgaaaatagacacagcactttaggggctagatgagtatacagctggtttaggagtatatctgagttatgtttataataaatagataatatgacagaataaatgtttgggattttcttttggttccatcgaaagttagaggacctccttctaggatttgtttgcctcttctggaataatgcagggcctatgtgactcctcagggaccctggatgcacacagttcatgtccccagggatgaggatgccaagaattgggcagaggtaaatgaagtggtcatgcttgggttaccagggagttagagctgaacctggacagtagttaaagg

SEQ ID NO: 240554 - DNA, 449 bp, Homo sapiens
ctgtttcctcagctatagaaatgaaaaggccgtccttttcttattcctctctgattatagtatgatgtcataatagctggtgttaatcttgtttatcaaaagttaccttgtctgtttattacctttatgatgtaaaaggtgaacgttaacacaggagggagctggtgagtgatttgtgttaactttcatgcttgagattgaaataacgacattcctttctttcttccttggggagctgtaagcagtgttgcctagaaaaaggctgctttgggaggaaaatggaaggattaggggaggaggaaaaaggtgaggcaggagagcatatggttggagcaagccaattaatctgaggcaggagaatctcttggatccaggagaccaaggttgcagtgagccgagatcacgccacggcactccagcctgagcgacagagcaagactccatctcaa

SEQ ID NO: 240555 - DNA, 529 bp, Homo sapiens
ccgagggcgtgttgaggaaattccattcaagaccctcatttccgaaagtgctctgtgattagcccggctttgtgccagccccagtccagaggcagagaggccagcccttaggtcaccaaaagcatcaggaaaatacaaatgcgggcccctttacagcccggcacaggaggttaaaggatttgctttgtagtttgtttatctcacagactgaagccaattatcccaattactaaaaaaataaaataaagtttactacagattgtatttttaagttcatttaatctccaaaacaggctgctacacacagttttcctttggttccaacaactcacgcccagtctctgtggcagggaagacagcccctaagggtcacatgtccaagggccaggggaggtcagaggtcacttaatggttcccaaatgcgctagcaagtagtcatagatttgaactttgcattgttgctgcggacccagggccttcttgggaggggagagctgggggagctatctctgcagttcaaaggcgggcg

SEQ ID NO: 240556 - DNA, 599 bp, Homo sapiens
gtccggtctctagtactgatcttaagaagaaagatttggaatggtttgccttttccagaatggaaattttgctgtaatagcttgagaacaggagaaaaaaatatttgtcaataggctaatcctaaagcttaagctactagttggaaagcagtgtccccaccacaagttttgtgctgctttttcctgaagaaattttttaaagtttcgttatgtgtcaaaacaattttgatggtttcatcctacatttagtagaggaaaataaaaatcatctccataccagaccagatgaatctaacaaaatcttttttttacttgctgcaaacacttacatccatgccactcatgagagctgagcatttgccgttgtacgttccttggtctactgttctcttctgtcatgtaagagtgggccttgggcatgaaggctgaagaatttagaggttggaccacaaaagacaaacgggagattttgagggcagaggggaagccacagccatttggcagttctagtgcatcatcaaggagtacctggctcccctctccccctcacctgttggcaagcattctgccttccccgggacctcctccagctgctccag

SEQ ID NO: 240557 - DNA, 912 bp, Homo sapiens
aggagaaggccgggcgcagtggctcgtgactgtaattccagcactttgaggggcagaggcaggtggattacctgaggtcaggagtttgagaccagcctggccaacatggcaaaaccccgtctctactaaaaatacaaatattagccaggcatggtggtgcatatctgtagtcccagctactcaggaggctgagcaggagaatcacttgaactcaggaggtggagcgtgcagtgggccgagattgcacctctgcactccagcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaagcaaaggccggacgtggtggctcacgcctgtaatcccagcactttgggaggccgagacgggcggatcatgaggtcaggagattgagaccatcctggctaacacggtgaaaccctgtctctactaaaaatacaaaaaaattagctgggcgtggtggcgggcgtctgtagttccagctactcgggaggctgaggcaggaggatggcgtgaacccaggagcacaggttgcagtgagccgagatggcgccactgcactccagcctgggcgacagagcgagactctgtctcaaaaaaaaaaaaaaaaggaagcaaagtgcccagctgggatggtggtttcagaggccacagtgggagcttcccagagaagggatgattgagctaagtctaagcaaaaggggtggtcagggcagcagctgctccaaaacaggggctgggggcttatgtggagagagaagacatggagagaccatgcccagaaggaggcggcggcttcagtgaacagtgcagg

SEQ ID NO: 240558 - DNA, 400 bp, Homo sapiens
agccttttaaggagtatttgtgaagaggagatgagaaggtagatgaagaggaaaatgggtttgaacttattttttttttagattttagatgatagaaacctgagcatttaaaaaactgatggaaaaatccaccagtagggcagacattgaagacaaagaagacagtagggataatttttggtgtgaggattctgagaagtttgggaaatgagatccagagcaggtaaaaggattgactttggagaggagaacctctgttctatcgtagccagaggcagagaaggagagaatgagagttgatgtgtgtggtgggaaggctttaaggaagcttccctttgaagggcattttttatgtaaagtaagaagtgaagagagttgagagtgaaaagagaagaagtat

SEQ ID NO: 240559 - DNA, 369 bp, Homo sapiens
agcgccataacgttgatctatagatgaggaaactcaggtccagccagacacagtaatttacatggatgagcttaaggccagtggtggaagcttgctaaagagctttccaatcacatttgaagtcttacatcttggatactctggcctcatttgccgctctatttcatcacttcaaatttgacacatcttgtattttgattatgtagattatggtttaaaatggaagtctctgttgacacttgaaatgtccagagtatctgttcatagaacttttgtaaataaacatgtaatctattttaatatgatgtcatctgggatgacaaccacaagtgcaataagaagtaaaaactattgtgtgtttattactgc

SEQ ID NO: 240560 - DNA, 498 bp, Homo sapiens
gaatacaaaacccagaaagaaatccatgtgtttacagccaaattttttttataaagttgccaaaaatatacattgataaaggacacaccctcttcaataaatgttgctgggaaaagtggatgtccacatgtagaagaatgaaactaaacccctatctctcatcatataaaacaatcaacccaagatggattcaggacttaaatgtaagacctgaatctataaaactactagaagaaaacaggggaaacacttctggatattggtcttggcaaagattttatggctgagaactaagcacaggcaacagaaacaaaaatagacaaatgatactctattaaactaagaaccttttgcacagctaggaaacaatcgacagagtctctgaagagacagctggtggagtgggaggaaatatttgtaaatgatatcccacaagggagttatacaaggaattcaaacaaatcaacagcaaaaacaaaaacaaaacaaacaaaaacc

SEQ ID NO: 240561 - DNA, 437 bp, Homo sapiens
atttctctgccagagaggcagtggtagactcagtttctttaggttgaagtgacctgaatagcaatgtcaaaaaatgtaagatcagtcttgctgactttggaaccacatagacaagatactgtgaatgtgtcatttgattccactagtggttaataaaggcaaccctgaatactagtaaggtaggaagaaactaacattgaattctgagtgtacacacgcacacacacacacacacacacacacaacatagaccaggtttccagaggtgccagttgttcagttcaagccacagaacagcccttagcatgctaacctgcagaataacagccatccagattccctcccagcctgatcccacttcatttatcctcttgacctccttacctcttactctttccttttccctccttcgttttatccgatcagatttcaagatt

SEQ ID NO: 240562 - DNA, 429 bp, Homo sapiens
cccaccttccttacgaggcaggttgtgttgactataaattgttacttgaatattccccttagtgggatacagagggtgtctcatctcactctgccccaaatgacttattagaacattccttcccattatcagttaggaatgattttggctgcaaataacaaacacaacaaagatgagagtaggttttaaaaataggcatttatttttctcacatttctggaagtccagagataggcagcatctggtgttatttctaaaactcagtaatatcaaggccaattgctacaatttcttggcttttctctcataatgggcaaggtggctgctgcagcaccagtcatcttgtccacattccaaggagggagaatgggaaagagaaagggatggcacctatatcaggaaaacaaaggatttcactgcaaccctgga

SEQ ID NO: 240563 - DNA, 377 bp, Homo sapiens
gaaagggttttgtcaataaattctgacagaagccttctaccagaggcattattattactcttcccagtatacaattaaagaaacagtctaggggagattaagaaacctgccttaggctgggcacagagggaggcagaggcacacagatcacttgagcccaggagtttgagaccagcctaggcaacgtggcaagaccctgtttccacaaaaattgtaaaaattagcctggaatggtggtgcgtgcctgtaatcccagccactcaggaggatgaggtgggaggattgcctgagcccagggaggtccaggctacagtgagccgtgactgcaccactacactctagcctgggtgttggagtgaaaccctgtttcaaaaaaa

SEQ ID NO: 240564 - DNA, 413 bp, Homo sapiens
ccaaggtatttacgatatggactaaactcaagcatagaaaatctagtacaggcataccttggagatactgcgaatttggttccagaccaccgcaatatgacaaagtgaggtctcacaaatgtttcatgtcccagtgcaaatacaatcatgtttataatgtagtctattaagcgtgtaatagcgttatgtctaaaacaatgtgcataccttaatttaaaatattgggagagaggaaggaaaaagtatatatacatttgttaattgctctgaggaaggagggtcgcatgagcccagaggttcgagattacagtgagctatgattgtgcctccgcacccctgcctggcgacagagtgagaccttgtctctaaaaataaacaagtaaataaaatacatgactgctaaaaaaatgcta

SEQ ID NO: 240565 - DNA, 424 bp, Homo sapiens
ccagcctaagcgacacagtgggaccctgtctcaaaaagaaaaaaaagaaaactcagaagttgtagaatatttggggtaaggcaacccctaaaaagtaagatgattcctatttagattcctaatagacaatagtcatataaatatggattttattccctttctgctgcttaaaaagggtttgattccggaggccctcataggaatcatttaaaaaataagtcttaataaatgattatttgccaggcactgttgtaattaaaatctgacagtttagtgagttaaggactgatatcctcatttttcacatgaggcagctgaggcaggaagatcacttggatcatgtgagcctgggaagtgagggctgtagtgagctgtgattgggccactgcaccccagcctaagcgacacagtgggaccctgtctc

SEQ ID NO: 240566 - DNA, 2358 bp, Homo sapiens
  misc_feature (681)..(681): n is a, c, g, or t
  misc_feature (1691)..(1691): n is a, c, g, or t
  misc_feature (2149)..(2149): n is a, c, g, or t
ttgttcataggggtccctcgttttctgagacacctcatctgagcactgacgaggggacacaactcttggctgggaagcaggagactgagcattgccttcaagccatccccacacatgtgacctcagtcagcattctgccctttcatgggtgtcagttgtctcgtccataaaatgggatgatgttcttgttccagccggcatactggatgactaaatgagggaacaggtaagaagctgcattggaaaaaggtaccattcagctgcaagacatccttgtgcagttcccccagggctaatggggtttggttgcccacctttgctgtgtctcttcgtggcgccagcaggtggcagcattgcctttgcatgtgccggctccacctctggcctctcccagacatgcagcgtgtagggcaggggaccattcttcacccaattcatttcaggggtcatgggaaggagggatctgaaatgccctgaatgggaagggcctggaaagaaaatgaaaatctcattcctcccctcaaagaaacacagataagccaggagagcaggatctggtgcatgagcccaagagggctaatgtgaccacttaggctgaagggggaccttacctctctctgccacaacggtgtcccccaccacctggaggagggaactggggatccagaaggcttgggtccntgtctttggttggaaaagtcagccagcattgcagtggggcagcaggaattcctctatttttgtgtgtgcaacagagttgaaaacttaattcactctataatttatttgtgcaaaaaaaaggtaatttccttatttatgagtctataatgaatctggcctttcttccaacccctgcctgatgataagcgagaaaaacaatgaaattttcaacttgatttgaacatcctggggccagagagtttagccggtcttgttaagtgatcttattaatttctcttggataaaatgcttagttctcagactgctttgcccagcttctcccactgtggtgctgttggggttttgtagacagtcaagggcagcttgtgtggcatctggtaggaggcatgagttgggatcctggggtgtggtgtcctctagacccagcaaggtcccctgtccctcctggccactgatcatactagaagctgagtttatgaaactcatggtccagtccctcctgatctgactagagcccatgtggcgcccctggctggccagccctcctgcacctgggcccctcctccccaccaagtctcctagctgtgccaccatggccccagtagggctgctggctcacaggaatggaagttggctttgaaagctgaactttagtggtgcctctcccttaccggggagccctggtgctggaggcagaggccgagttggtttgcagctgcctgggatgccacttcttcccagagttccaatgtgagttggggacaagggcttctttctctcagggaggggtgagtgggccagtgcttggctctgcttgttatccttctaatccccttcgtaccatcccctgggcaggaaggaggggaccaacactcttcctcttcttgctcagtcatccattacataaaattccagggccacacccaaggagagggatgagggaatccaggaaacatgctctcaaaagaatagcctgctttagaagacttttgatctgcagcataatcctnttttgcatgtcaaataccaaacattaccacattttttcttctgtgcattctgtctatatcaaacattaatcctggtctctctttaagcagagatgcatgcctcaggccaatgaagatgaagatcatgtaccatcaaggcaaaagagaaaagcactgcactccaacccgggcaacagaattattattattattttttaagagataggatatcattctattgctcaggctggagtacagtcgtgcgatcatagctcactgtaatcttgaacacgtggactcaagtgctcctcctacctcagcctctaggtagctgggactaggggtgtgtgccaccacacctggctaatttttctattttttttcaatagatggggtcttgctgtgctgcccaggctggtcttgaactcctgagctcaagcaatccccttgcctcagcttcccaaagtatggggattacnggcgtgagccattgtgcctggcccaaaatttttcaaatatcatccttttaagcttcaaatgttaccaacattggcgaatgcaaccagaggagacataacacataaaacatggggggtttatccacaaggagaattcactatcttgctggtgttaggatctgtccttccagggaggatacgccatgagtcagaagtagatgccactcagc

SEQ ID NO: 240567 - DNA, 534 bp, Homo sapiens
gactttttcgtaataaggctgtcataatactgcctgatgtattttatgtaatgaattgcagactgcagaaagcggggacttagctgagaaaattaatcgtgcactcattcagcaaaggtttcagggcctgctgtgtggagacacggttccaagcactgctgcagtagcagggaggaaacagaacggacctcaaacgctgtcccagcaaggactccagtctctgccttgtggatgtgtaactggcacgtgatgtaccagaaactcctgtgtgtggttgtatccggtgcgtgacacagtactctctccagctgctccttggatttgggaagcagccgaagatttacgggccatggaggctccttctatccctggaaatcggcccttgggaattaagctgagttatgtggttaaagccgtcatgacagccatcccctggctgggccagttctgggaataactataatgcttatactacaggatggccaattcagaacttcttactagtgctgaattcaataaaggtttaataacaca

SEQ ID NO: 240568 - DNA, 380 bp, Homo sapiens
cttgattatagttcctcatttttcctggccacaggccaaccctcaatatcctccacctttataaggaagacagcttcaacccagccctaaagggtgactccagcctcttatgatctttctttcatgttgcaaactggactctcttcttccaactttctaattgcaaaattgctctttatttttatgggttcttattacttccaacccaggtgtgaaaatgtcttcttggacacccttatcccatctgtagggcctgtgtaggtccctctttctctcattcttagttgaggattgactgagtagactgcacaatgatgaccatattttaaaagggacaaaggtcacatagcgaagtctctgttcattctcccaggcacaat

SEQ ID NO: 240569 - DNA, 373 bp, Homo sapiens
agtcttgaataaataaatatctaattaaaattgtgacaagtgctaagaaggacaagtataaagttttttaagaagaatagaagccaggccgggtgcagtggctcacgcccgtaatcccagcactttgggaggccgaggtgggcagattactagaagttaggagttcaagaccagcctggccaacatggtgaaaccccatctctactaaaaatacaaaaaattagctgagtgtggtggcaggcacctgtaatcccagctactcaggaggctgaggcaggagaatcacttgaacccaggaggcggaggttgcagtgagccgagatcgtgccactgcactccagcctgggtgaaaaagtgagactctgtcccaaaa

SEQ ID NO: 240570 - DNA, 430 bp, Homo sapiens
atggatctataagcagcaggaagattttttccaaggactgggagcaaacttgcaggctctgccatgtacttattgtggggtacctttagatgaattccctgtgagtgagagaagttgatcaccccaggaattagtcactaagaattcctaagaactttctatcaaaagcattggatccaagccatatattgaaatacaagcgtgattaatcagtaattcacattgccgatatgcatatgcaacttataatcaaatagaactagaagagactttgaagtcacctgactcagccccttgtgtttacagacaaggacatgtagtccaaggttgcatggtgagttcacagtcggattgtcctccctccaaactgaaactaatttgattttgatttcatattcaatatgcaataattatgttctatcagagataa

SEQ ID NO: 240571 - DNA, 338 bp, Homo sapiens
aagacgagaaaaacatcccgggtgctctgcataaaccacacgcaacgaaaaagctcaccgccagacagcttctgtaggtttaagaagactacgtttttctgaccacttcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgag

SEQ ID NO: 240572 - DNA, 368 bp, Homo sapiens
tttacatggcagaagctttgagtgatccacaattggttaatcacaaggatgtttacatgaagccagtgaaatgagaacctctgagggtcagaggcccaggagacagctattgtgctattgatttgtttcttaacttcagaaaggggaagctgatgccatgagcttggatgcaggattcatctacatagcagggaaatgtggtctggtgcctgtcctggcagagaactacagtaagtggaggggagtgtccgtctccattttttctgtccacagttcccctgggctgtgggcatagaaagatgaggaaataacttagtttagtgttgagataataactattgttggaatgtatggagctagtagaaaaa

SEQ ID NO: 240573 - DNA, 543 bp, Homo sapiens
cgggacagttgaaggaacattgagtcaaaattagaattcataaaatccgttgtaacacatctaatgtgaacgcattataaacatggacctgtacttctttataaccagaaatactaggagtagtcaacaaaaggtcatcattaatattagttctgcggttttttccacgtaatttaagaaattctgaacatgtttagcaacaagcatataactatgacaaacactcttagcgtgttttattagattgatttgtaaaacttaagggaactattttatttactggaaccaactattttattttaccagaaccagcacattggattaattggtatcgcacactgtagtcctagctacttgggaggctgaggtgggaggatcacttgcgccctggatgttgaagctgcagcgcgctgtgatcattgccaccacactccagcctgggcaacacagcaaaaacctgtctctaaaaaaacctagaatatctttgtgctatgcaaatcctaatttgaaaaatttgtcattaaattctctccaaacattctt

SEQ ID NO: 240574 - DNA, 553 bp, Homo sapiens
cacgtggctcaagcactggagtaaaccccagactgcagtttaaagatgaaggttttagacccacccttaccacttagtagcactttgagtttaggaaagcaatttgtttctgagctttagcctccttgttgtagtgctaatacctgtttcacctgatagggttgctgagctagcgaatcccgagtcctgcatgttaggggaaccagtagaaaccgaatgtgtgtgttgtgacacctgtgtttctaccttgtgccacctttataggaatgcctggtcagcacatctctaatggcactcggcttgcttctcaggccttacgcctgttaactttttttccccttatgcatctgtttggttttcttccctgactcaacgactgattttcctgaaagtagaagctctcatacgccctctagtgttccctggacatgaccagtattccagcaccacgaacagtgcctggcagctctgggaggttcttcataagtttgttgaactgagtggattctaggtcggcccgatgaattgttttgcctgtctgatttgtataaca

SEQ ID NO: 240575 - DNA, 607 bp, Homo sapiens
cacgtggctcaagcactggagtaaaccccagactgcagtttaaagatgaaggttttagacccacccttaccacttagtagcactttgagtttaggaaagcaatttgtttctgagctttagcctccttgttgtagtgctaatacctgtttcacctgatagggttgctgagctagcgaatcccgagtcctgcatgttaggggaaccagtagaaaccgaatgtgtgtgttgtgacacctgtgtttctaccttgtgccacctttataggaatgcctggtcagcacatctctaatggcactcggcttgcttctcaggccttacgcaaaaggcccattcagtgaagggtcattctgcttcctagtctgtacttttctaccctgttaactttttttccccttatgcatctgtttggttttcttccctgactcaacgactgattttcctgaaagtagaagctctcatacgccctctagtgttccctggacatgaccagtattccagcaccacgaacagtgcctggcagctctgggaggttcttcataagtttgttgaactgagtggattctaggtcggcccgatgaattgttttgcctgtctgatttgtataaca

SEQ ID NO: 240576 - DNA, 400 bp, Homo sapiens
ggatttttaaaaaaatgtttaagacaattatactatttactaatatttttaaaagtagatcatgtctacaaggcagctatgccaaacatttttaaatagaggttaaaaattaatgttttaaaacattcttttaagcctagaaaaatgataaccaactgatttttaagatattggcatggctagtttgcagaaaaacacattttggtaaacagattatatattttaattcttgagcactttatattgaccagacagtctaatggagtttatcctcatgagtgagcgatttgacttagaacaaaattaaagcgtccataagaaccttcaacagtaatttcttggactgaatttaatctaaattcagcattgtatgagaaatgcgacatttctgctaactcta

SEQ ID NO: 240577 - DNA, 469 bp, Homo sapiens
ggcaaccgtagtttgacagaagagcagcaccttgatttaatgcttcccagcatgtgtccttgagcaagtcacctaacctctctgggctgcttcctcattgggaaaatatggctgccagtaaaacctgccctgtccacctcctggggcacttggcaaacagcaaaagagtccaaatgtgcaggctgggccaggcgcagtggctcatgcctgtaatcccagcaatttaggaagccaaggtgggcggatcacctgaggtcaggagtttgagaccagcctggccaacatggtgaaaccttgtctctacaaaaatacaaaaattagccgggcatgatggcgggtgcctgtaatcccagttactcgggaggctgaggcaagagaatcgcttgaacccggaaggggaaggttgcagtgagccaagattgtgccactgcactccagcctgggcaacagagcgagactctgtctcaaa

SEQ ID NO: 240578 - DNA, 277 bp, Homo sapiens
gctcacctcccaaggctcagcttaagcctcactggatctatagcctttcctgaatccccaacttcaagaggaatgatccttgtctcccacggtatgctccccgtcccgcctctgcacttatttccccacacaactatgactcccggctagatggttcaccacctaaagacagcaactatgatgtggtcatcttaatacagataataccagttacaatgtacactttttaggcattcactaagtctcaccagcctgaccaacctggtgaaacccctct

SEQ ID NO: 240579 - DNA, 2546 bp, Homo sapiens
cccctcaaacttgaaaagaaggacagagccacacaagaggacagctccttctgcagtgcctcctctggcctgactgaaaggagacagcctcagagctatgcctccagacgcatcattcctcttgcaacactgactgttttcacagcaagatgggccctttagctctcctcatgaaatgtgaggctgtgtgccctctctgccttcctctgactacagaggaccactggaatgtatttatggagttggaagagtcagaatgcgtttgcctatgaaaattttttttggaactgaaacaaaacaaaacaaaaaagcccaaccaactttgaacttgttttcactagcccagccgatgtgccactataagccttcaagggccttaccccagcaaggcctctgctttggtgctctccatgacgcaatctgtctctctgcagacacaactctaaggtgtctccagagccaaagtcaggtgaagaaatggggttattgtgtggattattttaggtcagaatacaggccaaaaaaaacaaaactggttctgtttgaaattgcctggctgccctcattttgtcacttgactttacatggagagatactgctccaggaattacccaaatgacaaaataaacaaacaaacaaataaaaccgtacattctgcaccaagaataaataacgcaaagtggagactgagcttattaattttttcaaagccttccttacctgaatatgttaatgtgaattaatgtgctggactggcccagaggaaaataaagtccttctgtagtttatcttctatacctaaattggcagatctatggaattcatgtttgcattacatgtaaagtttttacagttcttacacctggataaggatcttttgactggaaaggtcaatatatttcaagggctttggctctgagaaagaacggcttggtggattccaggtaccaaatcatctgtaaaatcacatgccaaatcccaaaagcttactgtctccaggaccacaaaccaatcaatttgggaggaaattggctcaaataacatcaacacccgtaatgccaatggccaaactctagatggtgaatgtgaaatcttaagtggaatctgctcccaggccaagacaatacaaccaaatcatctggatgcaagtcaagctatgagatggagacattaaagcccagataagacgtgctgaataatagaaagaacatgaatttattggcagaaagacctgagttcaaatgtgggtgtcagtaactctgcggctttggacaaattattaaacctcattaaatctctgttttctcatctggagattgagaccagtagtaccaactttccagggctgatatagagccgaaattaaaatgtctgtgaagtgcctaacacaatggctggcatcttattagatttaataaatgtgagttccctcttcccttgcccactatatggcagagatgtaattcaaaagcagggaggtgggcctccaaacccaagttcttggcacatctgtaatgagaacttgtctgagctgctcctccaccactgtggtgatacaatcagattggctgaacttgaatgattctttcctttatactggcaaaccactctctattattttatgtatttagcccagatgtaaatcttgtacaagtcaaaatcaaaatatataaatcatgcatctcccagtgcattctaatgtgcctgcagtacagcctgatcataaaaatatcagtcatagacctactcagaaaaaaggtttaacattggcaaaagattatagagtaaatactgggcttcaggttctagggaatttgcgaaaagccaataagacatagggaacaccaatagcctttcttgtgctaaatctctctcacagtccccctgttttgaatcaggccatgtcttcccctgggaagaaaagaaatgcaagttcacaaaaaatgttcttgtgaaaagttgtaagctgcatttacaactggggaagatttcagtctcagttgttttcttgctggtcatagatatatttgtcctttgcttgctatggagaaagattctgaactttcagaaaaaacttccaagtctagactccaaagaatatagtttatcttactatggcatttattttgcagacagttccctctccaacacatgagtctatacaaatggtctcacctggcaacatatttcccagcccatgcacccctcccctatccctgatgccctaaggacactgcagagacagctgtgggtacaatgaaaaagtgcaaacttggagtaatgagatcagcatcgagttctaactctgcacttttctctctgactttgtacatgtcacctcaattctatgagttttgacttttgtcatctctataatggggacattagctgactaccaggtgttccacctgaaagctctgtaaaagaaagcacattgtgttatataaatttttaaaattagaatttagagagcagaaactgaagaactgtatgttcagctggtattttccatttttaaattaaaattcatacttgctactagtctg

SEQ ID NO: 240580 - DNA, 860 bp, Homo sapiens
agcggatagacaaactcaaaatgggagacattggacaagataactggccaaactcttccgaagtgtcaaagtcatgatgtcaaagagagaggggagacctgattcctgctccaggacacctcagagacaggacaactaaatgaaaacccagctacagcagatcagcaagagaatcaggctgtctggtttggaaaataaattttgacactgctctgtcctccctgtcctgtaacaggccaacctcccgaagatgcataaagacacctttgccgttgaccaggcagaccctgcatccacaggacatagagagaaaggtgctccctgaacactgatctggataagcattgctgggtcagtgcagaggcgtccatttccccagtctgccgagctggcctaaagctgaggacctcttagtgggagctgaggacatgtgcctgaagaggcaagcccttgactgatggaaattggagtctgagttccatgtgggggactgggaagcacagcaaggtctgaaatgggagacccagggaagggcagagaggaccaaaggaggaagggggtctacagtgtgggaaacagcctggacgcaacagccgggggagggggcctgctctggccccagtggccccttgtaagcaggaaaggcagctggctagacctcttctgtgttattcactctgattttatcctttatcttcccctcccaacctcacctcctttctaaccccaaagccatgcagctaatatgactaagattgctgggcgtttgcttggaaatgcaaatgagaatttctggtagtttcctagtttccttgatctcctttgtcaagtttattgaggggaaaggactctcggttaaa

SEQ ID NO: 240581 - DNA, 432 bp, Homo sapiens
aggatggtctcgatctcctgacctcctgatccgccctcctcggcctcccaaagtgctggaattacaggcgtgagccaccatgcccagccttagatgtaagtcttatgtaaatttagcttttccccctttcattgtaatttcttcagagtactttttctaatgttgttttctcttttctgctgttttaaacactatgaatatttttgtttgaagactcttctgtagtgggaatgtcctgaaacttcaggcccctaaaggattttagattataaaatgtaagtgacttagtcactgactatattatgcttataacagctaagacctcacagatctttcaggcacatgtgtatgcatagatttattaaaattcatctggagagaaactttcgcaaaaatgcatcattcattcctgctccttaaaaacaaacaaaa

SEQ ID NO: 240582 - DNA, 549 bp, Homo sapiens
ctctactgtgctagctaatgcaaagctacctttgcatatgtaaggtctagcaggggagaaccaggaggtaggcagcagaagatcctttataaaagaccaagcctgaaatctgaaaatccctgaaattccttagaaattgatcatcttaactctttctttgccaagcccgcatttcctgatttatatccttgttacagctgaaagaagctcatcatgtaaaggtttatagcaccaccattttcctcagaggattttacatatgcaacctatggatggatttttataagaactataccttggacttcttgcatgaagttaggaaggttatcttcagaggctccaagttttaatgcattccagtgttgtcaaatccaaaagcaattaaatactgttgtgtggttttgaattatagcctgcttgttaaaatagctactgtttcccctaaggacagcctgcatttttacctgatgtcatctgactctgggtctcaagagagtggggaacctaatagaacaactgaataaatgtagttctaagacagtgaaaaaa

SEQ ID NO: 240583 - DNA, 394 bp, Homo sapiens
  misc_feature (24)..(24): n is a, c, g, or t
gcaatagtgctcagactggtagcncaaacagctccccgttaactgaaagaagctcatcatgtaaaggtttatagcaccaccattttcctcagaggattttacatatgcaacctatggatggatttttataagaactataccttggacttcttgcatgaagttaggaaggttatcttcagaggctccaagttttaatgcattccagtgttgtcaaatccaaaagcaattaaatactgttgtgtggttttgaattatagcctgcttgttaaaatagctactgtttcccctaaggacagcctgcatttttacctgatgtcatctgactctgggtctcaagagagtggggaacctaatagaacaactgaataaatgtagttctaagacagtgaaaaaa

SEQ ID NO: 240584 - DNA, 473 bp, Homo sapiens
ttttacaattgttttttgttctaaaccagggttttttaaccttaacaccattgacattttgggctgggaaattctttgttgtgggggcctgtcctgtgcattttaggaggtttaagcagctctggcccctaccagtagtatatgccctttaccccctggggttgtgacaacgaaaaatgtctctagacattgccaaatgctctcttgggggacaaaatagccaccaatcaagaaccactgttctaaaccagcagtctcaaagcatggtctccatggaccactgaggtcctaagaccctttgagggaggagtgtagatgaagtcacaactgttttcataaaaatcaaagttaactgtccattttcaccgtgtcgacatttgtacttacggtgcataggcaaagtggataaaatttgctggggccctagcaggatgcaagggcaccacactgtattcttcactcacagttaaaaa

SEQ ID NO: 240585 - DNA, 696 bp, Homo sapiens
  misc_feature (596)..(596): n is a, c, g, or t
cgggggcggtggctcacgcctataatctcagcactttggaggccgaggcgggcagatcacgaggtcaggaaatcgagaccatcctggctaacacggtaaaactccgtctctactaaaaatacaaaaaaattagccgggcgtggtggggggcacctgttgtcccagctactcaagaggctgaggcaggagaatggcatgaacccggggggcggagcttgcagtgagccgagatcgtgccactgcactccagcctcagtgacagagtaagactctgtctcaaataaataaataaataaataaaaataaagttaaacaattacttaacccaagtcctggactgatgagaggcaaataaggtgctatactcagaaaaaaaataaggaaaggtttaatatgctatgcaagttcagctatgaataagacacaagtatctctcaacaaatatgaagaaagagagtttgttggctgggcgaggtggctcacatctgtaatcccaaaactttgggaggctgaggcaggaagactgcttgagctcaggtgttcaagaccagtctgaacaagatggcaagaccctgttgttacaaaaaaaaataatngcaagtttttattgtgggcgcaattaagatacttgggcaattgccccttaagagggggggttacaataatcggccggggttttaaaaaccgggaatggga

SEQ ID NO: 240586 - DNA, 403 bp, Homo sapiens
tcttggcattgattgtccctgggagagggatcttgcacctggcccagactatgcggccttggcaggagactagtattgcccacaattagtctattagggtttagtttattcagattttctttgtatctgagaccagctttcatcagaatgcatggcagagtcagggtacactgcagctctgaaggccattgccttatttttttcttttttaaaaattaacttactattttgattataaaagtaatataggccaggtgcggtggttcatgcctgtaatcccagcattttgggaggccgaggcaggagaatcgcttgaacctgggaggctttggttgcagtgagccgagattgcaccattgcactcaagcctgggcaacagaatgagactccatttaaaaaaaaa

SEQ ID NO: 240587 - DNA, 629 bp, Homo sapiens
tgtttgtttgtttgtttgttttgagacgaagtcttcctctgtcgcccaggctggagtattgtagtgcgatctcggctcactgcaacctccgcagcccaggttcaagagattctcctgcctcagcctccagaatagctggaattacaggcgtccgccaccacacccagctaatttttatatttttagtagaggcagggtttcaccatgttggtcaggctggtttcaaactcctgacctcaagtgatccatctgcctcagcctcctaaagtgctgggattataggcatgagccatcacaccaagcctcatttttcaataatgtaaaatggttataattactgcgaaagagtgctcattaatattatcatttgtttatatcaaacttagcataagctggaaaaatctcaagcaaatctgtatagcccttagcttatttaaatcccaaaacaaaatgagacaccaaatttacagggtttctttttaagtcaagacaatcttgtcatcaaaggatgaagccaaggaagctaaaagagtacatctctatacttgaaaacacaacagcatagatattatttatgagaaagtgtgttgagaaagggtgggaattaaacaaaatttacatttttccaa

SEQ ID NO: 240588 - DNA, 471 bp, Homo sapiens
tcatcagtaatgcgaggatgtaagttagttgatactcaaccttcctgtctgttctagaattctgtgagtctatgattaagtccttagcaaagaaatatttaggaacaactgcctgtgtgaggataaggagccagacacacctgtgatatgagggcagcccgggtctctaggatctgctctgggccaggtgtggtggctcacacctgtaatcctagcactttgggaggccaagctgggaggattgcttgagctcaggagtttgagaccagccttggcaatgtagtgagactctacctctcccaaaatatacatataaaaaaaattagccaggtgtggtggcatgcacctgtagtctcagctgcttgagaggctgaggcgggaggattgcttgagcccaggaggttgagactgcagtgagtttgtttgtaccactgcactctagcctgggcgacagagcaagactccgtctca

SEQ ID NO: 240589 - DNA, 423 bp, Homo sapiens
gctcactgcaatctccacctcaggggttcaagtgattctcctgcctcagcctcctgagtagctgggattacaggtgtgcatcaccaaacccagctaatttttttgtatttttagtacagatggggtttcaccatgttgaccaggatggtctcgatctcctgacctcatgatctgcccaccttggcctctcaaagtactgggattacaggcatgagccacagcacctggcctcttgagtagttacctttatagcagtgtgaaaacagactaatacacctactatgtagagatactgtgctaaatgcaaatacagtagctgtcttatttatatctatgtaaccagtgcttagtaatttgcacataacaggacttcagtaaacaactaattcagtttatctgtggtataaatccagattttcatat

SEQ ID NO: 240590 - DNA, 781 bp, Homo sapiens
cagccaaggaacaccgggagccatcagcagctgggaaggcaaggaaacattctcccctagagccttggagagggcatggttctgcgagagccttgatttcaggcttctggtctccagaactgtgagagaataaatttctgtcatgttaagctgccacatttatggtaatttgtgatagcaaccctaggaatctaatgcagcactgcttccagctgggtgcagaaacagccccagagttcctctgaacacaagcgtcccaagaaactgcttcccaatcaatcagttggagttgacgccagaaatggaaactgtttgctactcctggattgaatcatccccagcgttcctttcctttcaagaatccagactgcttgcctccccttttctcataaagggccgtctggctttgaggttccatcccttcctgttcctttcaaccttgtaagaacccattgccaccattctattgagatcacagggtgtgtctggaatagagggtggaaagtagctcagatagatgtagacctgaataaatttatacacattatatgtttttaaaagtcagcttttctcttcttggttcttggccaaagtatccaagttaacccatgaaggtctctttctgattcacattaatgataaaaggttaggaagaaagccaggcacagctgcagtggtgtgcacctgtagtcccagccacttgggaggctgaggtgggaggatcacttgagcttaagagttccagaccagcctgggtattatagaaagactttttcccttg

SEQ ID NO: 240591 - DNA, 631 bp, Homo sapiens
gtgagatgaggatttctgtggtagggctgggcaagtagcagccagactccttaccttggggagagccctggatctacagtccctgggcaaggctgctgcattgcgcctcagactagctgctccgaaaaccaaggcagggctttagcttctcaccccctcatgaaggcagcagaatacagcggttggagtgctcttctggaataccacagacctgagttgtcttggctccagtatttagcatctgcgaccttggcggggtgatatttactgcctagtcttcagttatttttcagatttaaaatggggataataataatgcctgtcttataaagaggttgtaagaatttaaaaagttatgtgtgaagtgtattgctgttgttactatgcagcagggccctagaaaacctttctttctccattcagccaactgattactcattttgttttcagatcataaatattcacatcataaatgttaatgtgttctataccatgattgaaaatgtgtgtgttagtattgtagtaatactgtcttttggacccctttcttcaaaatatttgcaaatgtgtggtattttattctggcctcatgtggtacatataatgcatataattggattttcctgttata

SEQ ID NO: 240592 - DNA, 132 bp, Homo sapiens
cccacaaggaaagctctgctccctcctcacagctgagcccaggtcccagctcccacggcgcccttccctctgaaccctgcacatcaccaccccatccccaaccttcctgcatttaccctgcagttcttgcta

SEQ ID NO: 240593 - DNA, 370 bp, Homo sapiens
agactgcttagcatggctagccaggatgggcccagcactaaaagcacaaagttgtagactttaacgtcaaagggccaattaaagtgaaacgaatgaggcctgttctcatatcagcactgaaaacgtgctgctggtctgttacctgaacaaatatcttctctgatccatattggaaaaaagtaagaaggcaatatacatttctctctgtctctgcaataactaaaaactcctgcctttgatgatgagaacagaaattagcaattaacatgaccatttacaaagcatctttatatatagtcatgcactgcataatgttttgatcaacgatgggcatatatgatggtagtcccataacataataaaactgaaa

SEQ ID NO: 240594 - DNA, 358 bp, Homo sapiens
gctgtttcccggctggcaggatgtttgtgcacccagtcctgatagacatgcttttctgcatgctttcatttggagttccagcatccttttgggccagtccattgctgtcttgagtcactagtgaactcacacccaggacccatttagtgagtccgtcaggcctcaacctgcccattggctcacagaatggcccgtggcagtgggccatgtctctgtcaaatgggactgatcttgcaatgctgcattagccttcgacaggctaatggcttcatgcaggtttctctttcatcctgtgttcactggaagcagcaaatgtcatgaaatgccaaagtaaagatcgttgtctccgtcaaaaaaa

SEQ ID NO: 240595 - DNA, 281 bp, Homo sapiens
gtagagatggggtctcagtatattacccaggctgatcttctgagctcaaatgatcctcccacctcagccccccaaagtgctgggattacaggtgtgagccaccgtgcccagcctaaaaaccaggacttttctaagagaaagtagatcaaattattctttgagatgcctgatgtaatccatacgtcttccatgcccatgtatttatataaaatgtgtgaccgctgtattctgttaagacatgaattaaaaaaaacgttcataggctggttttcataactact

SEQ ID NO: 240596 - DNA, 412 bp, Homo sapiens
cttgactagtcagtagttaagtatacagaatgttctagacctaatgaactgaatacagataaatacaattttgttgttcttcatggaagagtgacatttcagtagatccccactctgccaggggaaggaattgtcaaggtgacttattcttttgagcaagttctgatagtaattggaaactggtgaattagaatggtaattaaagcccagtgaaaaatgacctcctactggaaaaactggaggaatacagaaggctaaaaatagtgaacacttaataccaacagattttctgaaggaagacttcttagtttctctaaatgggaaatcttacattatcctctaaaggaaaaataagcaagtagttgaggaaactatgtttttttttttccccctttttcttgagacagtctca

SEQ ID NO: 240597 - DNA, 340 bp, Homo sapiens
cttgaatgtcgacctgaaggggaattgttggctggatgcagtggctcatgcctgtgatcccagcgctttgggaggctgaggtgagtaacttgaagtcaggggttcgagaccagcctgggcaacatggcaagatcccatctctgaaaaaaatagggtgtggtggcatgtgcctgtagtcccagatacttggagggcagaggcaggaggatttctttggcccagaagttgttcttttaatttctggccttactgaatcactgggcccgggaattgcaggctgcagcaaaccatgatagtgccactgcatttcagcttgggtgacagagcgagaacttgtctt

SEQ ID NO: 240598 - DNA, 2074 bp, Homo sapiens
  misc_feature (1)..(2): n is a, c, g, or t
  misc_feature (4)..(7): n is a, c, g, or t
  misc_feature (246)..(246): n is a, c, g, or t
  misc_feature (267)..(267): n is a, c, g, or t
  misc_feature (1944)..(1944): n is a, c, g, or t
nntnnnncaactttatctagaatgagtcttgagctttggagactcctgtacttgaatggagaatacagcaggccatctggaactgtctaggaaatcggatgtagttttagggagaaagataaagttttgaatgtaagattcattccttgagattttattgtttagttatgtttataatattttgtgctgaagtcaattaaacaattgaagaaaataagtatgagatctccagaaatgaaattgtgnggtgaacacattagaagagcngacctactatgtcttcctccaaaactatcttagtgaaaagtccttgggaaagggtttcgcctttcatccaggatacagcttcagtgaggcagttctacacatgtactggaatttgctgtcttttcatgtcttggttaatttggaatttcatttatttactattttgatgtgaagaattgcacttcagattttagtaaattattgccatgtcaatatagttgcattctaatgataatatgcatcttttttaaaaaaggcttttttcaaaataattttgcttcatgattaatttgtgattgcacataattttcataattttagttcagacaatctttagacatgaagatacttgttgacagcacagtacctttgttcctctctagtaactcaatataacaacatcagcaaatattggtatgagttactattattaatgatttattttcataatctgatttcttttatttcattagttgccttgggtttttgtctgatttcagaagctacatagctatgtgatttttaaaatggcataataaagcataaaatccacaagatctttagttttggagaattttgaatgggagaattttgaagattgacctgtgtacccttaaaaggggaaatcaggtagaaagacagctgtcaagaagatgcaatggaattattaccaacagaattgaataaaacacattttacaaaaaaaggttaatatctactctaaaacgcactagtgtatgaccgaaaagcaatatttggaaatggaactgttatcaacaggaaaaacagggaaggatttaaaaaatgactgcaataaatacttatgtctgtagttgcatttggacaccattttgaaggaaccccttccacagaaaccagatgtgatttctgtttttctgtctggagaaagcacacatataatgaaaaggttgtataattattgcacttgtacagaagaatcttctcatgtaaatttaaatttcaataagttgctggattaaactttagcaagggaaaggaaattgtaaaacgtggtcttgtctttcattcacatgtttgtgttagtatgttaattatcctttttgggggcaggagaagtacaatgaagcataggccagcataaatgctacttatacaggaaccaataccagagccagactaggcttaggaaaccttaatggtacatttagatagataattgccatagcagtgaaacagtagaaacttattttttgtcagtgcaaagcaggtttactaattaccagtcccaagagaggactcccattgcatggggaatagcaaagatcatccttaggccaaccaccaaaaactcaaccaagggttttccagggttgcagacaagtcaagagagtggatatgatgcctcagtccgcaccatcattagctccagagggaaataggacaatgcgtgtttttagttccctagatatgtatttctatactttaatatttctgtgaatgggtgttgccatttggtgtaatcttttaggaaaacagattgtgtggctgggcgtggtggctcacgcctgtaatcccagcactttgggaggccaaggtgtgcggatcacctgaggtcagaagtttgggaccagcttagccaacatggtaaaaccccatctctactagaaatgcaaaagttagtcaggcatggtggcntgggcctgtaatcccagctgctcaggagactgaagcaggagaattgcttgaacctggaaggtggagattacagtgagctgagatcatgccattgcacttcagcctgtgtgacagagcgagactccatctc

SEQ ID NO: 240599 - DNA, 402 bp, Homo sapiens
acggctttttgaaacagggtcttgctctgtcgccctggctagagtgcagtggagagatcgtggcttactgtagcctcgacctcctgggctcaagtggtcctcctgcctcagcctcccaagtagctgggactacaggggcaccaccacactcagggcaaggacacagcctttcctctacctgtggaggagctgtgtggtttccaggaaaccaggccttttccagcctcacctgtggggtgttgtaacacccaggaacttggagaggcgcccagaacctgggcagggtcagcacacaagcacccattctgcgtaagacccaggcctgaggacagccctgtagaccacagaaccccacgggtcccgtccccaacaactggctccttcccaccctagggccttcgc

SEQ ID NO: 240600 - DNA, 349 bp, Homo sapiens
aaagacatcattagtcactgtcacacaggaggtccaaagttagaccctttataaaagcagttagagcgaagctgagggtaggggccattcccatcggtgcctttgttggaggggaccccctgccaaaatatgtcctacttgcagcagttaattttttttttttggctaggacccccactccctgattttcttttctcatcagataagccaatgtagtgattcccatgtctggcagggtgttgcacagtagactttgaaaacctgtagagcttttaaaaatcatgaatgcctggaacccatcccagatcaatttaatcagaatcactgggggtggaccccaggcttgatt

SEQ ID NO: 240601 - DNA, 311 bp, Homo sapiens
agctgggattgggccaggctgtttagtgattctcaggagtaggcaatgatcagttttttgatttaggcagcattacctgagtgttctttttttcgggggacaaatcactgacctatatatttttatggtgcactaatctatatgtctattaaattttacaataaaaaatagcaactagcatagtttctggcccacactaaatgttccatatattaaaatggaaggtattataagctcggaaaatacatttctcctcctcatctaggaaaggaaggattaagtgaaatgtttcctaagtgctttcctttttt

SEQ ID NO: 240602 - DNA, 421 bp, Homo sapiens
gaagcctattgttctacattcaagaaagtgaaaaggcaaacaaataaggtagtaatttgtcttccttacctgtttgccttttcaactagaagcctattgttctacattcaagaaagtgaaagtggctacacctcttagagaacatttctttaatgatacatcagtgagtatcttttatgggtaataatctacctattttaactagatacaagtatgataagaaagagacctttcagttaactgaagctaagctcatcctgtcttccttacattgctaatatctgacttacaatttactaatatttgtaaggtgtcatttaagtaggtgtggaagcattagcctagattttgactagttctttggtgtcttctgcagctcatagaggcactataatcacaacccccacccgcgcccctcgca

SEQ ID NO: 240603 - DNA, 1684 bp, Homo sapiens
gacaggggaagggcaagtatggaggctcaccctggaagagtgagcaggactctgttacctgcaaccccaagctttaggcagcaggacaagaggccgaggttgtgaaacaaacggaaacctcaacctgcctgccatcatcacaccctcctgccctgaaaactcctggaggcctttagaaaggaactgttctaccctgttgttttactaatgaggaagtgatggtccaagcagtcaagtctgcataaccatctaagcttctgaatctgctgctgccgacaagggaccagactcaccaccacaaaccagggcactgagaggtagaaccaggcagcccacgccacagatggcacagcaggatgaacacggccccatgagacagcgctgctgctctccgcatcacagcaaagtcaaggcaaaggaggatgggtgccaggggtgcctctgcatgaagtgctggaagcttggacattcctaggccagttaggatcaaaggctgagcactggctgcgatattagggccagttctgggttggctctgtctagccatcacattgtggtttttgctgttatctgctgttagattcggccggaatctaagggatagagatgtatcatgaggtggaagctcaggctacctctatcttagttacaacagtcagagctcatgatgtcatggtggcctctggcagcttgggttagaccaggtggttatttgccacctgtaggctggcactttctacaacactgtcacgcatcagggacgagggtaccgagtgagagcaaaggataggctcctgcaaactcatctcctctcctggaggcttaactgagtgactgtgggtcgctgggtgtattttaatctgtgacattccacactttgtgtactcaccagcacatacacggtattattgtttcctcagaagagtgtgtatttaaatacctgccaggaaactgtgcaggtatttcacattaagtagcatatggggctcagtgtagtcaagaagtcacagggattaggaaagagaaaatgaattgctgtcattctatatatgttatatgcttagtaaatgtcagaacagtagtcacagaacctcaggatgtttctagcatattttggcttataaatgttttgtctacataatggatatctatcagtagctttcagaattcaagtaattttaatgaaataacactaaatgttcaagtattaaaagtagtggtaacagttaacagctattgagtgtttactatgtcctcagaactatgccaagaactttatatatacttgatctcacataaaaaacaaataaggtagtaatttgtcttccttacctgtttgccttttcaactagaagcctattgttctacattcaagaaagtgaaagtggctacacctcttagagaacatttctttaatgatacatcagtgagtatcttttatgggtaataatctacctattttaactagatacaagtatgataagaaagagacctttcagttaactgaagctaagctcatcctgtcttccttacattgctaatatctgacttacaatttactaatatttgtaaggtgtcatttaagtaggtgtggaagcattagcctagattttgactagttctttggtgtcttctgcagctcatagaggcactataatcacaacccccacccgcgcccctcgca

SEQ ID NO: 240604 - DNA, 498 bp, Homo sapiens
cagggaaggcataggtctctcccaggaggctgtcagcagctgggaggccggcagcaaccccactccaggcctgaagtatctgccacctttggcaggctctgggccccatggaaaggctgaggggcgctcatcccgggttgccatccccagaaccggtgtgacaggccccacaagcacgcatgtgagtcagctcatgcacaggagagcctcatggagcctgcccggccaaggtccccaaccccagacccagcagctgccactgcgaccaccctgagagctgtgactgcacccaggcctgaacacacatgcatggcctgagatctgggggtgtcctccagaatgaggtggacccagcaggggaaaaggctttgcagggagcggtcacagcaggagtgccccacgtgcactgaacctgccctgggccccacctctcttcacatgggtgatggggggggtgccccagttttatgggatctaaggtgagagcattaaagacga

SEQ ID NO: 240605 - DNA, 454 bp, Homo sapiens
cctgaatttctaacatagaattatgggggttttgtttcatatatgtatttttttgtttgttaatatggtggtttgtttctttcttatctatctctctcttcagtaaaatataagcggtgaactttgcttattttatttaatgatgtatcctaagcctattaatagactgcctggagcctgatagacatcaatacatatttgttaagtatattaacatagtcatatttctgcttctgtaacttaaattaagaaatatgaactttgtatatcacaaagtgcacaacaatcaggaactgaatggaaaataaaccatataataaatagtaataaattacaataaatataataaataataataaagagctcctcttaaaaacttaaagtctctcaaaacaagtagccttaggattggagagaatcgcagcaggtgcaagcccaggaggtggaagccaaa

SEQ ID NO: 240606 - DNA, 499 bp, Homo sapiens
tacattctactattaaggctatttatgtttttattttaagtgttttgttgtaattttgaaaggatagtaaaatattttattattaatgtggaattttaaatgtttctaagctttttgatgaattgttgcttcagttgagcttattatccgtaaaacaaagttgatgattatggtgaaagaaagagtaactcaacaataatcatgcttactcttactctgtcatcttaacctacacaaaatcccagagaagttatttgctgtaagacaggctttataagaaactcagatttgaaatgacctagttgtctgcaatttgttataaatagaggggaaaaaagatatgtgtttataaccatgtaactgcaatatttttgaaaaggtgcttaaacttttgtcattaatagatttagtagtttttaatatgtagctttaaattgtccattttcaaaatcatatttttgtataaaaaatattttaaataaaaatattcacaaatatt

SEQ ID NO: 240607 - DNA, 399 bp, Homo sapiens
caatgatgaaaaggttaataaagcaggttaatcttaaaagcatgagaagtctgcagccattacattgtaactagcacaaaaaactgaaatatcttcccgtctttgaaaattatctaattttgcagtgagccgagatcacaccactgccctgcagcctggacaacagagcaagttgactccattcccctctaccccaaaaaaaatgtatctcaaccagtattcatgctacaaccaaaatctcaaatctacagtatgtatttgtcagtgacatgagcaacacctttgctgaactggatagtaataaaccattatgtgctgtctgattttataacactatcgttggtaactgtcacactgaaatatgtatgaaatttacaataaagtgtatattatttataa

SEQ ID NO: 240608 - DNA, 465 bp, Homo sapiens
agtcagagacaagggacctcattactcacagacagcaagcaatttgaactttatgttctcatcagtttttcttacccccaggtcccacggaaacaacacagggtgggcccagatggatgttgcatgtgcagtgagtttacatcacagctgaggaaacccccacaatcttaggaaaccccaatctttaaaatgggctaaaaatagacctgttcaacctttgcctgggagatagacactatctttactatactggacagccaacataactgacctttgctctaaaggaagacatcatcaccattttccaagaccattccctatacaaacattctggaaaacctagtctagaacaaaagctgttagttcatctgctcacaagacatgcaaaaatgtcagaccttttgaggattatctcctggcactgacctcaacaaaaggaaactaagatcatcttagtagatgcag

SEQ ID NO: 240609 - DNA, 334 bp, Homo sapiens
tcaaaagggagagggaaagggttgaaaggtaaccttaaagttttgaaaagtaggaatacaggaaaaaaaaaacactgtaaaagataagattagggggtagggataggagagtagctggtttacggcagaagataatgatttccagcttagtgtgctacacaccatgtaagtgaatgtgtcaggcagtagaggactttgaaagtgtaagaaacaatctttctaagaaagagcaggccaggatttaacgtgacattcttgagagtctaatggtgaatgttagcaatgacataatgacattgaagcctatcaggattttttagaggggaggtgataa

SEQ ID NO: 240610 - DNA, 294 bp, Homo sapiens
tagaaaacctaagagaaatagaaggtaattaaaagcagagagacaaaaggcatattttcaataagaaaaagataacagttctgtcagcaaatgtctcaacagcaaaaatagaagccagaaaacaagttttaaaatacatcaaaaatactaagagaaattaactgtcaaactggtattatacacctatctaaaccatcaaagaataatgaaggtaaaataagtatattttcaaaagcaaaaccaacaaacttacaaacaaaacccagggtatctaccatcctggtacccttacta

SEQ ID NO: 240611 - DNA, 590 bp, Homo sapiens
cgtttgatttggcctgcagtgttttcaaagtaggggagatgtcacataaattctgagtttgggttctctttacaaaatataattttttttttctttttacatttctttgtggctctggttggcaggagttgagtagatattgcccattagactggcaggtatccttgagtttgccagtctaaactactgcctgttgtcctgagcctagcttactttactcacttacattacctgccttatcctttagacatttgagtttgtggtctgttaagtgactgagctctcatgggattcaccagctgttacctaggtgagtatttgaatggatttttggggtggtggcagtggttgcatgttataggcaccagaaattatgttcagtaagccactaccagtacctgctgtgcaaagaaacatcttccttggggagtgaagaactaaccaccagttttcttgtgacatttgttggtttttttatccttagtttagtggataaaaataagcgtttaattagtgaaaacccgactacctcccaaccccgtctgtccagctttatgttgacctggcttttaaaatcatttatgtattta

SEQ ID NO: 240612 - DNA, 451 bp, Homo sapiens
cacggtgagcgttatctagtgattgataatccaggtgatcttgattacgcttctctaggtaaattacagattatcagtgtcgtctccctctcatgccccagaccatacttcctatttcactctttctagctctgaatccgtccgcggaactcacactgttggctcattataagcttattgccaactaaaactcctagctccatgcctggctgtctgggcccagcaggccctccaaatctatacttcggcagctaatgtttttttggttgtttcttctaaaggtgagacttcacagatggccctgttaaatttgcttttctcggccttggtccagcattgtacctggtcaaggtgactgagataggcgaagaaaggaagatgacagtacaaactataaggatgactataagtccaaaatgaaataaattcaaaataaagaggtctcaacata

SEQ ID NO: 240613 - DNA, 1384 bp, Homo sapiens
  misc_feature (750)..(750): n is a, c, g, or t
  misc_feature (894)..(894): n is a, c, g, or t
tttagaaggcagctatgatcaccactctatcaccaatgtcactaaaatcagtattcttgattgcctgctggaaataaaaatgtaattgctaaaatactcagtataagttaagtgatacgttacaagtaaagatctctcatgtgttaagtttcaagtttcacttaatgttcttaataaaataatggtaatttgaattctctacaaatacgttcagcctgtagtattctaatttacagatgcttgagaacacctaatatttttgattaacttaatgtcaaactattatcctaccttgtaaatagcatagaaattttaactatagtctttaaaaaatcaaatttcattggtagggaagtgtaaatgtatggtttttttaaaacacaacattaaaaggttgaggttataactttcataaagatgaaatcactatttaaaagctgcacatagactgattattattgtttgtttgtcttagaagatgtatctttaaattgctggaagacatcatgaatattttcattgctaattattggtaaagtctttagtatatgtcagttctgtttgtgtgggtatggttgctgtagtgcggcttaaaaaaaaacagtgcttcatatcagtgaaagctcttctttggtttaatctgggttgtggttatattgttttttcatatcgtgtgagctgattgcaaggggttaacccaaaatgagccacttcacttaaaattattctatatgttagtttgtgaattcngttgttggtatttaaacgtacatcatagtttaatcatatcacataaagttgtgatttcaggaatactttatatttcttttgctgtttttgcttgtgacaattgactggtccaccacatagaatttcttagtctttctaacactnggtgaacatttgaactgaccagatgattttatggaaacagcatgagacagtggaagtcaaatctctattctgtaccttgctttgcccctttctggctacaggagcctcagaagtcattcagagatgcagcaaagtgcaggggatcaaaccattgatcgctgaatttgagtcttacttttgtcatttattattagctgtgtgacagctagtaaattaacttaatctctctgtctctgtgttttcatttgtaaatggtattaatattagtgcctctcccccagcgttcttaagaagattaaagcggttgatatttgtaaagtacttagaatattgcctgtacagctaattatttaataacattttaatgtgatgtgacctcattagatctgatgtctacaaacagtactttgagtttgagaattgttatcattttaagtgtttcttgcctttgttttcaatacatcttgaaattattaaacttaaactggtg

SEQ ID NO: 240614 - DNA, 452 bp, Homo sapiens
tcaggagagacctcaagaacctggatgaagatgctggcaaagcaataggagactagatttgcaagcatttaacttcttcacatgtacattcgtagtagaaaggaaagcagtaagaatgatctaaggtttctctaattgaatgaccttggtggacagtgactaatatctctcatgagcataggttagaggcaaaaatcctcaacagtgtattagcaaatcaaatccaacaatgtattaaaaataattatacaccatcactacgtgggatttactccaggtatgcaaagctggttcaatattaaaaaatcaaataatataatctattacgtcaacaggttaaagaaaaaatcatacaatcaataggtgcagaaaaagcatccaacaaaatctaacacccagtcatgataaagtctctcagcaaactaggaatagagaacttcctcaacctgcta

SEQ ID NO: 240615 - DNA, 1038 bp, Homo sapiens
tcacatctttcacccccaatgacgcagttaatgtcctcaggtttatgaccagtgtaatctccgggcaggactcatcccttgagagcttttagctcaaggcagactgcaatacagcactcaaccagctctctctcctcgccaaacccatcctacccaacgatcctaaaggctaaaggaggaagtaaatttaaaaccctgaaactacagcatatcctgctgcattcgaagcgagtgtcatccataaaaacaaaacgtgacaccccaaatccatcctcactccaagctaaagccaattcctgcctgacccgacagttgacaggtcccccagatggccgggctttaacactaaaagtcattggcaccccctcctctttcccaacgacctttaatttgtgaagagccagacatgggttcctgaagatccttcctacaccccttgccccgaatgcagcagaggtgctcccggcagttactccggcgccccctaataagccctcgcaagggggtgcggaaagacccccagagcccgtcagagggggcttcggcgaccgcgaccctgcggctgtgtggaggacgagggaacaagccccaagggatgggaagggaggatgacgggaggcgcagcagacgcgtgtaacgaggggtcatctcccctcgaggggggtggagttgttgaggagggctaatcccctgccaccgctcccctgctaccctcaagtcccgctctggcctcgcgccccattgctcggattcactcccactcctctggggccgcctggaccccagagtgcccgcgagcccggcgcccctgcctcaagcctgggctcccagaccggcactcacccggcccgccatcttcgcggacacgtccggctcggcggctgcagctctgcgctcggcaaagcccgcccccgccgcgcgcgcgcccccgccgcccgccctcgcgcaggcgtgcaaccgccgtgaggacgcgcgcgtccctggccgcgtccccggcgtcctcgctccacagggcgcgcgcgcgggctcggcggccgc

SEQ ID NO: 240616 - DNA, 858 bp, Homo sapiens
tgcaggggtcagtcctggggggcaggggctcaggagagaagggagcagctggcatgtgggggtggggccagcctgcgttggggcaggagatgaccccaggacctccagtgatggtgacccttctagtgagaatgtcaagaagaactgcagagaggggagggaagagggtcagtgctgggacaggggtgggggcaagtagagttggctccacagagggctttgggcttctcatcccagcctgggaactgcggcccgtccccagcttaccagcaagacaactcagatctcagttgcagccagggtcacacacacacacgtgcgcacacacacatgcacacacacacacacacccatgtacacacgcatgcacacacacacatgtaggagcccagacaaccccccagaggccaagctggggtcatggggtccacctgccacaggcctcactgcacctttccgtgtgagagcccacccttcttgctcctccacactgtcagaccccactgggacaaggcagggctggcccaggtgacccggggactagataggaggacccagaagaaggaaactgttctgccccaggttcccccagggagaggccacctatctggggagacagctctgatttgggagaaagggagaaaggccctgttgggtgaccagctgtgcctctcgggcagggtcctcgggcctctgtgaccccagcctccctgcccatccttccactgcaaagccgctgggaccattggcagggaagctgcagagggcaggctttgcagactgcgaagcttggcaaacaggaggccattctgtgattctgccatagctcgaggggccgggggtccatttgtttgtccc

SEQ ID NO: 240617 - DNA, 855 bp, Homo sapiens
ccaccccccccacctgtttaccaggacccagggccgctatctccactggcatgtgggggtggggccagcctgcgttggggcaggagatgaccccaggacctccagtgatggtgacccttctagtgagaatgtcaagaagaactgcagagaggggagggaagagggtcagtgctgggacaggggtgggggcaagtagagttggctccacagagggctttgggcttctcatcccagcctgggaactgcggcccgtccccagcttaccagcaagacaactcagatctcagttgcagccagggtcacacacacacacgtgcgcacacacacatgcacacacacacacacacccatgtacacacgcatgcacacacacacatgtaggagcccagacaaccccccagaggccaagctggggtcatggggtccacctgccacaggcctcactgcacctttccgtgtgagagcccacccttcttgctcctccacactgtcagaccccactgggacaaggcagggctggcccaggtgacccggggactagataggaggacccagaagaaggaaactgttctgccccaggttcccccagggagaggccacctatctggggagacagctctgatttgggagaaagggagaaaggccctgttgggtgaccagctgtgcctctcgggcagggtcctcgggcctctgtgaccccagcctccctgcccatccttccactgcaaagccgctgggaccattggcagggaagctgcagagggcaggctttgcagactgcgaagcttggcaaacaggaggccattctgtgattctgccatagctcgaggggccgggggtccatttgtttgtccc

SEQ ID NO: 240618 - DNA, 451 bp, Homo sapiens
aatgtgcccatgaggttgtagaatatgtggcctgcacacccatacatggcagtcctgcctaaagggacccttctgtcttcacgcatgctaaaagactaatagcctgaaatagcctgggcatttcgagggaggaaaaagcagctccgaggcccacctggcctagcaaagaccatcttcactgatggctgcctcaggcaagaaacaagcactgtgaaccatcaggagcttatcagtagcttggttcacagcgtgaagcagtggaaagccacagggtataggatgcaaagtattgagttcacgtcccagttctgctgctactagctgtgtaatgtccaggcagatccctcgtaacttccccaagccttcctgtggtccctagtggctcagtgctggccgaagtttctacatttagagagaaacagggatgaatcttaaattcagctgattgaaa

SEQ ID NO: 240619 - DNA, 1934 bp, Homo sapiens
ggctgactctcttttcggactcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcagagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaacaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaatgaattccctatccctttgtacactggtctatttcttcaaaacattaaatactattgataagatatcaccttttataatttgtgttcattacagttctcttgtcatgaaatgcaaatgaaatgtagtatatactaacagcttttacagaaagactaatcctaagagaatcatatttttaaatttgaatttataataattatgttgtacattatggtttcgatatatgtatatgttgtgggatgagacacgctcttattttttaatttcatttattcatttttcagtttacattattgtcccctttgaagtaaaatttaataggatgttctcaaattttattgagggttgacagacggccaaggaaaatgtttatttttattttttcatcaaaatacaacttgcattttgattaacctttatattctaaaaagaactctttcagaatgcagtcagaaagggcaaataagtctctttcatagaaatgataaaatttccttcaacagacaaagagatcgatgggaaagtcatgtttttgcatttgtcacagctgctgataaactaagaacaaatcaagtgagacaagggaggagccattttacatataattcctgataagattatctatttcagcctccctctcttcccttcctttatggaattttgcattctcttactgcctttaatgttaccgtcctgttgcatatgtatttttaccatgcaataactcatatttattttaaagaactctagacttgaagtcagtggatcacaaggaatgagggggtttggatatgagacctaaatataatgtaaagcttattatg

SEQ ID NO: 240620 - DNA, 2222 bp, Homo sapiens
ggctgactctcttttcggactcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcaggagcttgctacacgtgccggaaatctggccactgggccaatgaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgccgagctttaggtaactctcacagtggaagagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaacaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaatgaattccctatccctttgtacactggtctatttcttcaaaacattaaatactattgataagatatcaccttttataatttgtgttcattacagttctcttgtcatgaaatgcaaatgaaatgtagtatatactaacagcttttacagaaagactaatcctaagagaatcatatttttaaatttgaatttataataattatgttgtacattatggtttcgatatatgtatatgttgtgggatgagacacgctcttattttttaatttcatttattcatttttcagtttacattattgtcccctttgaagtaaaatttaataggatgttctcaaattttattgagggttgacagacggccaaggaaaatgtttatttttattttttcatcaaaatacaacttgcattttgattaacctttatattctaaaaagaactctttcagaatgcagtcagaaagggcaaataagtctctttcatagaaatgataaaatttccttcaacagacaaagagatcgatgggaaagtcatgtttttgcatttgtcacagctgctgataaactaagaacaaatcaagtgagacaagggaggagccattttacatataattcctgataagattatctatttcagcctccctctcttcccttcctttatggaattttgcattctcttactgcctttaatgttaccgtcctgttgcatatgtatttttaccatgcaataactcatatttattttaaagaactctagacttgaagtcagtggatcacaaggaatgagggggtttggatatgagacctaaatataatgtaaagcttattatg

SEQ ID NO: 240621 - DNA, 2203 bp, Homo sapiens
ggctgactctcttttcggactcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcaggagcttgctacacgtgccggaaatctggccactgggccaatgaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgccgagctttagagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaacaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaatgaattccctatccctttgtacactggtctatttcttcaaaacattaaatactattgataagatatcaccttttataatttgtgttcattacagttctcttgtcatgaaatgcaaatgaaatgtagtatatactaacagcttttacagaaagactaatcctaagagaatcatatttttaaatttgaatttataataattatgttgtacattatggtttcgatatatgtatatgttgtgggatgagacacgctcttattttttaatttcatttattcatttttcagtttacattattgtcccctttgaagtaaaatttaataggatgttctcaaattttattgagggttgacagacggccaaggaaaatgtttatttttattttttcatcaaaatacaacttgcattttgattaacctttatattctaaaaagaactctttcagaatgcagtcagaaagggcaaataagtctctttcatagaaatgataaaatttccttcaacagacaaagagatcgatgggaaagtcatgtttttgcatttgtcacagctgctgataaactaagaacaaatcaagtgagacaagggaggagccattttacatataattcctgataagattatctatttcagcctccctctcttcccttcctttatggaattttgcattctcttactgcctttaatgttaccgtcctgttgcatatgtatttttaccatgcaataactcatatttattttaaagaactctagacttgaagtcagtggatcacaaggaatgagggggtttggatatgagacctaaatataatgtaaagcttattatg

SEQ ID NO: 240622 - DNA, 2031 bp, Homo sapiens
aaccccagccacatctccagcacacaagaacttccaaacgcctgaaccgcagcggccaggtgttcctccagaacctcctcccacaggagcttgctacacgtgccggaaatctggccactgggccaatgaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgccgagctttagagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaacaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaatgaattccctatccctttgtacactggtctatttcttcaaaacattaaatactattgataagatatcaccttttataatttgtgttcattacagttctcttgtcatgaaatgcaaatgaaatgtagtatatactaacagcttttacagaaagactaatcctaagagaatcatatttttaaatttgaatttataataattatgttgtacattatggtttcgatatatgtatatgttgtgggatgagacacgctcttattttttaatttcatttattcatttttcagtttacattattgtcccctttgaagtaaaatttaataggatgttctcaaattttattgagggttgacagacggccaaggaaaatgtttatttttattttttcatcaaaatacaacttgcattttgattaacctttatattctaaaaagaactctttcagaatgcagtcagaaagggcaaataagtctctttcatagaaatgataaaatttccttcaacagacaaagagatcgatgggaaagtcatgtttttgcatttgtcacagctgctgataaactaagaacaaatcaagtgagacaagggaggagccattttacatataattcctgataagattatctatttcagcctccctctcttcccttcctttatggaattttgcattctcttactgcctttaatgttaccgtcctgttgcatatgtatttttaccatgcaataactcatatttattttaaagaactctagacttgaagtcagtggatcacaaggaatgagggggtttggatatgagacctaaatataatgtaaagcttattatg

SEQ ID NO: 240623 - DNA, 1109 bp, Homo sapiens
ggctgactctcttttcggactcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcagagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaacaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaa

SEQ ID NO: 240624 - DNA, 1181 bp, Homo sapiens
ggctgactctcttttcggactcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcaggagcttgctacacgtgccggaaatctggccactgggccaatgaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgccgagctttaggtaactctcacagtggaagagaccttgaagatttgttgttcaaggagaaactgaagagcaagaaggaaagtgagagccagcaataccagcagagccagatctgagctgggagaaggggagaaagtttgtgaagaggagagacagggtcctgctttgttgcccaggctaaaatgcaacggtgctatcataatcatggctcactgcagcctcaacctcgtgggtacaaagtatcctcctgcctcaggctcctaaagttttgggattacagatggtattgcctggaagacaggattctgaaaccagcaccaactttccttctgccttctccttggtcagtgtggacagacaatcgctggagagcttgaaaaatacatcaaaaatactggaatgaaaaagagcaccatcatcttgaacacagttggaaagaaaaagcacagatggaggaagacagcgtcacgccccaatcacctggtctttcctcaggagatggtgcccccctcttttatacctttcttgtactgaaccctagaaacaataccttttggccaactcacaatgtgacatttgttcttccagttcaattttacttccccaaccctttactttaatgtttgattcctcctgagtcaaatgaagtgttttcatgggcagaaa

SEQ ID NO: 240625 - DNA, 920 bp, Homo sapiens
  misc_feature (920)..(920): n is a, c, g, or t
catcttggctcctgtggaggcctgctgggaacgggacttctaaaaggaactatgtctggaaggctgtggtccaaggccattttgctggctataagcggggtctccggaaccaaagggagcacacagctcttcttaaaattgaaggtgtttacgcccgagatgaaacagaattctatttgggcaagagatgcgcttatgtatataaagcaaagaaagaccttgaagatttgttgttcaaggagaaactgaagagcaagaaggaaagtgagagccagcaataccagcagagccagatctgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacaccgaggaagaggaggaagatgaagaccaggactacagctttcctatatcttctattctagagtggtaaactctctataagtgttcagtgttgacatagcctttgtgcaaaaaaaaaaaaagaaaggaagaaatttttggtctcgggaataggtgttggtatatgggggggaacatatccttaagggaccctggcctaaagcccctcccaggccctggttactcatgggaaccggaaaggctcaatggaaggctaccggtgagcccatcttgaactgttaccctctttatcggtcggtcaactaccaaaggcgggaggaccccgttgaacatttcgaaagcggcatgcgacctcgcgaaactttgtaaaatgcctgagacagtgccaggaacataggaggcagatttggcgtaacctgtgccgacacctgcaccagatattgttctttcn

SEQ ID NO: 240626 - DNA, 392 bp, Homo sapiens
gctaaggccagagaaggggccagaggggtgaacagggagaagacagacagtccgggtccatggcccagctctgccactggccagctctacaatattggcaattcactgtacctctgtgagcctcagttgcctctgctgcaaaagaagaaatgcccatggtgaggatgaaatgaggtattttggtgtaaagctcctggcatgtagagggcaccaacaagtattggttttagaggcatctggagccccagttttctatgtgacctccactgaggtgggagaaagtttttaactccccccgatactccaccagactcaccacagtttccccagagtctctgatcagggcaaactatttgtgtctaattacattaaattgcataatattttcaccg

SEQ ID NO: 240627 - DNA, 346 bp, Homo sapiens
caactgttacatttcaaaaagctttccttttctcaactttataggtgcaatgttaccactgtgaagttctagatgaacatgaaataaaggaatttattaaacataattccttggtgctccaactcgtacgctacagaatagcaaagaaggcacacatattcatagtaactggatattttgccttttgggtgtgactatattgggttatatgctatctaacacagaagttttgaggtacagatctgttttggagctggtaagaccatctactcctctatacgcttcgttttacaaaaggggaaattgagataagctgacttgccagttactggaaagaaatctggca

SEQ ID NO: 240628 - DNA, 380 bp, Homo sapiens
tcagcactgtgcaaacccatctgggtactgttcagttctttgaatgctgcttgacacggacaaacaagagggcattaaaaggggaggtcacagctgggcgcggtggctcatgcctgtaatcccagcactttgggaggccaaggcgtgtggatcacatgaggtcaggagttcgagaccagcctgaccaacatggcaaaaccctgtctctactaaaaatacaaaaattagccgggcctggtggtgggtgcttttaatcccagctacttgggaggctgaggcaggagaatcacttgaacctgggaggtagaggttgcagtgagctgagatcacgccactgcattccagcctggtcgacaagagcaaaactcaatctcattaaa

SEQ ID NO: 240629 - DNA, 377 bp, Homo sapiens
cacccaggcaagcttgcgtgactaacggaggagcgtctccccttagattcttcccgcccggagccggggacagcagaaaaccacctgacctccagattctctctcgtccagtggagattctcctgcccgaaggcaggcgctctccaaggtccctctccccagaagagccacgatcccaggaagccggcttgtgcagaggaaagaaccgcacctcgttgtcagaacaaccccagctctgccacctacaccttgtgtgaccttgggcaagtcagagaaacttctcagatgcacaatctcgtcacgctcctagtttccaagcccacacacctgagggtcaatgtcccttattgcacccccaccccataccgactccatca

SEQ ID NO: 240630 - DNA, 393 bp, Homo sapiens
aggcaggaaagcttgaagcaaaggcaggaagactccaagcagggagggggcttgcaggtcacagataggtgagagacaaagggtcccattcttctgagtttctgatgagcctttccaaaggaggccatcagatctgcattgatctcagtgagcagagggatgactttgaagagaatgagaagcaggtttgccctaacgcagcttgcgttttccttgtagcttagtgatttggggttcaagatattttcctttcacccctcattcttctcctgaaccaacagaagaagagatgcagagtgccgttgatcatttaaaaggctggacttcaaaactgccctttggtagtgacatcctgatattccaattctgtcccatagctacttgcactttaac

SEQ ID NO: 240631 - DNA, 484 bp, Homo sapiens
tggtaagcgagcagcctagaaagtcaaacaccttgctgaacacctagaggaatttgcagccacctctgtgaggtggaaaacatacaagccagacccctgttcttttgactctgaaatactccatgggggctggccaggaaagaggtgtctagaactgtttaaaaagataaatgctaggtcgggcgcagtagctcatgcctgtaatcccagcactctgggaggccgaggcgagcggatcacctgaggtcaggagttcaagagcagcccgaccaacatggagaaaccccgtctctactagaaatacaaaatcagccgggcgtggtggcgcatgcctgtagttcagctactcaggaggctgaggcaggagaatcgcttgaacctgggaggtggatgtggaggttgcagtgagccgagattgcgccattgcactccagcctggggcaacaagagcgaaactctgtctccacacactaaataaataaat

SEQ ID NO: 240632 - DNA, 728 bp, Homo sapiens
atttcatagtagtcatgcccaagaattctttagacagtgtcaaatatgaatacaaattagtaacttatactttgtttccttccaaaacaatttttgtgattttaaaaattagacataagctgtttgcaacaaatttactaaatccatgtgttatctgtaggaggagcaaaatatcttaggaaaagaaaatatatcaacattattttatcagtgagatactttagtaggaaaaaaaaagtttctaaagatacctgagacttattatacagatgttatcatgtaactgagttcttctcaagttgacatttcttacatgtgattgttggtttttacttctcactttcaaagtaaactcattgtttgtcccaaaactcagaatgaattatagttacttgattaggaaaataagttaatagaagaaaccatatgatagaatgtcagcaatttttcagtcaaatagaaaataatcttcatttgtgaacgtaaaggttttcctataactaataactctctatttcctatttcagaggctggcataatcttgttctaaaatgcttatatttgcctagtttaacccctcagtaccacagcagtattctctatctgaattagaatttgtcaaactagacatttgagtgaatagagattctgtagcttgtttatctgaaaaaaaccaaaaaacaaaaacaagttcttctagttgcttgctggaagctcagttgactgtt

SEQ ID NO: 240633 - DNA, 501 bp, Homo sapiens
attgatctaagagaggttaaacatgaattggaaattccttctccgatatcaggtttgatttttcacaaatatcaatgtttatgaaagtattcctaaaatttcaggtaaaaccacccaataatatgactgtgaaaaattatgcttcttcctctatgagctactacattcttaaattatctgagcattctattaaaacttaaaaaaatgcttaacttgagtctgcatgaatctgaattccctgcatatttaattttaaagaaaatagtttatttttttgttagaccaatactttacaaacttccccaaccaataagaaagaacaaagaggagaacatgaatatccctgggtatttgtgagtaaatccccaagagactaaccataaatgtgaaatttctttataattgtatgtcttcttctaaaatattcatgtggattgtgcattctattctatcttcttattttaataaaatctgttttaaattatttacttcctggaaaca

SEQ ID NO: 240634 - DNA, 106 bp, Homo sapiens
gggagtatgcagtaagatgaaaaatagtcaaatgagaaggaaggtcagtaataagttatttagacctggttaggcagcagggtctccaaatgcagctgcaattggt

SEQ ID NO: 240635 - DNA, 647 bp, Homo sapiens
attgcttgaacccaggaggcagagactgcggtgagccgagattgcgccattgcactcagattgcgccattgcactcctgcctgggcaacaagaacgaaactttgtctcaaaaaaaaaaaaaaaagtgaactgtggtttatctgattgctttttaaatgtcattcttttaggttgcagacaaaaatgttacctaggtgcaatacatgatcacttatatactgaacgtataatttctatatttatcttttatgtaaattatgatgttataagatttatttaaacagttttcttcaagaagctggttagtggcgaacgcctggacttggaagccaggctacatgagtctgaattctggctttgctatttattagttggcctttggacaagtaactgaatctttctgtacagcagctttttcctctggaaaaaaaatgcttacctcaaaattaggtgtaaggattacatgagttatcacttgtaatttgtttagaaccatacgtaatatgcattatttaagggtttattactattatttgtaaatattactgcctatttgtaacattagttaaaacccgaataagaaatagactatggagagggaaataatagtgttcattatgacctttcacagcacggaaatgtaagct

SEQ ID NO: 240636 - DNA, 295 bp, Homo sapiens
gcgcacttaacattttaatttgtgtgcacgcactactttttaaaaaataatattttaaaaagtggaagcttacattatgagtttacattattgccagtttattatcaatgaaaagctacaatattatttcaactacagataattattaagaaataaaaggaccccagtgtgcctgctgaacaaagagagaaggacattttggagaccataaaacattctacattggcttttgatgtgtctgaagtgaaacatacatacttcccagagaaaggtagtaaaacaacctgtaaactta

SEQ ID NO: 240637 - DNA, 498 bp, Homo sapiens
tactcaaagcccactgatttcaatataaacctcatcccaaaacaccctcccagaaacatccagaataatgtttgaccaactatctgggtactaaagcccagccaagttggcacatcaaattaatcattgcagggtgtgagcaggagaaaaaagaagagatgagattgccctgagcccaaatccagaaagcagggcacaaccaagagagctaaagacccctgggtaaagccacctcctgcccccaagtccttccctgacgcagacttgctggacaaccaggtgcgtcaacatgcaggtacaggggcagacccttctcccttccctcctcctccatgcctttcacaactatttgctgagtgtcactgtgccaagccctggggctaaaactaatcaagatttggttcttctgtacacttaaaagtggttaaaatggtcaattttatgttacgtatattttaccacaatttaaaataaatttgaaaaaaaattaaaaaaaac

SEQ ID NO: 240638 - DNA, 483 bp, Homo sapiens
ccaaaaaaaaacccctttttgtttcccaacccccttcccgaaatccagaataatgtttgaccaactatctgggtactaaagcccagccaagttggcacatcaaattaatcattgcagggtgtgagcaggagaaaaaagaagagatgagattgccctgagcccaaatccagaaagcagggcacaaccaagagagctaaagacccctgggtaaagccacctcctgcccccaagtccttccctgacgcagacttgctggacaaccaggtgcgtcaacatgcaggtacaggggcagacccttctcccttccctcctcctccatgcctttcacaactatttgctgagtgtcactgtgccaagccctggggctaaaactaatcaagatttggttcttctgtacacttaaaagtggttaaaatggtcaattttatgttacgtatattttaccacaatttaaaataaatttgaaaaaaaattaaaaaaaac

SEQ ID NO: 240639 - DNA, 452 bp, Homo sapiens
ctcggcctcccaaagtgctagaattacaggtgtgagtccccaccaccacatctggcctaggactctgtttttttttttagacaaagggtgtgagcaggagaaaaaagaagagatgagattgccctgagcccaaatccagaaagcagggcacaaccaagagagctaaagacccctgggtaaagccacctcctgcccccaagtccttccctgacgcagacttgctggacaaccaggtgcgtcaacatgcaggtacaggggcagacccttctcccttccctcctcctccatgcctttcacaactatttgctgagtgtcactgtgccaagccctggggctaaaactaatcaagatttggttcttctgtacacttaaaagtggttaaaatggtcaattttatgttacgtatattttaccacaatttaaaataaatttgaaaaaaaattaaaaaaaac

SEQ ID NO: 240640 - DNA, 411 bp, Homo sapiens
tctctcccaccctatcctcatccttgctagccaactcttaccttaccttaatgacataattaaatgactataaagttccataactcttgctcctttaattaactggaggaaaacctcttatcttctcaatgttgaagattctgctgtttcactttgaatggtattgttccgtctcctttgtaaaactgtgaggagaacttattattttaaataaataaatgtgaattttagtggaaacataaactttccattagctatagaaatcatctctaaaattggttccatatatccacctgttaattttcactaaaggttgttgtagatagcaaatataaagttaataagcaccaaaatcactgagccatataattctcttgaaaatttttctggactcaggaggtgcagcagcac

SEQ ID NO: 240641 - DNA, 439 bp, Homo sapiens
caggtagactcttgacaaactcctggagtttagcagaaagggatgagaacccaggaagactaaagacaaataaatttgaaagatctagtaataaaggagagaatgctacacagagaaatactcccacagatctccaaaggagaatatttctgaatattcggcaaagtgttcaaaatgtgtaaagaaaacatgtgaggctggggaaagaatcacccaaaaggattacagagaatagtaccaggcattcacacagggatgggaatagtgtctatttccaccagtgagactgcaaaatctcatcaatttacatgatgttgcatagagcagtaagaagggttgtgtagtaggattagttagccccaaacattcgtgtttccacctagcaaatcttaaacgcaaggcccaaaaggattaagccatttcgtggtaatttaatttt

SEQ ID NO: 240642 - DNA, 510 bp, Homo sapiens
  misc_feature (505)..(505): n is a, c, g, or t
  misc_feature (507)..(507): n is a, c, g, or t
  misc_feature (509)..(510): n is a, c, g, or t
aagtaacttgtcaaaagtcacaatactgggtggagcttggattcgaactcaggcagtgggtcacccgcggcaggcgcgggctttgggtcgagccaggggcattaggtgaggagaggcactaggcgaggagaactcagcattcggacccggctcccactctcaccccggcatgcagaccgatggaagaggctagtggtctgctgggaagggaggtggcccgcgtagcgtcccctccctcgctgagcctcagccacccctcccagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaagttctggtgcagtcagtgagcgcgcaacgtgcggggtgggggataggtggggaggcttggngngnn

SEQ ID NO: 240643 - DNA, 1394 bp, Homo sapiens
  misc_feature (1034)..(1034): n is a, c, g, or t
  misc_feature (1047)..(1048): n is a, c, g, or t
  misc_feature (1062)..(1062): n is a, c, g, or t
cccgccagctcccccgttccccgcggcgcccggcccctggctgcgcagacccctcttcagcctgaagctgtccgacacagaggacgtctttcctcgccgcgcggggccgctcgaggtcccggccgacagccgcgtgttcgtgcaggcggccttggcccgtccctccccgcgctggggcctggccctgcaccgctgctcagtgacgccgtcctcacgcccggccccggggcccgccctggctctgctgcgtgagggctgccccgccgacacctctgtcgccttcccgccaccgccgccgccgagcccgggtgccgcccgccccgcgcgtttcagcttccgcctgcgcccggtcttcaacgcctcggtgcagttcctgcactgccagctgagccgctgccgccgcctccggggagtccgccgggcgcctgcgcctctgacgccgccgccgccgccgccgccatcgcggtgtctgcctcaggacgaggcgtgcgccgacactggcagtggcagcgccgagggcctggctgctgacggcccccacctgcacacgctgacgcagcctatcgtggtcaccgtgccgcggccgccccccaggccgcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcagcgccccacgcccctggcccgcccgcgagagcctcgcccagcggtccccagcccaggaggtcccagtgaggaagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctttaaaaaaaaaaaaaaaaaaaaaaaaaaanacactggcccccnntttacaaccgcccnactggaaaaaccctgtcattacccaacttaatcccctttcattccattcccctttccccacctttttttaaacattaagaggtcctaacaaaatcgccccttccccaatgtttcctcaccctttatgggaaatggcaatttttaaaccgttaaattttgtgttaaaaatcggggtaaaattttggggtagacagtttttttttttaaccacataggctcaaacttggacaaaatcctttttaacccaaaaaataaacccaaaattggtcgcgggttttttccttttgggacccgggttctttttttaaacgtgtttttttacgagggcgacc

SEQ ID NO: 240644 - DNA, 513 bp, Homo sapiens
aaaatgagtggaaatgattattttttggagatggtgtgttgaaactaagtaactcattcctcatcacacttttcatccactagctttagcatttgttgatttttcttggttgaattattacttaattatttctattgatgattgctgaatggtggtctttctaattttattacattcattagttgacattctactgtaagaaaaagctttctcttcctcccattgttgatttatttgtttatctttgtttttatggactcatggttttcttctttctttttttttttttttttgtttttgtttttgtttcaggagatgggatcttgccatgtcgccctggtgggatacaaacccctgggctgaagtgatcctcctgcctcagtctcctgagtagctgagattatagctattgggcctaacttcattgtttcattttttctattcagtgggcctgtaatccaacattatttttattttgatgctcaaattgtcccatatttgataagtggaatc

SEQ ID NO: 240645 - DNA, 253 bp, Homo sapiens
tcgatacggctttgtttgggtggggtgtgggttgtttttgtttttgtttcaggagatgggatcttgccatgtcgccctggtgggatacaaacccctgggctgaagtgatcctcctgcctcagtctcctgagtagctgagattatagctattgggcctaacttcattgtttcattttttctattcagtgggcctgtaatccaacattatttttattttgatgctcaaattgtcccatatttgataagtggaatc

SEQ ID NO: 240646 - DNA, 342 bp, Homo sapiens
gtttcactctgtcaccaggctggagtgcagtggcgctatctctgcttagtgcaacctctgcctcccaggttcaagcgattctcctgcctcagcctcctgagtagttgggattacaggcatgcgccaccatgcccagctattttttgtatttttagtagagacagggtttcaccatgttggccaggatggtctcgatctccttaccttgtgatccacctgcctcagcctcccgtagtgttgggattacaggcgtgagccaccgcacgaggcctgcccttgccatttttgtggccctgaactctgcttggcttctttccacttaaccccttctgtcgtcttctc

SEQ ID NO: 240647 - DNA, 1686 bp, Homo sapiens
tactatcaaggacacccagccaactaacatttagaaagcaaactctttattattaaacattaacatatttatcgacgtgtgaacattctgggacaaaatcatctgcccacttcttgaggggccattgttagaacgaatattccaaatgttctgcccatattgcatttgggggaagaaactgctctgctaaaccaaagaaacacaaaatgtaagaactagtgggcagaatcatcagcagagagccccctcactgtcacatcgcccttgtgaggcactcagaaaagctacagcagtcacttacatgacaacaccaactttcaatgtattggttcacatattttaattacatcttggtccctaaagaagcctgcagccagcaaacagacccaggcacgaaaagtaaatgagtctcaaactgattagcccaataggaattggacaaccccttaaggggctctagatggtgaaggacacgctgtttgccctgccattctgcagcacaaaaatccaggcaggtcgaagagggcggacaccctcgcgtggccaccagcccggagccgcagctcacacagcggcctccaaggcgtttcgcaggcagtccccacagtggttcttaaagcggccgctctcgccaataattgggagtctaattacgcaacgttcttcccgctcccattcccgcttcttctctctttccaacagtccgctaacgaaccaggtactgtagctgggtgtgtcgaaatcatttttcccctgctcccaagtttctcggtatatacggtacaaaactgcacaaaacccggcgctaaggagcgcaggaggagctgacacttcacacatttgtcaagattactgtcaggccccacctcggcgattgccacattcccgataggcatcgcagttgtaaaatacacaagttccctccccggctccggacccgaaagcgtctgcaggcgctgtctataactttgcttttcgatggttcagtcattattagcattatgattggtttttacaaaacgcactggaatcttaagagtcttttccttgctctgctgccttcaaaagacatggaaccccaggactgctccgagggcccctgggaatgtgccggctgcagtctcagggctccctcacttgtcttgggtctgagggcgcgacggtgacgagaaaggggggactacggccaggaaaggggagcagggcccaatcccctcccctagcgatcccgcagtgaagggcccgggcgccgagccaggacaggcgcgattcgctcccgtttatcaaatccttatcggtgccccgaggtgggaaccgctgctttcgaccggaggatacacggtttctggctccagtcccgtagtggaagttggaacaagagcaaatcaacctcggcagtgagccctcccggccagtcacctccctcccttagcgagtcggtcctcctcatcctcgcacctctataccgccgctccgccgctggtttcccgcggctcaggcggttcagccggccgcgcgttggattccagcttcccgcagcatagcctcgccaagccgcggccaagcgcggggctggaagctccaggccactggggccgcacgggtggagacaggaggagaaaggggacaggcggcgagccgcacacatttgcagaagttgaggccctgcctgcttctgcgcggccg

SEQ ID NO: 240648 - DNA, 1459 bp, Homo sapiens
tactatcaaggacacccagccaactaacatttagaaagcaaactctttattattaaacattaacatatttatcgacgtgtgaacattctgggacaaaatcatctgcccacttcttgaggggccattgttagaacgaatattccaaatgttctgcccatattgcatttgggggaagaaactgctctgctaaaccaaagaaacacaaaatgtaagaactagtgggcagaatcatcagcagagagccccctcactgtcacatcgcccttgtgaggcactcagaaaagctacagcagtcacttacatgacaacaccaactttcaatgtattggttcacatattttaattacatcttggtccctaaagaagcctgcagccagcaaacagacccaggcacgaaaagtaaatgagtctcaaactgattagcccaataggaattggacaaccccttaaggggctctagatggtgaaggacacgctgtttgccctgccattctgcagcacaaaaatccaggcaggtcgaagagggcggacaccctcgcgtggccaccagcccggagccgcagctcacacagcggcctccaaggcgtttcgcaggcagtccccacagtggttcttaaagcggccgctctcgccaataattgggagtctaattacgcaacgttcttcccgctcccattcccgcttcttctctctttccaacagtccgctaacgaaccaggtactgtagcgctgtctataactttgcttttcgatggttcagtcattattagcattatgattggtttttacaaaacgcactggaatcttaagagtcttttccttgctctgctgccttcaaaagacatggaaccccaggactgctccgagggcccctgggaatgtgccggctgcagtctcagggctccctcacttgtcttgggtctgagggcgcgacggtgacgagaaaggggggactacggccaggaaaggggagcagggcccaatcccctcccctagcgatcccgcagtgaagggcccgggcgccgagccaggacaggcgcgattcgctcccgtttatcaaatccttatcggtgccccgaggtgggaaccgctgctttcgaccggaggatacacggtttctggctccagtcccgtagtggaagttggaacaagagcaaatcaacctcggcagtgagccctcccggccagtcacctccctcccttagcgagtcggtcctcctcatcctcgcacctctataccgccgctccgccgctggtttcccgcggctcaggcggttcagccggccgcgcgttggattccagcttcccgcagcatagcctcgccaagccgcggccaagcgcggggctggaagctccaggccactggggccgcacgggtggagacaggaggagaaaggggacaggcggcgagccgcacacatttgcagaagttgaggccctgcctgcttctgcgcggccg

SEQ ID NO: 240649 - DNA, 1070 bp, Homo sapiens
tagggtcttagggagtagggtcttgggagtctaattacgcaacgttcttcccgctcccattcccgcttcttctctctttccaacagtccgctaacgaaccaggtactgtagctgggtgtgtcgaaatcatttttcccctgctcccaagtttctcggtatatacggtacaaaactgcacaaaacccggcgctaaggagcgcaggaggagctgacacttcacacatttgtcaagattactgtcaggccccacctcggcgattgccacattcccgataggcatcgcagttgtaaaatacacaagttccctccccggctccggacccgaaagcgtctgcaggcgctgtctataactttgcttttcgatggttcagtcattattagcattatgattggtttttacaaaacgcactggaatcttaagagtcttttccttgctctgctgccttcaaaagacatggaaccccaggactgctccgagggcccctgggaatgtgccggctgcagtctcagggctccctcacttgtcttgggtctgagggcgcgacggtgacgagaaaggggggactacggccaggaaaggggagcagggcccaatcccctcccctagcgatcccgcagtgaagggcccgggcgccgagccaggacaggcgcgattcgctcccgtttatcaaatccttatcggtgccccgaggtgggaaccgctgctttcgaccggaggatacacggtttctggctccagtcccgtagtggaagttggaacaagagcaaatcaacctcggcagtgagccctcccggccagtcacctccctcccttagcgagtcggtcctcctcatcctcgcacctctataccgccgctccgccgctggtttcccgcggctcaggcggttcagccggccgcgcgttggattccagcttcccgcagcatagcctcgccaagccgcggccaagcgcggggctggaagctccaggccactggggccgcacgggtggagacaggaggagaaaggggacaggcggcgagccgcacacatttgcagaagttgaggccctgcctgcttctgcgcggccg

SEQ ID NO: 240650 - DNA, 2133 bp, Homo sapiens
  misc_feature (1110)..(1110): n is a, c, g, or t
  misc_feature (1177)..(1177): n is a, c, g, or t
  misc_feature (1338)..(1338): n is a, c, g, or t
  misc_feature (1444)..(1444): n is a, c, g, or t
ctcacaactgccccatgcccctcaatccacgctcatgcacctgccctgtctctgtctcctgcctccagaccttccgtcataagctggtggagcctgtctgtgctttctggaactacagtatcagatgagtttccatttccaggttcttttttttttttttttgagatggagtcttgctctgttgcctaggctggagttcaatagcacaatcttggctcaatacaacctccatctcccgggttcaagcaattctcctgtctcagcctcccgagtagctgagattacaggcgcccgccatcacgcccaactaatttttgtatttttagtagagacagggttttgccatgatggccaggctggtctcgaactcctggcctcaggtgatccacccacctcagcctcccaaagtgctaggattacaggtgtgaaccaccaaacccagccgttaagatgatttttttaaaaatatgtccactctgcttggggatgaggcaagacttacacatggttttgacctctgttcaccatctgcctttcagggtgactccaggctcctcccagctctaagacaagctgcagcgggaggatgtgttacccagggggtagtgagctccttgtcataggagtatgtgaaggaggaagcactcactctgtgaggtgcctaggaagagaatcatctgtcaaatgggcgttgaacttgatctatctgaggccggggcccgtggactcttgaaggagcagagcaggctccagggattatcctggctccctgccctggatctttagctgaggtagggaaccttggtcccagtggctcagtaattaattaagttgataaatgacagtcactgggatcagccctgccctcctaccatcctaagaatgtcaagcacattttacaggtgaaaaactgagacccaggaaggggcggtgactcgccaaggtcacctagctggttagaggcagggcagtgacaggccccaggctctggggaaagcctttcccctgcttgcttctggcccctcacccccttgtccaccttatctcaagagccccctgttccctccccatcccccaagcccatatacagggggtgcctgggccaccacnggctgctccgtggctgccctgtacctggactccaccgcctgcttctgcaaccacagcaccagctttnccatcctgctgcaaatctatgaagtacaggtgagtgcacggtgggaggggggtgtcaggagggggcttcttagctggaggtgaagagaagagccaataggtagccagaagaagcatctgagggatgccagctttcatagattgtcggggacagggctgcangcagtagttcatgcctgttgtcccagcactttgggcggctgatcacttgagcccaggagttcaagaccagcctgggcaacatggcaaaaccccgtctctaccaaanatgcaaaaattagccaggtgtggtggctcgtgcctatagtcccaactattcaggaggctgaggcaggaggattgcttgagcccaggaagtcgaggctgcagtgagccaaggtcacaccactgcactccagcctgggtgacagagcaaaaacctgtctaaaaataaatgagtaaataataaattgtaaaaaaaattgttgggggaaaactctaagaggatgtcaggaggggtcggattcactggagctggaaagggccccggagtggttacttgctgagaagtcaggtgagatgggacgtgagcctcaggaacgctggggtcactacaaggaacaccttgtagtgttgaggggcacactacaaaaacatgttaccaaatgcatttttcctgtagagtcagggccaggcacggtggctcccacctgtaatccgaccactttgggaggccaaggcaggcggatcatttgaggtcaggacttggagaccatcctggccaacatggtgaaaccccatctctactaaaaatacaaacattagccgggcatggtggcccgtgcctgtggtcccagctactcgggaggctgaggcacaagaatcacttgaacccaggaggcggaggttgcagtgagctgtgagctgagattgcgccacttgcactccagcctgggtgacagactgtcttgaagcaac

SEQ ID NO: 240651 - DNA, 441 bp, Homo sapiens
actccccagctccttggtgcagaagttctattagggcagagcagcaggctgtaaggagagtaagctccactgctggagggagctgactttatttggagcagattaaggaaaatttcatgcctgggacattgtcaaaaacaatagtgatctcagtggcaagcaatcagacaagtgcaacatttcagtagcctgaaaccttgagtcttgtggggcaaacaacaatctggtagacaagccaggaatgtaacaggaggatccaggggatgagaaagccaaagagggccttgataagatcctttttatctcttgtggtctggaatactgtgtttatgtgaaggctgcacgtatggtcatgagagaccagagagaaccctaataactacttgtctctagctgaatgtgagacctcatgaatgcagaaagtaaaagctagggcagact

SEQ ID NO: 240652 - DNA, 459 bp, Homo sapiens
gagcgggcagggcggggtctctcggaactcccacagctggaggtgcggtccccggtgtccttccagcaggaggagagaccgggcttgcgctgtggccgccagggggcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaa

SEQ ID NO: 240653 - DNA, 406 bp, Homo sapiens
ctggctgtatatgaacatcatatgtaagtgagagagacagccaaagggtagctgaaatgactgtgagtgattctcactgcaagctctactgtccaaacataattttttaaaaattcaaattctgttggcagtagttcagaagataagtaaattcagatttttctcaggacagtttgtgtctgtatcagcctctcttaaatatttaaactgagaattagttatcttgaataagcagataattgtaaaggatgattttcatcattatctgcttataaggcatgtaagaagtttatgtgttcaattggtggtaatggtttgatactacttggaaaacacttgtctgggaaggtaatgttcactcgacctgccactgcttggaattgggagatcgttttagtcaaattga

SEQ ID NO: 240654 - DNA, 289 bp, Homo sapiens
cttcaaccagcgccactctcagcctcccctctgccagcgcttctgtggctgcacctgcattcgtgggctgtggctgggaagcacaggaataattgatggctcgtggggcactttgctgggctgcttccagaaaagttgacccctccctgcaaaccagcactgcccagcattcttgtcccgccaagcctgactgcgagctgttgtggcattgccactttgcttggaaaggaccccttatctttcatttcccttgcatttctttcaattctaccattcaccatttctcata

SEQ ID NO: 240655 - DNA, 419 bp, Homo sapiens
cagtgagctgagatcgcaccactgcactccagcctgggtgacagagtgagactttgcctcaaaaataataataataataataatgatgacaacaaaacaaacctataaggattttgactgggattgcactgagtctaaagataagtttggaaaaagccttaatattgcaaatcaaactttatcatttttttagtattataaatagctttctacagtaagccttgtggatatacatttaaaatgctattgttctataggacagatttctagaaatgggatttctagataatagggtataagttaatttaaaatatatataagctatatatataatatataagctaatttatataatgtatattatatataatagctaataataatataataagctaatatatataatatataagctaatt

SEQ ID NO: 240656 - DNA, 533 bp, Homo sapiens
gcggccgcccgctcccaccccagaaccgacatgtgggaaaggctacccctgactggggaggggagataggcacggtgggagtggggtggcccaagcccaggcctgacacctcagctgtttaaccagtgctatgggtctcactcaggccaggcgcagtgctgagcacttcacaacgatccactcatctcttccgcccagcaacgtgcaggtgtgactgttatctccattttgcaggtggggagactgaggcgtggaggggttcgcagccccacatcagcagagccgggggtcacaggcactggcagctgtgttgcctcgccctgccccgatggctccccctcatctctcagggagacatggagactctggatggccctggagtgcaggggcctggtgtctgctgtccccctcatcttgacgtcacaatcagctaatgactgcagctgctctcggccagttcttccattgccagattccggggggtctcccagcccattgctgcagcatcctgtgcgtgacctggatctgttact

SEQ ID NO: 240657 - DNA, 517 bp, Homo sapiens
atctttcgtcactcctttgccttagagaggggataagggagaagaatcttgtctttgacttgggaatacttaagtgagttcagtctgaggcataccggaaagtagaggaagagaatgtgggtagggggctgattgtgaagaagtgaccacttgtggcttgtcaccgcattgcaaagtgcattgggagcttcttgcttcggggtgatgatctctgatcccagaagcaccaagaagggatcctacccagaggaaaatagaggtgaactggcctgccagagagtccatagttcataggtttagatcatagactttgcttctggccatgtcaaatatctgtcagaagccaaggctgggacttgcctgctgtgccttcctcatggcacagtttttgtcctggtcctcagtggaagctggcttttttcagcagttgagatgtttaatttgtgtgattctactcaggcctttccaagagtcctgttttccaaactggcttgtggagatttctggtgctcctttg

SEQ ID NO: 240658 - DNA, 405 bp, Homo sapiens
cagcaaagaagttgactcacttaagtcaaaccacaacaaaatggagctgggagagtataaaagaaggcccttcatgcatggatgtctctaaaagaattattgcaaggactctctgaaaactacaaaaattttagatacaacgcttctatgaagacatcttcccagcaatagccagtatcaccagtgagtatttgtccataccagcaataagcttctggggccaaagaggtttattttaaaataacttacatgaacttcacctttttttttctttatttcttcttcttcaaaaaaaacaaacaaaagggatatatgtgcagaatgtgcaggtttgtatgtgcagtttattttaaaataacttacatgaacttcaccttttttttctttatttcttcttcttcttca

SEQ ID NO: 240659 - DNA, 397 bp, Homo sapiens
aaagagatagccagccctatttataggctgtgcctggcggagatgaaaccctctatgtttatggcttgggcatcaagcagacacctgaatggcaccaattcttcacctgatttgccgcatgccagtttcagccctctgagctacatgaggcctatgctattttgatgaagtgagatgtcctaaagcatactgagataggaaaggacacactggcactctcttgtctgctacttctggaacaagactgaacagtaaggaaaaaggattgggaactgctcaagagaatcagcttaaattcagttttcggaatcagtggcagctcttcggtggcaggggcttgtcctctcaagcttctccattctggtggatctcctggttctcctttaccctgggcctc

SEQ ID NO: 240660 - DNA, 371 bp, Homo sapiens
gcaattctaaaatggtattttaaccatgttattataagcaactattattgcttattgtaacaatgatccctgattgataaatagcatctgtctggtttgagagaactataaatacctgatagggacaccattgctttcgattacctgaatgcaatcattgatataactggacttataacgtgtggcaattctagaagctatgcctgttgactgttccaagacatattaggtggtgggggcttgaagcttctaagccagggtaatgcctgtatctatgttatgtggatcttacctccttatacttgagccttcatctggtgggtgaaagaagagcctcctgactgctgggtgaaccgtgacgtgggactacc

SEQ ID NO: 240661 - DNA, 496 bp, Homo sapiens
gctgcggatgctggagttggtagtcacaaggtgctaatagtaatttgctctttgcttgtgcctccatcccagatctcgaggcagatattaccaccttggttttgcacaggctcattgaggttaaagggctggttggaagttacttggcaaggggttgagtgcggaggccctaaaattctctggcccgttagaccttgagctagtcagtaaactagaaatggaccgagacccgggagacctgaattccagtcctcactctgtcactgactcagtgtgtgggcaaaaaatgatcagtttcctcacctataatggaagggccagtggtactcttccacttatttggatctgagttaatatttgaacttagacctcacaaaaggcacacaatgctaatgtaagcatcatttatggccaactttctctgagctttactttccccccctttttcttgcgacctgagtttgccctttgggaattaaaatattaaataagagtc

SEQ ID NO: 240662 - DNA, 361 bp, Homo sapiens
tacacaaaatactttatcagcagctgttttcatcaaaaaatcagtagtcagtttcacagttgaaaaagttacacattaaaatattttacaattcattatatattcaccaggttcccattttctaaggggcttttaatataaagcagaatagaagggaaaccctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaa

SEQ ID NO: 240663 - DNA, 470 bp, Homo sapiens
agggtgaggtatgggctatagagttagacaggctgggctctaattccagctcctccatatcttggcaaacagacagaggaaaaacaacataaacatgtaaaacaaatagaatgttccaaagaatcatccagattatttgctaactacaaaaggaaaaatgtcttttacaataaaaactctaccagtcaccacattaaccagtcaaatgtagcctcactaaaaatcaatctgaaagttactcatctcttcatgtgacacaatgtgaaattcatagcatcacccaggaaatatttccaccaaacatgtttaacctaaatttaaccaaagaactttagatctttaacttctggtttataagaaatacaaggggtcaaggaacaagttaaatgatatcacaaggaaacactctagaatgcaggacagttttcaagaaaactagcttagtctcttaacttaaaagataacaacca

SEQ ID NO: 240664 - DNA, 270 bp, Homo sapiens
cccccaagttgtagcaccttatttctgttttcttctcattcccatttattttgctctgttatatatcatttttaaatggcttaaaacccatcttaaaatttttattttctgtgtggatattattttacacctaattatctctttatttctttttttctttctttctttctttctttctttttttttttttttcttttttttttttttttgagacagagtctcactctgttgcccaggctagagtgcagtggtgtgatctccactcactgc

SEQ ID NO: 240665 - DNA, 217 bp, Homo sapiens
tagggcttattttgctcctgtcctttgcctgtgcatttcatttttgcatcgtggtaatcatactgggtgaattttgtattctgtaatttcaactgaatattatatcataagtgttatctacaagttccatgaggaccaaatcttctccacctttttcaccattttacttagcatggtatagtaaagctggctcaataaatatttgctgattgaataa

SEQ ID NO: 240666 - DNA, 424 bp, Homo sapiens
ccccgcctgcagcaagcccagcaacatcatccccgccgctgccgccatttcacttcattggagacactgaaggccgaggtcgccaccactcctcctaatcgacggagcgagagaagctggcggatggttgtccacaggcggctccggcccccaggtctcctactaaacgacaacagtcattatggaagccttttttttttttcaagtaatattaagtgcttgagtatgtatcaaagaagccttgactgttaattgtcactctattgggcactgtggagtaaaagcaattctaaaaccaactacatggaaaccatcaagacctgtcactcccgtttctccacagctattgttgctcctcacaggttcccactccagccttcttccttcaaagaccctgagagaagaaataaaaaataaaagcaag

SEQ ID NO: 240667 - DNA, 860 bp, Homo sapiens
ggaagcccaagcatggagcataaaaaacagctggggggccaggcgcggtgactcacgcctgtaatcccgacactatgggaggccgaggtggatcacctgaggtcaggagttcgaaaccagcctggccaacatggtgaaaccttgtctctactaaaaatacaaaaattagccgggcgtggtgatgggcgcctgtaatcccagctactcaggaggctgaggcaggagaatcgcttgaacctgggaggcggaggttgcagagagtcgagatctcaccactgcactccagcctgggtgacagagcaagactccatctcaaaaaaaaaacttggggtgtcaggggtatcccacgacccagccttccccacccccagctcagggctgcctcttgcaggaagccttggctcacctttccctcccagtgcaccagtcccagggctcattgctcactgccctcagggcaacctcagaaggccaaggcctgagctctgccagggctgcaggctgtgctggggctgggcctggacaaggggccgccagtctggggaggggctaggagagcaggatgaagggaaagcaaggtgtgatggggacggggcacagagggacacagtcccccagaagcggagccagtgagcaactggttccggcccctggctgtgcccggtgccctgtcgggctgcccagccctgaaagcgtcccccacttccactggtcaccgcaggcctggtctgctcgctgagaagccctgtgtttccgttctctctgggctatgtggtggtggcaccaattcccagcagggcccggcaaggttatttatagaactggccagggcctgtgtccacagcctggcaggcacccag

SEQ ID NO: 240668 - DNA, 386 bp, Homo sapiens
taaataactatcattgcatattaaatttctcgatatttgagactgaagagtttatattggttactaatttgtagaaggcgttgataaaaagatttctagtaacacctccagaaactgttttttacattcattgtaaccttacttgatctttccaataaattagagacatttctgtgagaatttcatgtagaaatgatcttgacttaggaatgacaaaatatttttttggagatcacggaatacttatttagtaagttagtgcaaagtttatttatcttgaagttttacatatcataactcaaggtcactaagtgatataaagaacattcaaagtgaggtatacacagaaataagatacatcaatttggcattttgaaaagaaccta

SEQ ID NO: 240669 - DNA, 506 bp, Homo sapiens
tttagacggagtttcactcttgtcacctaggctggagtgcagtggcgtgatctcagctcactgcaacctccgcctcccgggttcaagcaattctcctgcttcagcctctcaagtggctgggattacaggtgcctgccaccacgcccggctaatttttgtatttttagtagagacggggtttcattttgttatataattaggactttacattattttataatgcttgctaattgctgtaggtctccatattgtcatttccccaaccagactatatccttaaaggggatagatgttgtctattacaatactattgctattgctgtgttttgttttttgtatttctgttaatgactagcaaggcttggcaaataggagttcaataactacttcttgtgtaagtgattgacaaatgactttttagacaacagctttcttcaaatatgtcagagcttctatatttacttgaagttgtcaggtacagcacatcttactgcttgcaattgcca

SEQ ID NO: 240670 - DNA, 298 bp, Homo sapiens
aaatctaggttgcacaatccaacaaacatttctatagaaatgttctatatttgcactaatacaataattctaaatgaaagcagttttaaacagcagtgtaaagtaagtgactgcaacagaaatgacaggatttgacaagctgtcccttcattcattgttcattcaaaatacatgaatgcttactatgttccaggcactgttctacatacagcaataaacagacaataatccctacctcacagagctaatttgtattctagcaggaggaggctgacaataaattggtaaaacatatgat

SEQ ID NO: 240671 - DNA, 425 bp, Homo sapiens
attacagattatctaatcccagaaaaccccataccctatgggctttagtgttcacgagtatgtgacgatttccaaagtacattaaaaaaaaaattataccaggtgcaatttaagatttaggagttaaaatgtgctcagattttgtacagtaactaaaacatcctattcatgatgagaagaattacagactacgattgtgggttccactgtctctccctaatcatggtaagtctgaaatggaaaatgcaaacatagctgcaaaattaacattgaatcaattttttttaacaattggaagctggccaggaacaatggctcacacctgtaccccctgcactttgggaggccaaggcagcagattgcttgagccaagagttcaagaccagcctgggcaacacggcaaaaccccatctctataaaattca

SEQ ID NO: 240672 - DNA, 366 bp, Homo sapiens
gcaaacgatgaacagatttttgttttgtggagaatgaagaggaaatgcagaactctatggaaattctcccctactcagctcccctccttctcagaaatagtcaggtattctcctctgggtgatatagaagttcagcctttccttgactttcagatctgtggggtatcactgtctctttctctccctttcagcagctgggatctggcctgcagccttaaagaaaggtgaccggttacattaatcagaaatataacctatcaatggcgtttcaaaactggctggatcacattcatagctgtcctcaaatgcttagcacccctagaaaactaggactagtcaacaaatcccagagaccttcccctaaat

SEQ ID NO: 240673 - DNA, 584 bp, Homo sapiens
actctcagttcgattttcaatttattatctatatccagctcctttccaaagatacttgaggggtctttcaaaaacacacacaaaggagtgaaaaaggaaggcaagacaattaagaagaggaaatagataaataattctagcacaaatggagctgctatgactgggcaccatcgcaacaaacaagacaaaatgggaaggccagctgttgctgcataacaaatctccccaacatctagaagctgaaaacaccatttgtcactcctcacaaatctcaggctgggctgcacagttctgctggtctgaggcaggattggctgatcttggttgggctcatgcgtgcatctggagaccaatggcaggctgctgggtgctgggtgctggctgctctgagatggccttaactgggacaccttggctgggttctacatggcctctcatccagcagcaggccaacccaggcttgttcacatggtgatagcaggggcccgagaaagcagaagctgtcaggccccttggaaagcctcttcctctaggcttagaactggtataccagcactcctgctatgttccattggctgaagcaa

SEQ ID NO: 240674 - DNA, 1098 bp, Homo sapiens
  misc_feature (426)..(426): n is a, c, g, or t
  misc_feature (469)..(469): n is a, c, g, or t
  misc_feature (482)..(483): n is a, c, g, or t
  misc_feature (538)..(538): n is a, c, g, or t
  misc_feature (542)..(542): n is a, c, g, or t
  misc_feature (564)..(564): n is a, c, g, or t
  misc_feature (589)..(589): n is a, c, g, or t
  misc_feature (603)..(603): n is a, c, g, or t
  misc_feature (607)..(607): n is a, c, g, or t
  misc_feature (676)..(676): n is a, c, g, or t
  misc_feature (745)..(745): n is a, c, g, or t
  misc_feature (796)..(796): n is a, c, g, or t
  misc_feature (826)..(826): n is a, c, g, or t
  misc_feature (934)..(934): n is a, c, g, or t
aaaatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcagaaaccaaagacaaggttagactacggcactatgaaaaatcataggccaacaaactggataacctagcagaaaccaaagacaaggttagactacggcactatgaaaaatcacaggccaacaaactggataacctagcagaaaccaaagacaaggttagactacggcactatgaaaaatcacaggccaacaaactggataacctagcagaaaccaaagacaaggttagactacggcactatgaaaaatcacaggccaacaaactggataacctagcngaaaccaaagacaaggttagactacggcactatgaaaaatcanaggccaacaaacnngataacctagcagaaaccaaagacaaggttagactacggcactatgaaaaatcanaggncaacaaactggataacctagcngaaaccaaagacaaggttagactanggcactatgaaaantcanaggccaacaaactggataacctagcagaaaccaaagacaaggttagactacggcactatgaaaaatcanaggccaacaaactggataacctagcagaaaccaaagacaaggttagactacggcactatgaaaaatcanaggccaacaaactggataacctagcagaaaccaaagacaaggttagactanggcactatgaaaaatcataggccaacaaantggataacctagcagaaaccaaagacaaggttagactacggcactatgaaaaatcataggccaacaaactggataacctagcagaaaccaaagacaaggttagactanggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaat

SEQ ID NO: 240675 - DNA, 224 bp, Homo sapiens
caaagaagactttagtggtataggagctaaggtaaagaagagaaaatttgagatcaagcacctttatcaagagatttaagtgacagaaaagtgatgatctggccgagcatggtgagtcacacctgtaatcccagcacttggagaagccaaggtgggaggatcatttgagggctggaattcatgaccagcctgagcaacatagagagaccccatctcttaaagaa

SEQ ID NO: 240676 - DNA, 404 bp, Homo sapiens
ttctctgacatttttaaatatcctgaaaagttgaaagaattgtttagtgaacgcccacattatctttcacctagattctacgattaacattttcatatttgctttatttacatatttatctgccagcacattttttttaaagatgcattttaaagtcagatgtggaagtcagttgctacagactgaattgtgtcccttccccccagattcatgttgacgccctgaccctcaatgtgataatatttggagatgggcctttgggaggcagctgagtttacaggaagtcatgagggcaagtgctctcacgatgggattagtgcctttataagaagcagcaccagagacctttctccccacccttcccatgtgagatcacagtgacaaggtggcagcctggaggctag

SEQ ID NO: 240677 - DNA, 514 bp, Homo sapiens
atagtaatttataagtaagataaaatgatcattgaaaactcctggaattgcatcccaatggcttttataaatgtatttttgataacggagtgaattgtgctacccctcccccacaaaaatatggtcacccctaatctctagagcctatgaatgtgactctatttgaaaaaagagtctttgtggatgtaattaagtatcacaagatgagatcattctggattacctaggtcattacctaaatccaatggcgtatccttatgagagcagaagaggagaaggtcatgtgaagacaaagatagagagtggcagccacataccaaaagatgtctgcagccaccaaataagtaaaactgtttcaaaatcaaggcagttcgcttaataaaatcatgatgtttcagtcaggcatactgactcacacctgtaatcccagcactttgggaagccaaggcaggcagatcccaggccaggagttcaagaccagcctggccaacatggtgaaaccccatctctgttt

SEQ ID NO: 240678 - DNA, 553 bp, Homo sapiens
ctcactgtagcctcgaccacccagactcaagggatcacgtgaggcaggaggatcctcctgccacagcctcccaaaatgctgggattacagacatgagccactgtgcccgacttgggattggaaagagttttaaaaaccctcttcttttccattttcctgcctcctcacattctctggggagttgggcagtacatcctgtggcctaacttcagtctttcctcctgcttctcagaggaagcctaaccttgttgctcaaggctgtgtgactctccagagcctgggcacccaatgaactctcagaggtggccagaaagaaccagccacatgtacacccccagcccaccctgaaggcagagaagggtcttgggctcagggagagatgtgctggtggggggaggtgtggagtgaagcgtaagaggggctgccgaggctctgggtttcttttttcttttcttttttgagacagactctcactctgtcgcccaggctggagtgcagtgagccgagatcgcaccactgtacttcagcctgtgcaacagagcaagactatctc

SEQ ID NO: 240679 - DNA, 460 bp, Homo sapiens
ctccttctctttcctgtctcttagtatcattcttttctttcactgtaggctatcttttccataagtgggatacatagccactagcagttcctgaggtttgtcttataatttcagctactagaaggaaattgacctgactctttcagtcctaaatccaaaatctctggcaagtgtcttcctggttcagcttgaattagatgatcacttctagactaatctaagtgcttagagggctgggcccctttaatggtatcaagggaatgtggatggagtagaggagtggttatcaaaaagggatgctgaaaagatagtatcactggtgtctacaacaattctcatttgacagatgaagaaagtggaactttagatgttaaataacccctccaggtttactcagctagtgaatggcagatccacaagctatatagttaaacatgatataaaagtgaacagctaaaaa

SEQ ID NO: 240680 - DNA, 406 bp, Homo sapiens
ggggtgaggggaacactacatttttgggtcaaaaatattataaagatttattttacctgggcctttgattggatctgagctccgaaggatcaaccatttaaaaattaagccaagaaaagggtaccaaaaatattgtcacaaatttgggaggtacccaagccagaccaacagatggaacttggcacgaaatagctctttacagactaagtagctgactcaagaaattttaactcagatgaatttattaaaatgttgaatgtcatcttgaataagaggctggatgatagatttaggtcagtatatacaatttaatttgtttaacttcctgttggtcttggatagtataaaagctgctcacatttctatagttaaagagaaagagcgagagactcttagcataaaaaaa

SEQ ID NO: 240681 - DNA, 730 bp, Homo sapiens
ggccttatgccatttgaaacgtttttgcactttttatatattagttcatttagtccttataccaccatgcagtggctgtgatggttatggtagttaagagccaacttgagccagatgcctagcttcaaatcttggcttctctctcctcttactctgtgaccttgtgcaagtcattaaacttctctatgtccctgtttccttctttgtataatggaataatgaaaatacctatcttctgggattttcataaggattaaaggggtataaatagatgtaaagtgcttagaacatttcctggcacatgttaaatgctctacaggttttagctattttcacaggggaatgttcttagcaacagataggagttcaagatcttgctttgtcctgtggtgaataaagggagtggcaaaaatactgtgcccagtagaacctagtagctgtggaacaaagaagcggagccctgtccatcattatgtgcaaagagataatcagtagtgtcaaggaggtcagagaattctgaggtcaaaaggtgaaatgaatcatcattatgaatatttatgtcattgaatatgattatagacaatgagaaggcaaaaaaaaaaaaaggttgattgggagaagaaagcaatagtgatgatttgaagagaaatgatgaagtaaagaactaaatgggattgaaggttacaaagaggttgttagagaattgagcccagagtaatatatatggcta

SEQ ID NO: 240682 - DNA, 400 bp, Homo sapiens
tcccttataaattacctagaaaatgagcgtaagtctacagcaccataaagagttgagcctcttccacagtgatctgaagcttaagaattccaaattggtcaggatgtgcctgagtttaatacacctccttggcttgttcaggttgagcaaatccaagatcagacaatagaggactttacttagattcttgaacttgtccatggcagggcaagaggttgtgagtctgcccccctaatttgttacttcaagcttagtgataatcatggtaataacaagccttcagtaaggaaaccatttacctccaggaggctcaaaagcctgaacagaaatgacgtgatacatcatcctcagaacttccttgtgactaaaccatagggaatttgtaaacatcacttgaaag

SEQ ID NO: 240683 - DNA, 509 bp, Homo sapiens
agtggcaggcaggccacgcccctccgtgtgtaagacctgccgaaaacactcctcgtggggttggggtgggagtgcaggggccttggtggtttctacacccatgggcctgcccggcacgtgccccagactgtgcagacagggcctggtcagtggctggatgttgaccaaacgtggaatatgtctgtgtgtcaggtaaagctgtggtgcattctggttggttgtttgcttttgttttaatcaaggttctctttctgctgtagggctgcatgatttagcagccacaacaggccaggcgcggtggctcacgcctgtaatcccagcactttgggaggccgaggcgggtggatcacgaggtcaggagtttgagaccagcctgaccaacatggtgaaaccctgtctctactaaaaatacaaaaattagctgggcgtggtggcgtgtgcctgtaatcccagctactcgggaggctgaggcagtagaatcacttgaacccagaagttggaggttgtgg

SEQ ID NO: 240684 - DNA, 599 bp, Homo sapiens
acagttgattagatgggggatgaacgcctaatctagttcctgatttctgacaaatccacccagatattgtacacagtgcgtaggagacatatataatgagcacatataaaggtgcagaggaaaggaaggggatggagatagaagaaacaaaaagtgacagatcagatataaaagactttctaaccaccaaataaagaaagattttacttctactcctgatattttccagttccgctttcatttcctacataatccatcacataaacagaaccaatgacaaaaagccacatgattatctcaatagatgcagaaagggctttcgataaaattcaacaccacttcatgctaaaaactctcaataacctaggtattgatggaacgtatctcaaaataataagagcagtttatgataaacctacagtcaatatcacactgaatgggcaaaagctggaaccattccctttgaaaaccagtagaagacaaggatgccctctctcaccactcctattcaacacagtattggaagttctggccagggcaatcaggcaagagaaagaaataaagggtattcaattaggaaaagaggaagtcaaattgtc

SEQ ID NO: 240685 - DNA, 425 bp, Homo sapiens
ataaaccagactatggtctacccaaagtctctctatcaaggggactgaggaaaagactgataagactggggggatagttagtacaagtgagtgctgagagaacacgaggaggttctgattaatacttgcatatcaacccagaggaaaaaggttctgccacagaacattagctagaatatttaccaacaatctggttaagatgctatgagtatggaactgttagaagccagttggtccatcattagcaacatggactctggagttggaatgcctgggtttgaactgcagcctcattacttactagatatgtaacctgtgccaactcttaaacctgagtctgtttcctcatctacaaaatggagataattgtaatatgtagggttgttgtgaggattaaatgagactatatctacacatgcttagaa

SEQ ID NO: 240686 - DNA, 459 bp, Homo sapiens
ggaggcaccatctgagtacttctccctccgtggggtcctccgggaaaagagcgcgctggctcgggatcccgggcggactcccggcgagacaccgcagcgccacctagtgccgggatgagcaggtgcttttcggccgagccagtttccgtgcagaacgcctgagtcccctggagcaggtgaggcccctcccgagagggcagaggctgcttcctgtcttgtcaaggacataaaaagatgatcgtctaattattaaagtaatctgtatatatttagataatagagcatgaagtacaaaataaaacctttgaatgctttcatcccatgggggtgtgatggcccctgtctccctaccgggtggcgccaactctgtccatggtctccccgcggggcggcaccaactctgtccatggctcagttgctgcactccagtctgagtgacagcaagactgtctaaaaaaa

SEQ ID NO: 240687 - DNA, 473 bp, Homo sapiens
ccgctgcactccagcctggacgacagagcgagactctgtctcaaaaaaataaaataaaaagaagcactccgtggtgttgcatagagtgttggtatatattacatatatgaatgagttaactggcccttatcaggaagatggatgggaagtgggttctggaaaccttattctataccacatccttatatatagtcctcagttattgtccctctgtgttctagggcactgtgaggtgaatgctattgtacacgttttatagatgaggaaactaaggctcaggaaatgtaagtatctctcagaaggtcacacaggtaatcactgaaggagctgtgctcaaacctaagtcctacaactggcagagtgtggttgctcccacctgtaatcccagtgctttgggaggctgaggcgagaggattccttgaggccaggagttcacaaccagcctaagcaacatagggagaccttgtctttaa

SEQ ID NO: 240688 - DNA, 411 bp, Homo sapiens
tggggaaaaacacagatgacaacaatgtgtcatagctttgataccggatagactctggcatgttgagggtgcgtttctactactaagaatgtcaccactaagaatggtgacattcttaactttttgagggatggattcagaggaaaatttagagaaacttgaaggtgacatgttgaattgaatgagaagtctatcaaaactctgcaaagaactatcattgatgcttcaacagtttcctgaaataggattgtcaaatctgtaagtctgtgagatttccggaatcagaggtctaatcaaaaacatttagcgttccccacccccaaaacaacggaaattttaaaagtaaaaatttctctcttgggtgaaaaaaataaacaccccaactgataaacgatatactcaatgcttacc

SEQ ID NO: 240689 - DNA, 371 bp, Homo sapiens
tatattcactattgtcaaaataaacacgtaatagcaatctaagggaagcgtctgcaatttcctcatgaaacaaaagaagccttgggaagctttcttctcctgccacattaaggaatgcccattagtaggtcaggctcctgtaagtggacaaatgcagacccaaatgtaggcttccagtctggggctaaaatgtccatgcatgttccacaacttctcatctttcacttcttctctttgacaatgataacaggaaaacctggagaaagttttgtgcctgcctttagatctctgtaaattaggaagtatttatttttataggtatgtaatgctttcttttataataaattatttatagttattgtgtaaagcag

SEQ ID NO: 240690 - DNA, 463 bp, Homo sapiens
ccaggattatgtcactgaaaattcagaaatctgtgcacctacagctcacctgttttattacttttgtggtttgcatatcttccctttattttctcctggtttcttataatggtttgttttgtttgtttgtttatttgtttgtttcacaaaaatcccataggattctgatctcacaaagggaaaagctggatccccagggcaaggagccaggggtcagcggaatggacggtgccctgcagccgatgctgtcaatgcagcagggctaaggctgggaaaggcacctagtgaagggagaccagggagggtacacacaggtacatgcgtgggcagctgctgtctcctggggctggtctcccacaaggtggtttcctcgtgcagcagtgacttggtgcagcccctctcacctggcaccaatgcatttgtttcctcaaaagaccatagggtggcgtttacctcaccactt

SEQ ID NO: 240691 - DNA, 165 bp, Homo sapiens
ccgactgtaggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagact

SEQ ID NO: 240692 - DNA, 285 bp, Homo sapiens
aagggggcagggggcaggggtgtgtggggtgtgtgtgtgtgtatagacctgcatggtcaaggccaagaggagcctttgtgttttgtcgcctgcttgaaccatggtgggatagaaggatttcagggtggaccagttgactgaatgcccttcaatcccatagtcttttgtggtgcatcaacctcatagaggaccttgtggtatatgttcaagataacagagaccgggagtttgagaccatgcccaacatgaggcaacatagctacatcctgtctctacaaaaaacta

SEQ ID NO: 240693 - DNA, 1082 bp, Homo sapiens
ctgggtgacagtgagaccccatctccaaaacaagaacaaaaacaataaaaaatccaacaatttaaggcattcattctttatctactcacatattgatatataacatgtatgtaagctctgtattcatagcttgtcataatgaagttggttatatttaagaagaattttcagtggaatttctaattgattcttttttaattaatttatttagacatgtgctgattgatcacctacaatgtggctagtgttgtgtcaggtgctatttcctctaagaaggcagaaaatatttcatggataagaattaggaacatcatctgtccagtacactttatacaattttcagtttagcaattattttgtagtttacttagtagctgtctcccctttgctttgaatcctaaacccctctcttttcatttttatatcccaagcatctgctcttagcacagttaaatccctgcaaaatagccgtaacttgagttaaaaggagggagatgtggagggaagagcatatgcaaagattcgatgctatgagaaagctcagcatgtttggaagcctataagcagttcattcctggtggagcttggttgggaggatgggcagtgaagttggagagatggtcaggggaatgaataagaggtgccttgcatgctgtgcaaatgcatttagacttgatctgcacgtgataagaagccattatggccagcctactaatatctgtctcatgggagctgcatcaccataataagaataaaacctgatttttggatccttgcaggcattggggcaggcagttagtaacaggattggaagtgtggaatataaagtgtaagaaaagagacttctccccatttctgagcacatagccaactccaggaaacatttaaaataggcatagtttgcctcagcctcttgtcccctcttgctctcccttcctctctctgctggtgttccccacccttagcccttccctcctgccctgacatctgcctgctgcacaggtaggtaccaccttactcttttttctgccacaattcaggcaatgcgacgtcagtttaagggcatctcttctagattccag

SEQ ID NO: 240694 - DNA, 427 bp, Homo sapiens
gggcaggggcccccgagcaggcaggcaccccaacgtggctccctcccaactcacgacccctctcgctaggtgcccagcaggcgtacaccaccacatgcctactaggaagccacggggaggaggacctagtgccgaacccacagccctggcctccgtggacatgcctcccccctaccccagcagggaacagatgacccctagagagcgccccactgtctaccccgaggtccaagcttgcagaggccactctgaagttggctgtccatcggcctcttaactgggctgtttttcgtccaacttctctactgcacttaagatgatttgccaaaaacccctccaccaccatattagctggaacatttggggttgaagtgacagaactcccaaacaaataggtttgagctgtaccccgtctctaccaaaaaaa

SEQ ID NO: 240695 - DNA, 578 bp, Homo sapiens
gctatctctatcgcggtttccttatgtataaatgggaagaatagtacctttcattggatcgttgtaaatattaaatatggtaacacctgttgttatggactgaatatgttccctcaaaattcatatattgaagcactaacccccaatgtgatggtatttggaggtggggcctttgggagataattagatttacatgatgtcataagggcgggcaggacttcatggtgggattggtgccattataagaagaaaagataccagagtcctccttctccgccatgtgagaatgaagagagaaggagtctatctacaagccaggaagccagccctcacaaggaaccaaatctatcagcaccttgatcttggactttccagcttccagaactgtgagaaataaatccctattgcttatgtcacccagtctatggtattgttgtggagcagccctagctaggacatctgtaaatgacaagttctatactactatataggactgctggataaatgctagctattcccatttccctctgagaactgaaatacctgaaacttctattaaaagtctttgtattcctcaa

SEQ ID NO: 240696 - DNA, 969 bp, Homo sapiens
ggagcttttttctatcaccatgaagtggaaaagtataatgatatcccacagcctaaaaactggaaagttggggtggagtgagatctggatttggaaacagttgcagaaataagttccagtgccataccagtgcctttcccaggtagccaaagtagtgcccacaaaccttgcctgcattttggatgtgatggagagtcagtcaaggccatagtgtgttgtgcctgaggggcccaattgttaagaaaccacagagaatacactgtaccgttcttgattgtacttttgcctgtgttacagttggtctttcttggaggaactagtgaaaactagttattaccccttgtccctgcactgttatctcttcccgtaagtcagctcagaatgggagtggaatctgtccaggtttttttcggtcactttcctgtcagtctcttgcatcatgaaaggaagacatcattcacatctgctcattgctcatttcagtttgacctgtgttctgttagaaattcctctaagattttaagatgcagcattgagcagattttctgtcactgaagcagattttactcaacatttattcattcattcattcatttattcatccactcagcaaatatctaattagagcctgttaggcgctaggcactgttaagcattggggagcttactgtgaagcacaacatttttatactgagacatgtccacgttgtaatgagccatatacatgggatcattttacaggaaatagaactttgctgtcatgatttgccttgggaaaaattagggaacaaatgggggtaccaaagacactgtctttcttagcagtgatctttgtgactttatcgtaatattattgtagcttaagagttgtgggaattaatttagctgtcattgttactattgttatttcctgattgctgacattttgcttaataaagatccaagctgaaaggtgggtagagtcaagat

SEQ ID NO: 240697 - DNA, 998 bp, Homo sapiens
ggcggtgcggcggtagcgcagggccctcctgcggggccaggcaggggcgggtgggcgctccttgccacctttctgctctccctgctgtccgagaagttcgtgcggtgccagcccagctcccagctggggacagaacaggaaacgtccccggcgagcctggcgggggtggcggcaggggtgtctgtcgcctgcgctgggcaggacgcgcgtcctaccggcctcccactccgcgggcctcaccagccacctcattcccggagcccgggccgccgagagcgccgcggatggacctcagggaaggcctggcgcgccgcctccgggaagccttccggccttctccctccaccgagtactggggagtctcaggccacggtgaatgaagagcaacgggccggagagacctcggcctctgcccaggagcagcgcccagcaaccccgcccacaggggacccggtggacgccctggtggccactttgccaggctccccatctcccagcgaaccagagaggatttccgttcccctcctgcttggtgcctagcgccagggcggggcgtgggctgagcagcccctcccatggagggagcggccagtctacatattggaggtggggctctggggaaagggtgttgttaggaaggcggtttgaggcagcgggaggtggggatgcgcccggcggggaggggcaggtgtgtggggagggcctggggagcgcctccccagccgggcagcgcttccccagccaggccccgcagctggaccccggctccgtccagcctgggaaaggactccacggtttatgctgaagtggtggtggggtgggtgaacgctgcgcaatggaagggcatggccctgtgctaattgccccggggtgtggggctgtggaggcactgcgggggggatgtgctgtgtcagttgggcaatggcggccaactgtggcgtgcaggccttggagctgcccctccatggagctttaataaaggcactagccctgcaaaa

SEQ ID NO: 240698 - DNA, 193 bp, Homo sapiens
ttttttttttttgcctccttggtgtctgctcatttttctaagatccagatcagctatgggcaaattcactgggaataggataaagtgaaggtcttctttttcttttctcagtggactaaaaaactcttaagtgtttcttttgtattcaaacccaaaactggtacaaagtccattaagagaagccacagctgca

SEQ ID NO: 240699 - DNA, 453 bp, Homo sapiens
tgttcagagaaaacagaaattattaacttgatgaagtatttctgtgtgtttggatttacgtaagtaattttgaaatttgcatcattggttgggcgtggtggctcacacatgtaatcccagcactttgggaggccgaggtgggagaatcactttagcccaggagttcgagaccagcctgggcaacatagtgggaacccatctctaaaaaaaaaattaaaaaaataaagaataaattagcagcattaacaaatgaggtagtaagaaactgtactaaaggaaaacaaacaaaaaaaggactgcgcatgttcatttttgtattcacctaaacacaactctaaagtttgtaggtttctagatcacctttgttgaactcagtatattatccataacccacctaaagcaaatagtttaattctatctttctggatataattaccttttagttggggttca

SEQ ID NO: 240700 - DNA, 1284 bp, Homo sapiens
  misc_feature (1279)..(1279): n is a, c, g, or t
cataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcataatatattcaccatgcattcaaagtaagggcaggtggagattatggaatcattggnacagt

SEQ ID NO: 240701 - DNA, 1230 bp, Homo sapiens
  misc_feature (1225)..(1225): n is a, c, g, or t
cataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcataatatattcaccatgcattcaaagtaagggcaggtggagattatggaatcattggnacagt

SEQ ID NO: 240702 - DNA, 469 bp, Homo sapiens
taaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctct

SEQ ID NO: 240703 - DNA, 476 bp, Homo sapiens
ctggcttcgagtcctcactctctcccgggctggctttgagtcctcactctgctcttgcgagctcacatctgaagtgccttctgttctgtcatgaagtcccaagagttttttcgtctttgaatgttctttttatgtttcaggtggttttggggatttactatgtcttgaggacatccatgagcgtttctgtcggtgtggttttgtattttatttccctttgtggcctctgtcttgtgttgtctgagagcacggtggggttgcgagggccgtgccctcgggaggagacctgcgtgtgccttgactgccctgggcagccggcactggggcagaaggagtggactcccagggatccccgccgtttgtgtcccagacacagccccagccctccgcctgctggctcggtgggcggcctgaaaccatcctgccttctaggaagacagcaattctggaagagcaaagccgatacaactgaagga

SEQ ID NO: 240704 - DNA, 150 bp, Homo sapiens
ctagaaataaattgtgagttttgtaatttcacactatgcactataacactataatgttaatatacagaattattttttatatataattgttgcaggaaaaacccagacctgtgtagaagaacatccctctgccaaagagatagtgctgaa

SEQ ID NO: 240705 - DNA, 581 bp, Homo sapiens
attatatctttactatcagacaagattgaatttagtggaaaagttttaaataagcggcaatgaggaataattcaaagcaacagtatagcattaaacatccataaagcagaaactacagaaaatataaagaataatagttacatagtagtgataagaatgtttattcacttctcttagttcataagagatcaagtggacaacaactgagagaaagaaaacccaaataaaataatgaagtcaatatttgagattgtcaagctttgtatcctgaaaactaagaatgtcaaataaaacattcacaaaaatagaccataaagaaaatttcaaagaatttcaaaaggcaaagtaaatatatacagcattctgtgatctcattgcaataaaagtagaacttaggaaaaagaatatcatcacctggacattttaaatttcctactaaaataattcttagatcagaagaaaccaaacaagttatagaaaatctaaaacaaaagcataatgaaaacaatacatatcagaacttgtgagatggaactaaaatagagttcagaggcacttatcttaatgaagaaagaaaataa

SEQ ID NO: 240706 - DNA, 272 bp, Homo sapiens
agcacagagctgcaattctgtgcatgaattctggaggcagattccctggaattgaatccttgttctgccactttctatcggtgtgaccttgggcaagtaacctccctgtgcctgctttcttcatttgagaatgggataattgtagaacctatctcaacggatcttacggtgtttaaatttttgtaaatatttgtaagtccttaaaacagtaccagacacatagtgaatgctttgtgaacatttgttaaataaaaagtagacagatgtagcta

SEQ ID NO: 240707 - DNA, 721 bp, Homo sapiens
tgaaccattagcaaacaattgaatgttattgtctttttgtgtttttttttgttgttgtttgtttgtttttctcttttagagacagagtattgctctgttgcccaggccagaggcagtgctatgatcagagctcaatgctgccgtgacctcctgggttcaagtgatcctcctgcctcagcctcccaagtagctgggactacaggtatgcatcaccatgcctagttaattttttaaattttttgtagagacagggtttcgctatgtcgcccaggctggtctcaaactcctggccacaagcgatcctcccacctcagcctcccaaagtgctgggattacaggcatgagccaccgtgcttggcctcattgtttaatatttaatgaaagtatacatggtgctaaatttatttagcctcagtcagtgacccctaacaaaccactaaggcattccatgccaggctgaccaggtacagtggcacacaagccaaatgctactgccacacagcctcctttttaaatgtcccagagtagagaggaatagggacagctgcatttttgcagccagcaaggagctccagagagatcctttcccagcagcccctgccttccagacaggcgttcttatgctccagttatgttctgcaaatctcagcttttttcatgtcctcatcagtcaacatcatcagcaagctttgcggggagaaagccaaaaaagttcttatct

SEQ ID NO: 240708 - DNA, 1855 bp, Homo sapiens
agtaactgcatttatgaaattctttgtcagagcaatttagttaatagatatgtaaatgactacttatttcattgtgtaggtggaccgctccatgtacactttctgaggaagaacataagtgctaaaaactattaacattgcaaatggaaagaagcaaaagttaaggctagaatgccattcccttgctgtattagatattaggagtgggacagaaagtccatcttgtcatcaagatttgttcggtttatggggtgggatttcttatttacatcccactcttggacggtctttttttttttttttttttgatgcatggaaactaatataaattggggtgcaagggtgtttcttgctgattttcaagcacaaaaggtcattacaaacccagctgggaagggactgggggaggtgctgaaagttaaaaccacggcagtaaattttcaacacaagggaatacctcctaaaaatcacctaggggctcttttaaacctttattgtttttttcagcataaaaacaacttcagaggagactggggatttcaaagctctctggctctaactgcctcctgggaacagcatggaagcttccctaatcatggaggagttaatgcaggcctctgggggaagaagtctctaatgggaggaaataaatgggcccttgccttgcagatggtcccaagccctcccctcactggaattcttcttgctctgtgagctagcctcatcttcagttgtgcttttttttttttttttgagacagtctcactctgtcacccaggctggggtgcagtggcgctatctcggctcactgcaaactccgcctcccgggttcaagcgactctcctgcctcagcctcctgagtaactgggattacaggcatacgccaccacacttggctaattttctgtattttttgtggaaacagggtgttaccatgttggccaggctggtctcgaactcctgacctcaggtgatccgaccgcctcggcctcccaaggtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataatagtagaaataaagtgcacaataaatgcaatgcacttgaatcgtcctgaaaccatccctccccgaccccaatccatggaaaaattgtgttccgcgaaaccggtctctggtgccaaaaaggttggggaccgcttctggaaaagctggaaaaggcaagaaaacgcattctctccctcagcctctggaaggaaccagcactgtgggactaatttacatactgtagggtaataaatttgtgttgcttcgaaccact

SEQ ID NO: 240709 - DNA, 3552 bp, Homo sapiens
  misc_feature (3393)..(3393): n is a, c, g, or t
  misc_feature (3395)..(3395): n is a, c, g, or t
  misc_feature (3397)..(3397): n is a, c, g, or t
gtctgtgtggagacgaaagctgcccacaagggagcgagggagctgggagggggtggtaagagatgaggtgggaaggatgggttgggtgaaccttgaaataattgtagttgtactttgtgaaaaaaaactttatcatcaaggctttgtcctgatccaacctgaccttcccctcagttaatccgaattactgaggtttgactccatgttcagtttctctgagatttgctttgatttctcttagaagtggagctgctgtttattctcccggtggctctgtgtacacgctctgcccgtggagctgcctgggatgagccgtgagtcctctgagaactgcttcctgtttcgtctggtaactcctaagcctgcctttctttcctacagtctgcatttgtggaaatctgcagtatttgaagtttggaggagatcaatttttcatcctttccttcgtgggataaagaatatttcaaccacctctggagaccaaagagttctgagaagttttgaaatagcttgggaaatacaccacgtgcttcacacttcatttttctcctctctctttcattgtttgacttaattaaaatattgtaatgcaagaaggagagatgaggcaaacgtttagagaaggaaaaggaaatgggttcatgtttaaactgactctgagcaagcatggcgatggtagtttgaaagaattctgagcatgtaggaaggtaaactcaaaatgttcttcctgcctgagaagtgattaaaatacctgtgagcaccaacactattgtcgttaatgaaaactgtggccagctttccccacccccaagtgctccccacaacccaaagaaaaaattggaacatttttgggtccaagtttcacagatgttaagcattttgtgatattacttagggggtttcctgagctgcattaaagttgaaccactagggtgttgaaacagttgggccccataataaaatatacatgaaaaggaattgtgaaacattggctgttgtgtgttggtgacaattaggttactgttttaaaaaatacataccctggacacatctatgggagctttttagagaattttgagtagcactagagtaaaggcggttggtaatttctctggttgcctctggcaggtggacataatttaacaatacccgtcagatatgacaaattgtttttgagttacattagggccttaataagatcacatctgttcatatatcctccttaaccacagagcctgatttagagaggtttcatactggtatgatattgttgtttaaatatttagaggggtctagacatgtatcataaaagaatagactcttgtgtataaaaacacagtccttttattctcagtgtttttgctttcatggaccttgcatcattctgtctacttgagtgaaccacatgttgcttctaggagccagaaaatatatttcattcctcgtcagagttagtgttttagagctggaagaggccttggagaccaacttatccagctcccctcctctttagggtagaaacctgagatggagacagaaggaggggacttatttagggtttctcaccccattagtggcagaaacagaatcaggacttagatctgccaatttgtagttcggtcgtctttctgttatgctagatgttcacctgggacctgaaaatgtggccattgaggcactttgatgtgtcactgtcccttagaggctgcagtcctttccaggggacattcctggccactgagagggccaggctctttgctatgtattcagattcagagcccagatcctctagtttaggaatacctaaactatctccctgcctgaagaccttcctgtgccagcgtactttctgtcacttccctgctgacatgcacaggcacaggcaagtctctctcccatctctgaccacactgtgcacgtccccaactctgctcacactgttcccttctcctggaatgtgtcctctttgctatgtcagttactgtcatgtccagcataagctccatcttatcatgacgtctcccaagcccacagaggtgtgttaggtcgaatcatgtgaaaatgctgttttataggtgaaaaaggtcaaatattgtcagttttaacatgtctcaatgtattaaataccatgggggtaaataaagctcttttaaataagcagagattgtaatcaacacatacctcatggtaaatcatttaagaggctctataaaaacgtttatgcacagccatacataatgcatacatttctgaaataaaataaaataaatgcgtgcttttagaataggctgtagttacattcctctcccatgccatcgacatcaatttcccctgtagatgatggaggtgcgatgttcagacaaatgctgacgcagaccgacgggagctggaggctgaggggcggcggcctggcaggtgatgtctctccagtcttggggaatggctcctgggaacacgggtgtctgcttgcggcatcactggtcatcacaggctggtggggctgggtggttgtggctgtcagtctcaggcagttgaggctgactttttgtgcagccctgtgtgatgtctggatttagggagacgccaggaaagtggatgtagataatgctttacccagggcccctctgtgaccacctgtctcttccccatctccaggcaacagcagccactaagaagtgctagagtcattggcttcctaagaaattggcatgagcactcaggcccccttatccctacacagagaggcggaaactgtaccatgtgcctggctgtgtattcttcaaatatcaggctcatggcatttcagctaagaatcccaacatctgttgatcagcaacagacttggcaaatagtggtgcttagtaagtagcccttgagacagaggacctgatttgtgattcaatttctaataattcataaatgactcatgaatagcactcaatttgagggccattatgacactttgagaggcatagtaagagtatattgcattgatatagtatggtgtactcttttagaagcctgtcattcatatatatatatatatggaatttatgttaatcaggataagcatatattaaggtatgtttattaagtcacaagaagatctcttacttggccagtttgtggggtggggatggtttgggattgctctgtaatagactaccactagcttagcagcatgaaacaacactgtttactagctgtaggttgagaaacccagcaagcctgcctggtaaagagtatcagataggaaacagatagcaaacagcacaaggctggaatcagggtgtcagcccctgtgtatttctttctggaggctctggcaaaaacccacttccaggctctgtcatgtcgttagcagaatgcacttccttttggctgtaggactgngntncctgttttcttgctggctgttggccagggcacattctcagaccacatgcccgcctccatctcaagtgagcaactctctctcatgttgactcctccttacctttctgatctctctgacatacgcttctgccaccagccagagaataccactgcttt

SEQ ID NO: 240710 - DNA, 892 bp, Homo sapiens
actagtttgagcattttttcatgtaacttgcattagggttctcctgagggacagaaccaataagattcacgcatctatttcatatatgtatatatacatgtgtgggttcaatgcaggctgacagagtggagatttggacacaggctgcatgaacgagcagactgccactaaggtggcctaaatttatgtccacttttgtcccatagcccaagtttgggcatcttgcccctgctttgccctctagtatctgaccttggtttgctcctcttttttactgtacagagctcaaaatgttgaaaatatagatctgaatctcaagcgagagataagagctaaagttgtggatctggtaatcattggtgctgcctcctccttcccttcctaatccccattgtaatctgtaaaatttacagttccatttagctgtggctattcctttcttgtagtttacaatctagaggaaataaaactatttactggttacaaaaaaaaaaaaaaaaaaaaaaaaaaaaaaaaaaaaaaaaaaataaaagcagaaaaacaacacagcgacacaacgcgagcgagacgagcggcagaagcgcgaaggaagaaacgcaccaggaacaaataccacgacggcgcggaagaacgacgccgggatacacagagaaaaaagcaacgaaacagcgcagcgcatcacgacacgacgcgagaaagcacacggatagggctaatatgtgagttagtgataacaatggaggaataaaagcaagaagtaaaatcgttggtgaaggcgtgaaaataagctgtgattcatgcgagtttctgtgctgcggagtatatagagtatacgggtggaatgctggtggcgcgccgagcaagaaccacacacagaagcaacgagaggccc

SEQ ID NO: 240711 - DNA, 440 bp, Homo sapiens
tgcagatgggtgaagagtctggcctccccactgtacagaggtcagatgtctctcccatcctccaccaggctgctctggcaaaggactttgctatggtttgaatgtccctgccaatactcagttaaaatgtgattgccattgcgatgatactatgaagtagaactggttaagaggtgattaggccatgagggctctgccattatgaatggattaatgttgtcaactcaggagcgggtttgttatgacaagaataggttgttataacaacctactcctgtttggccccctcttgctctcttgctcttgccccctcttgcccttctgccttccaccacagagtgatgtagcgcgaaggcccttgccagatgctgaagtcatgctcttggacttcccagcctccagaaccatgaaataaataaacctctgttgtttataaatta

SEQ ID NO: 240712 - DNA, 842 bp, Homo sapiens
tatcaagagagatgtattgatcatatgcattgtcctttatatgtattatttctaacaactgaacatttaatgatatttggtctgcagatactttgaggttctaatctctggcaagaaccatgaatgtagctcttctatgttgccaaattcagatcctctgccttaacagccaggtgggttaaaatgataacctcttaggaaaaattaaggaactttttgcaaggttgtagatattcctccattcaaggtacagtactttttttgagaaaacagcccagggttcactactgcaagatgtaaattgctgtccttaagttctgtgccataaaatctatgagcgataattttagcttggcagtctaaaaaaagatttaaactgattgtttactgtagccattaaaaaaaaaatctcagtagacatagaatgtctacttttgattactgtgacattcagatgagccctccaaaatttaactggaaaaagcatgtaagactgcaaaattatataagatatatagaattattggttctaagtcatttaaatacttggaagctgtcttccaaagaatagttgatcttaaggcaatatttctgacaaaaattatcaagtccgactgcctgatgaggctgctcctcaaaagcagcgggaaagccaagttggaaaggggaaaagagcagctctaagacaacgtctaaacccactgtcttcagagtcagacacgttcatcatccttactctcccccttcataagatgtacaactctggaaaattgacttaaccactctcagttttacttttctctggagattcctattttctctggggattatgtgattatttt

SEQ ID NO: 240713 - DNA, 915 bp, Homo sapiens
aaaattccgaaagataccatctatcagggacggacagacacttctgcattgaggcttaaatcagctatctgagtggaggtcaggggaggggcagggttcaattagtcttcactgggaacatttgcaagatgttcaacctaagggcgcaacagtcccgatgttctgtgtgatattccagacatggggagcgctttattcagtttctagagcccagttggaaaagaatcctgataagtgggggtcctagaaggttgctcagaattccaagggcatggaacgatgtcattaaaagaaagtatgtgttcccggggtcagttctgcctgttcatgagacgtctgtgggagatgtggccgcctctctcagggtgtgtggttatgaggaagtcaactgtgtggctcaggaacagcccggtgagaactccctgggaggcaggctgtattccagggaggaactttctagcaacaagagggttccaatgtgccacaggttctaggtgacaagtgggactccagcagaggctgcaggaacctgcccaggaccctgtggaaggatgtttcatctcgggtggaaagttgtccacaatggcttccatggtttcattagacaaacactattgaagatgtgtgcggcctggcacagtggctcacgcctgtcatcccagcactttggcaggctgaggcgggcagatcacctaatgtcaggagtttgagaccagcctggccaacatggtgaaatccccgtctctactgaaaatacaaaaatcagccaggtgtggtggcacatgcctgtaatcccagctactcaggaggctgaggcaggagagtcgcttgaacccagaaggcggaggttgcagtgagctgagattgtgccactgcactccagcctgggtgacagagcgagattccatttcatta

SEQ ID NO: 240714 - DNA, 1460 bp, Homo sapiens
ggcacgaggagcaactgctaacagcgaggaggggttttgaaaggtaaaggccattagcttggaggcagaagacagacctccctgactgctgaattcctgccggcctgaaattggagcattccaagctcctcagatgagtcataagccaccaagattgtgagcctctgggcttctcccagcttgtaggagaaatgccttgcaggtgaagatggtgaggaagttggccctgaaatagcccagcccctcgaagagacaaacagggaggagcatcattcaggtgcttcactgggaaatgaaccaggataatgttcatcttaaaataacctacttcaatgaacattctgccaaaagacaaaaggaaggtattgctaggtaatgtgcagccactctgtcacagtctttttttttaaatgaacacaaattccttgactgtcttcttgctgagaggtgaggtctctgtccccctcctctccctacttgaatctggatgagcttgtgactcacttataaccaagaatatggaagaagtgatgctgtgtgatctcctcatgcctggagcctgtgagcctctctctgagaagtccagtgcccctgagcccaccatgctgaagaagccacctggagaagcccctgttgacagagagccagcatcacctgccagtcaccagaagggagccatctcagacatccagcccagctgagccttcaactgactgctgccccaaccaacatgtgaactgcaaccgcatgagagaccctcaagtgagaaccgcccagctgagcctttcccaagttcctggcccacaaaacccagaacaaattaaaatgagtgttttaagccattaaggagcagggtaatttgttacacagcaacagtaaccaggacacattcccaaacctaactaggaggaaatttcctcttgataaaaatgctgatttttttattcatcctagaccttcataagtcagaatcatctgtggataaggtataagaatctgcattttttttaagacaagctctcccaccccaggtgattcagatgcacagccaggtttggaaatttaagaccttggaagagagtcacattgcctctctctgagtctcagcttccttgtctgtgaattggggaggagtgagagttggtgtgagtatcaaagaagacgctgcaggtaaagtctttagggccagccaggcgtagtggctcatgcctgtaatcccagcactttgggaggccaaggcgggtggatcatgaggtcaggagttcagcctggccaatatgatgaaacactgtctctattaaaaatacaaaaaattagccaggcatggtgccaggtgcctgtagtcccagctactcaggaggctgagacaggagaatcgcttgagcccaggaagcggaggttgcagtgagccgagatcacaccactgcactccagcctgggcgacagagcaagactctgag

SEQ ID NO: 240715 - DNA, 1009 bp, Homo sapiens
ggagcggctgggaaagaggagtctctcgaaattcagcaactgctaacagcgaggaggggttttgaaaggtaaaggccattagcttggaggcagaagacagacctccctgactgctgaattcctgccggcctgaaattggagcattccaagctcctcagatgagtcataagccaccaagattgtgagcctctgggtgctagccaggatcactccctccgaagtcacaccagagggagggctggagggagaatcaaatgaaagagagagggagagaaaggaaggaagagaaggagggagaatggaaggatgtatggatttggatgtatgggttccattccttctaccctggcaaaagcttactcatccttcagtgtccatccaaaatggcatctcttcttgggcaccatctccagagtctccttcaagcaggtagctacatcccacaaaacaaccacccatctgaccatgcaagtgtgtgggggaatgaagaccagcccaggaatctgagatgaatgttttgcttcttgctctgccactgactcacagggtaccccaagcaagtcccttcacctcctcggtctcagtttctccatttatactactaaggcagtggacatgatggcctcaagtctcaacatttttattccctgaaaagaaactcttggtgctgagtggtcttcttctgccctgacatctcacctttcaaacgcttgtctcttctcaccccacccaccacttagcatgtgctcttggagaacacccaggactcagggtctctgcacacatcatgagtccagctcagcatttgaggtggaatcagaggaaaggaaggagagtggggagaatagtcagtattttggcaagctcatcataccttccccctttgtatagaaacttcaaaccatttcctttgaaggcactacctccttcccccagttataaatgagtgaaggtctcaagcctggacaaccaaatgcacagtgattggttcaactctggacctgtgact

SEQ ID NO: 240716 - DNA, 555 bp, Homo sapiens
ggcacgaggagcaactgctaacagcgaggaggggttttgaaaggtaaaggccattagcttggaggcagaagacagacctccctgactgctgaattcctgccggcctgaaattggagcattccaagctcctcagatgagtcataagccaccaagattgtgagcctctgggtctaaagtccaccaggtcagggagcaggcctgtctcgtcttctagtcttctactgtatctcaatacaatgcctgggacaggagaaacacccaatacgtatgggcagaataaataaatgacacagttctggggtggcagcagatcaatttcctggtctgtgtctcttcaatggacaagtcgatacatctctgctgctccacgtgtagtccatggaccaggccccttctcatcacctgggagctcatgagcaacgcagcatctcagtatcccaccccagacatctgcatggactgaatccagttcaccacttgcttgagggtaattgcacataagtctccaagtctcagtttcctcagctgaaaaataaaaggtaataaagcccatta

SEQ ID NO: 240717 - DNA, 428 bp, Homo sapiens
tcctggtttcaagcgattctagtgcctcagcctcctgagtagctggaattacaggcgtgcaccaccacacccggctaatttttgtatttttagtagagacggggtttcaccatgttggccaggctggtctcaaactcctgacctcagatgatccatctgcgttggcctcccaaagtgtgcccaagtaattctataatgtagccaggatgagaaccactggtatcaggtctagacccagggactcattattataaaacattcccctttgacataccttttcatccttgagtcaggacaattttacctttcagaaagtagctacagtccttttataatttactcctcaccaaaggtaaaatacatccattttctctgtgtgtgacttctgactattctgcactgattcaataccccttcgttttttgctt

SEQ ID NO: 240718 - DNA, 889 bp, Homo sapiens
aaatttaataactggtagggctggtctcattcttctgtctcaggtttttccaaagtactctcatcccttggtctgtggggaaccggtcctaggacctctctcatataccaaaatccacagacgctcaagtccctggtataaaatggtatagaattcacatataacctatgcacatcctcctgtatgttttaaatcatctctagattacttagatgagactatctaatactatgtaaatagttatactgtattgtttaggaaataatgacatttttaaaagtctgtacatgttcagtacagacacagtctttttgaagtattttttatccctcctttgttgaatccatggatgcagaacccatggatatgaagggctgactatattctcacagttatattcaagttgtattttgaatgattttatgacaatcttttaccaaagggccaactgtattctcatgtttattattcaagttgtatgacaatttcatatcagccccccagagagttggcatttggattgaaatcatactgagtctctagattaatttagggagaagtgacatctttataattttgaatcttcctatccatgtatatgcgagtgttttgtatttcagtggcattttcaaattttcttcaggtaggtctcttagtgtttattccaaagcatgtcatctgttaatgcttttgtgaatgaaatgtttacctccattatgttttctgattgtacataggaaacatcctgatttgaattacaaatattgtaaccagtgccttatctaattattttatgaattttaatagttttctggttgttctttggagttttcaagtgcacaattatataaattgcaaataaagatcattttacctcttctcattttca

SEQ ID NO: 240719 - DNA, 420 bp, Homo sapiens
aatttatataattgtgcacttgaaaactccaaagaacaaccagaaaactattaaaattcataaaataattagataaggcactggttacaatatttgtaattcaaatcaggatgtttcctatccatgtatatgcgagtgttttgtatttcagtggcattttcaaattttcttcaggtaggtctcttagtgtttattccaaagcatgtcatctgttaatgcttttgtgaatgaaatgtttacctccattatgttttctgattgtacataggaaacatcctgatttgaattacaaatattgtaaccagtgccttatctaattattttatgaattttaatagttttctggttgttctttggagttttcaagtgcacaattatataaattgcaaataaagatcattttacctcttctcattttca

SEQ ID NO: 240720 - DNA, 334 bp, Homo sapiens
gtcctgggcccatctctctggcagcttctccggcgccgcacggggcctcggcggcgggagagacgtgggggcgcgacgccccgacgcgaatgcgcggggaccgcgggcccttcgcgcacgcgccgggcgacggaggcgcgctcgccgcttcagggcgcaggcgcagagccccggccgccctcgcgccgccgaagtgtgcactgctctttccggtgcttgccgggtgctgggcgtcgtgaggcgcgggccgcggagaccccggctgggcgggaaggaaggggcgtgaacggctctcagcttcgggctcctgaggacaacgatcactcgccctcag

SEQ ID NO: 240721 - DNA, 439 bp, Homo sapiens
gcagaataatggccaccccaccaaagctttctacagcctaatccctggatcctgttacactacctggcaaaaggctttgtggatggacttaaggttatccaggtaggcccaggacaatcacgtgggcccttaaaagtggacaaggagggccaggcatagtggctcacgcctgtaatcccagaactttgggaggctgaggtgggcagatcacttgaggtcaggagttcaagaccagcctggccatcatggcgaaacccggtctctactgaaaatacaaaaattagctgggtgtggtggcacacacctgtaatcccagctactcaggaggctgaggcacaagaattgcttgaacctgggaggtggaggttgcagtgagctgagatcacatcactgcactccagcctgggcaatagagcaagactgtctctctctcaaaaaa

SEQ ID NO: 240722 - DNA, 425 bp, Homo sapiens
ctagaggatcccaagcactgtaggctcatcttagagtcggctatgacagctgttaatacagccagctatcattgcccatttgtaggcctaactttattttcattcttatattatgtagaagatgcagaattgcctcctggactgaattctggggatgagggctgacaacatcccagattgtaataagtggctgctccagggatgacaggggttcaaagagacagggtggtatgaaaacagtctgtgaactgcaagtctcatggacccgattctagtgtcagctctgtcagtggtcacttttgctcagtgactctcagtcccctcatctgtaacatgccttgcttatctttcccttggatttgttgtgaggctccaaaaatgagaaaatgttaaataaaaatgtgttttgctatataaatgtcaga

SEQ ID NO: 240723 - DNA, 151 bp, Homo sapiens
ctagaggatcccaagcactgtaggctcatcttagagtcggctatgacagctgttaatacagccagctatcattgcccatttgtaggcctaactttattttcattcttatattatgtagaagatgggtaccgcagctcgcaattcagtaatc

SEQ ID NO: 240724 - DNA, 385 bp, Homo sapiens
gtttaatatccatctacctggaaacttcaacattccaggcctgccttccgggaacaccaggcattacaatgagagttagaagtatatttgttaacttgaaaaagtgtttaccataaattatgggtttttttggttttgtttttttgttttctttgtagagatgaggtctcaccgtgttgcccaagctggtctcgaactcctaggttcaagcgatcctcctgcctcagcctcccaaagtgctgggattacgggcgtgagccaccatgcccggtccataaattatgtttttaaagtagataatcagcaaatgatcctattttggttaacacaaacacacacacacagactcccccagcctgagcaacatggtgaaaccccatctcta

SEQ ID NO: 240725 - DNA, 2074 bp, Homo sapiens
  misc_feature (1)..(1): n is a, c, g, or t
ntttaaaataaaaatcaaatttcagcagaaagattggagaagagaaagatattacttgattgagcaacagagaaacaatgcatgaatccacacataaaactctttaagttgagtaaaggaggctttcaaaccctaattcatgcatttaacaactaaaatcccagcttttcccatgttgagtttacacagagaagttaaaagataaatagactttatcagactttgacagtaaattaaagaccctttatcttcctgcctggaagttctataaaataatgggtaataaaggcaagctattagtcaaaatggtctgaattaagcctggaaagaaaatcttgcctctaagagcagaagggtgcaaaacactggcccctcctgggcttgggcccagagacaaaggaatagtggttactatgacccaacatcagtctgcagccagagttccaagcatcttctctgctatccctaatgatttaaaaatatataaaaatatttcacattctttaccctccatcagaatgcagtgagcagtaagtcagctcaagaaaatatgacccagtgcctaacccgttgatactttattagatgccattaaaactttagagagctgggagattattaaggcctacatttggaacctggaatcttttcctttgggaacctggaatctcaactcaaggattctgtagcttgcttttttgcctgtatctaagattgctctattttgtgataatgtaaacttaatggaagaaaattacttcatagatgctagacattcaagaattaaatccccttttcatgttagctagtgtcaaaacatttgtttaaacatggtttctaaattttgatggggtagcatacatggttttattttattctgtagatgtagtgaaaaaatattttattttgatacattaacaaggaagataagacagcattcattttgagtatttgctatagaatataccctgcattggactgtgcgtggagtctggtatttgtatgtttcaaggaaataaaggtacagagaagcacttgttcgttgcctatataaagactaactgtacagctgacagcttaaaagtactgtatgacactgcatttcttgtccaacagtagcgtctgtttccttcattccaaaaccaaaaaaaaacattaaagatgaatgctgaaaatgtgatagaaaaagaccttcctttttggcatgtccattaactgccctcaccgttcttttccaagcataactgctagactggatggcataaattaaacaattaacaggatactagttcaaggggaaactctccagttagggtagatttaattttcagatttggaaaatgaatcaaattacacattcaaaagacttgaattcatttttttctctaagcatgtactttttataatatacattgtctaacatcggagagataaattcagtattattttcctaagatactttctgccttttgtagcagtgagaatactagaaatcagcgaggcgtggtggctcatgcctgtaatcctggcactttgggaggccaaggtggacagaggtggtccaagagttcgagaccagccggggcaacatggcaaaaccccatctcggccgggcgtggtggctcacacctgtaatcccatcactttgggaggccgaagcgggcagatcacaaagtcaggagatctagaccatcctggataacacagtgaaaccccgtctctgctaaaaatacaaaaaattagccgggcgtggtggcgggcacctacagtcccagctactcaagaggctgaggcaggagaatggcgtgaacccgggaggcggagcttgcagtgagccgagatcgcgccatggcactccagcctgggcgacagagcaagactccatctcaaaaaaaaaaaaaacccatctccacaaaaaaaattatttttaaattagccaactgtggtggcacacctgtagtactagctactcagaaggctgaggtggatcacctaagcctggaaggtggaggttgtggtgagcagagatcgtgccacttcactccagcttagcaacagagtgagaccctgtctc

SEQ ID NO: 240726 - DNA, 654 bp, Homo sapiens
agctgaagacaaattgctgggccacctgggcacagcagcgaagtgtggcaggagccaggggcactacgcaaacatgaggaacaccttcttcagcctggacaatcagccagggagagtcaagaactacagagacaaacgaagtcagtgctacccgacggcaaaatctgaaatcacaggatgtttggagggccttgagtggttaaaaaaactaaatatctatatggatatacatgtgcgtatatgtatgtgtgtatatgtgtatatatgtaacattttatatatatatatgcatatatttaaaaggtctccaaagatgtgctagcattctttcagtaaactcgaacctgccttgtgaagattccttcattcgaatggtggaatccacccctccagccacacacctaatagtacatcaacgtggggcttgggatgcagaactaatgtcatttctatcaatcagggacgccaccacaccttgctggcttctgccacggataacgatgaaactacatttaacactgcctggcactaaggtttagagttatgagtcggtgcttccctgtcacttcacttaaccctctgagtgtgtagtttgtagatttgttaactgcactgagaggtcccctggtgtgacctcaaaataacggcctctcc

SEQ ID NO: 240727 - DNA, 355 bp, Homo sapiens
tttccttgataacataccagcaaacacactcatcccatgcatgttgttaaaaatccatcaatagactgggcgcggtggctcacgcctataatcccagcactttgggaggccgaggcaggcggatcacctgaggtcaggagttcaagaccagcctgaccaacatggagaaaccccgtgtctactaaaaatacaaaattagccagccgtggtggcgcatacctataatcccagctactcaggaggctgaggcaggagaattgcttgaacctgggaggcaaggttgcagtgagccaagattgtgccattgcactccagcctgggcaacaagagtgaaactctgtgtgtcccccccccc

SEQ ID NO: 240728 - DNA, 1048 bp, Homo sapiens
taaagccaggaagccaaaagacaatacaaatctgtgcttcctatttcaacacatcaatttcagcaacgactgcttcttttcagaaaccgcataagcatcgtcaaattatttgaattaatagaaggatttttctaaggggtgtggtttcaacttaataccatgatttcttgtaccacttctgccatgcttaaaatgtccggccaaatcaaacaagcagactcactaggctgaagtttgatgacctttagaatactgcagaaaggactgtgctgagttttgcctctttgggtcatatcagacaaataacctcaataatgatatacaaaggaaaatgtaatatgccagagacgtacatcatcattatgcaagacgctaaactttgaggaggccaattttaaaatcatgcttctgaaacatgtttactacataatactgaaaacaatcaaatcttgctgtcatatttggagaagacaagtgggagattaccagtttgtgctactaaagaatgttcccaaaaggaatgatgatagaagctacataaaatgtttatgcagcagagagggcgctttcatttttcatctggtttttggtttaacataagtaggcctgcttgttctctgagccagtaacaggctacctacaattccacgggcgctgccctttctgataggagctgtagcggttgggtctgtctgcctcttctctctcatttcagttcttaaacagcttcccatcaaccaaggaaactcctgggtagacagaaaaggcagtagagacagcctctccagctgttttattgggagttataggattttcacctggaaggagcctcagaaaacaagctataaaggcctttggtttcatatcgtggaggagaagaacaacacacatcaagatacccattctgcagaccagaaaactgaggaccagagcgagtaagcaaatagtctatagtcacatggccaataaattaagaagctagggctacaaccagttttctgggacccaggccttttttttctttcctcctagagatcgagttttccaa

SEQ ID NO: 240729 - DNA, 87 bp, Homo sapiens
ttttctttcccttccttccttcctgcctttctttctcttcctttcctttccttccttttttctctctctccctttctttctttctct

SEQ ID NO: 240730 - DNA, 457 bp, Homo sapiens
atgtccctcagtaggtgaatggatgaataacctgtggtgcatccagacaatggaatattattcaatgccaaaaagaaatgagctatcaagttataaaatgacatgaaggaaacttaaatgtgtattactaagtgaaagaagtcaatctaaaaaggttacgtactttatgattccaagtatatgacattctgggaaaggcaaaactatgaaaacaataaaaggatcagtggttgccaggagttaggtgagaaagacggataaataggagaagcgcagaggatttttagggaagtaaaactactctgtgtgatacaataatgatggatacatgtcattatacacttggctgggcatggtggcttatgcctgtactttgagaggtcaaggtgggaggatcccttgaggccaggagttcaagaccagcttcagcaacatggtgacacgaccccatctctac

SEQ ID NO: 240731 - DNA, 331 bp, Homo sapiens
agattaaaggtgaagtcatgagggtaggtaagttctctaagtgtaataaaggagctggacacagtgtctcacgcctataatcctagtactttgggagtccgaggcacatggatggcttgagcccaggagttcaagatcagcctgggcaagatggtgaaaccccatctttaccaacacaaaaaatagcctagtatggtggtgcatgcctgtagtcccagctacttggaaggctgaggtgcgagaattgattgagccggggagattgaagttgcagtgagccaagatcacgccaccacactacagcctgggtggcagagcaagaccctttctc

SEQ ID NO: 240732 - DNA, 2050 bp, Homo sapiens
  misc_feature (610)..(610): n is a, c, g, or t
agttgggcatggtggcgggtgcctgtagtcccagctgcttgggaggctgaggcaggagaatggcgggaacccgggaggcagagcttgcagtaagccgagatcacgccactgcactccagcctgggcgacagaccgagactccatctcaaaaaaaaaaaaaaaaaaaaaaaaaaaaaaaaaaaatatatatatatatatatatatatatatgtataggctgggtgcagtggctattcagaggctcactcattgtgcgcatggtgcttatggtgcctggaatagctggcactacaggcatgtgttctgtgccagctcaagtcttcaattttgcttcagatctttaactttttaattgtgaaatataactgtatgcagaaaactgcataaaacacaaaggtactgaataacaaataattataaagtgacatctgggtcaataactagaccacagtcagacccctgaagctccctctgtgtcttgtctagtcacatccccctccccttgctcaagaggttttcagtaatcacatcctttttttctctatggttttacctcctagttttggaatccataagcagtatatttcagctttgcatgtttttgaactcngttcaaatggaatttgtacaaaataatatgctgtgcatattatttcttgcttcttttactttatatcattatgtaagattcatccatgttattgcagcttatttcttttttgcttgtttatttgtttgtttttgtttttttgagacagtctcactctgtcacctaggctagagtgcagtggcgcgatctcggctcactacacctccacctcctgggttcaaacgattctcctgcctccgcctcccaggtagctgggaccataggtgcacgccaccaggcctggctaatttttgtattttttagtagagacagggttttgccatgttggtcaggctggcctcaaactcctgacttcaggtgagccacccgcctcatactgcagcttatttcttcattgctgaataatattccattatatgagtatacccccagttgtttacccattttattgtcatctcaagtttttgcccattgcaaataacattgctgtgagtagtcttttatgtatatcctagtacaactggcacaagttccttcaggtatatgctgaagaagtagaattgctagataataaggcacgcatactttaggcttttgccaaaccatttttcaaagtggttgtactaacttatactcccactagctagtagaaagtcaacactggttcacatgattcccaacatttggtattatcagccttttacatttttgccaatctagtggctatattgtggcatatatttgtggttttaatttgcacttccctgattactagtaaagttaaatgcctttttaaatgcttactggcctttagggtttctgcttttgggaagtgtctgttcaaatctttgacatatttttccataggggctatctgtcatttttgtaagatttgtaggagttctttatatatgctagatatgagtttataggattacaaaggaaatcaattatattgacataatagttatcaaatataaaaatgcaagtatgtgggcttatttatttatacaataaataagatctggtgcaggcgtaataacaactataatatcaaagtgattataagcattgacattatttcaagatatctgcaacaaaaatatctggtttccacttgtgacaacgccacaggtactattaacattatgtactgtgggccaggcgtggtggctcacacctgtaatcccagcactttgggaggtcaaggtgggcagatcacgaggtcaggaagtcgagaccatcctggctaacacggtgaaaccccatctctactaaaaatacaaaaaattagccgggcgcggtggtgggcgcctgtagtcccagctactcgggaggctgaggcaggagaatggtgtgaacccaggaggcggagcttgcagtgagccgagatcgtgccactgcactccagcctgggtgacagagtgagactccctctca

SEQ ID NO: 240733 - DNA, 349 bp, Homo sapiens
tcattctgaataaagcaaggcatttcaaatcaaattacatggagattaaggtttctaaacctttagtaccttagcagattctagccaggcacagtggctcatgcctgtaatcccagtattttgggaggccaaagtgggtggatcacttgaggtcaggagtttgagaccagcctggccaacgtggcaaaaccccatctctactaaaaatacaaaaattagtggggcatcacggcatgtactttggaagcctgaggcaggagaatcacttgaacctggaagtggaggttgcagtaagccaagatcacaccaccgtactccagcctgggtgacagcgtgagactccatctca

SEQ ID NO: 240734 - DNA, 873 bp, Homo sapiens
  misc_feature (46)..(46): n is a, c, g, or t
cgaggtgggtggaccacctgaagtcaggagttcgagacccacctgncccaccggaggaaaccccatctctgctaaaataccaaaattaggcgcgcatggtgaccggcccctgtagtgccagctactcaggaggctgaggcaggagaattgcttgaacatgggaggcggaggttgcagtgagccaagatcgtgccactgcactccagcctgggcgacagaatgaggctccgtatcaaaaaaaaaaaagcaaggataagagaatggcatccattttcttgatattttaagaaatgaagcttccggttctaggcacttggagagccgcggcttaaggtacagacatggccaagtccacgaaccacaccacacacaaccagtcctgaaaatggcacagaaatggtgggctccaggttcctgaggaacatgcactttgccaagaagcacaagaagggcctaaagaagatgcaggccaacaatgccaaggcaatgagtgcacttgctgaggctagcagggccctcgtaaagcccaaggaggttaagcccaagatcccaaagggtgtcagctgcgaactcgattgacttgcctacattgtccaccccaagcttgggaagtgtgcttgtgtccgcattgccaaggggctcagactgtgtgggccaaaggccaaggatcaaccaaggcccaggctgcagctccagcttcagttccagctcaggctcctcccaaaggctctcaggcccctacaaaggcttcggagtaggtatctctgtctgccaacgtgaggacagaaggactgatgcaacccccctgggctgccgtctttatggggctggggtcctcctgtgctattagtacaaataaacctgaggcagggg

SEQ ID NO: 240735 - DNA, 946 bp, Homo sapiens
cagggagcccaggtggcgttagcattgccgctcttttgcacctccccagggcaggtcttctgtcccatgtgctgaaccccagaggagtcaccactgggaactggggcagggctgctctgtgccactgcaccaggctcagctgaggtttccagaaatctgtgactccccgtgcagagggggcctgctctgtatggactccgaccaagcctggcccactctgtctatttcttcctgacctctccagccccgagagcacatagaagctgccagatgagggcagtgaggccgagggccggcagtagggctgcagatgccctgagccctaaggtcaaggtggatggaactgctgtgtaagtctgatgccgaggagaccaggtcgttgggctttcaggtgagtggacgctttctccccactcacaacccccaccatgcagtctctgctcctccatggtcactgtggaatggctcctgatggcgctcaaccccttgccctgttttctcccctgcggtccactgagccagccctgcggccgccaagtctcaggttagagctccctctcgcggccgatgctgggcactacattgcccaagacccaggtgggccgaagtcttgagaaagggctcgcagtcatcgtcgccagcaggcagacaccaggcacctacctccccgacatacccagcctggtacctcgaagaccagtagccttgagctacacttgggattcccaatacagtttcaaaaccgtctagctcatctttcaggaaccttccagggttcacattctgatttttcagtaaggttctcacctctgtgaccaattaccttgagactgatgtcctgcaccatcctggagtgttgggatctgcaggtcgtgaaaagggaaaccaagcaatcactttggaatgacttcctggaacttccctggcccctccttcgtgttctctg

SEQ ID NO: 240736 - DNA, 843 bp, Homo sapiens
gggacggccagcccttcctccccacctgtgcctgcttctgagccaaagccatgacacctgcccttcccttgcagggaggctgcctcaccaagctacctgctactcatgggggcgatgggcatcagggtggcctgcctggagccccgagagcacatagaagctgccagatgagggcagtgaggccgagggccggcagtagggctgcagatgccctgagccctaaggtcaaggtggatggaactgctgtgtaagtctgatgccgaggagaccaggtcgttgggctttcaggtgagtggacgctttctccccactcacaacccccaccatgcagtctctgctcctccatggtcactgtggaatggctcctgatggcgctcaaccccttgccctgttttctcccctgcggtccactgagccagccctgcggccgccaagtctcaggttagagctccctctcgcggccgatgctgggcactacattgcccaagacccaggtgggccgaagtcttgagaaagggctcgcagtcatcgtcgccagcaggcagacaccaggcacctacctccccgacatacccagcctggtacctcgaagaccagtagccttgagctacacttgggattcccaatacagtttcaaaaccgtctagctcatctttcaggaaccttccagggttcacattctgatttttcagtaaggttctcacctctgtgaccaattaccttgagactgatgtcctgcaccatcctggagtgttgggatctgcaggtcgtgaaaagggaaaccaagcaatcactttggaatgacttcctggaacttccctggcccctccttcgtgttctctg

SEQ ID NO: 240737 - DNA, 533 bp, Homo sapiens
gcactgcccaactcccaggggcatccatagagactctgaagggaatggtaccgtctggagtcacgtagtgcaggtgccctagtcatcgaagagagcgaagggctgcgtatggaagttctgatgcatttttctgtctaccaagcgtccagcatgtcccttttctgtggtaaccacccaagtgtggattgcattatgtggtccctccactacatgctcagagaagaacccaacctagagggggcactgagccatcccccggtcaacccagctccctgggatcctggggcgtgtgaagcttccatgcacttcctgagcaggcagccactgaggcagggtttgaaaagggccagttgtgacaggaggatggcgggcgtggaggcaggctctgctccacggattcctcctggcagtggattcagattggaaatccaagcagaagcaaatttacagccccccgagctgtcccagacccccaggcagcacggagccccagctgcctggagtcggacttgggaagggggcctcctggcttc

SEQ ID NO: 240738 - DNA, 468 bp, Homo sapiens
tttttttgagatggagtctcgtctgtcgcccgggctgattagaagtggtttatacttctactttcagagaaactctctagcaaactaaaaatgttatcctcccttcctaatttcacataacagtgagtgaaatgaatcccccaaataaagagggaaatgaagaggaagaaatgattgtggaaatgatagctgctatacaaaaataaatgcaaaatataactgcaaaagactaattcttcagtacaaaaatatgaaggcttaggaatatttttatttattttgtttattttataaagtcatgaagggcagtgttatgccagtcttttcaaaaaaaaaatacaaacacctaagttataagtattaagacatacggccgggcacggtggctcatgcctataaatctcagcactttgggagggtgaggcaggcggatcacctgaaatcagaatttggggtcgacgcggccaa

SEQ ID NO: 240739 - DNA, 84 bp, Homo sapiens
cacaaagtttctcatactctacaatgagcaaatgagaggggcctagaaaacatttctgtcaggtttgagatggtttaaatgctg

SEQ ID NO: 240740 - DNA, 355 bp, Homo sapiens
tgtgtgtcaagttgacaaggggtcagctgtattggctagttttgtgtcaacttgacacagctggagttatcacagagaaaggagcttcagttgaggaaatgcctccatgagatccaactgtaaggcattttctcaattagtgatcaagggggcaaggccccttgtgggtgggaccatctctgggctggttgtcttgggttctataagagagcaggctgagcaagccagaaaagaacatccctccatggcctatgcatcagctcctgctttctgacctgcttgagttccagtcctgcatcctttggtgatcaacagcagtatggaaatgtaagccgaataaaccctttcctcccca

SEQ ID NO: 240741 - DNA, 459 bp, Homo sapiens
ttatagctcattatcacatttttaaaaattgttggtttgttcaattagaacacaggctccatgaggacagggattttgttcagtttttgggaagataatcaggctactgtgtggaatacggactagaggagaagcaacctcttagaaggaagaccagttaaagttgttcaaagggtccatagagaagccttaaaagtatgaatttagggccgggtgtgatggctcacgcctttgatcccagcactttgggaagtcaaagcgggcagatcacctgaggtcaggagttcaagaccagcctgaccaacatggtgaaatctcacactactaaaaatacaaaaattagttgggcacagtggcgcatgtctgtaatcccagctactcaggaggctgaggcaggagaatcacttgaacctggaaggcaggggttgcagtgagctgagattgtgccattgcactcca

SEQ ID NO: 240742 - DNA, 429 bp, Homo sapiens
agttgtggtgatgaaaatgcctgttgcctgcccaggcacttctgggacaataaacatgcttatctagacaagggcctcggccagaggaaacaaggctcagagacagaagcaaaaaggcaggaagaccttcctgacagtaaaggtaattaagaccagaaaccatttaccaaggaatgtatgggtctccttttcctggagattatagaaacctggaagctaatgggcccccagagagcagctggtccagccccttcattgtatagataagaaaactgagtcccacaaaagaaggtccctgcccagggtcacagagctgcataatgtaagagcagagaccaagacctgatgctgggactctctggccagatcagtttccattactccaagctgagaggcctccttcaaccacaggacagcctggctgatttt

SEQ ID NO: 240743 - DNA, 2008 bp, Homo sapiens
  misc_feature (772)..(772): n is a, c, g, or t
  misc_feature (937)..(937): n is a, c, g, or t
  misc_feature (1173)..(1173): n is a, c, g, or t
  misc_feature (1973)..(1973): n is a, c, g, or t
  misc_feature (1976)..(1976): n is a, c, g, or t
  misc_feature (1978)..(1981): n is a, c, g, or t
  misc_feature (1984)..(1999): n is a, c, g, or t
  misc_feature (2001)..(2001): n is a, c, g, or t
  misc_feature (2003)..(2004): n is a, c, g, or t
  misc_feature (2006)..(2006): n is a, c, g, or t
aaaagttgggaaattccttgaagcaatgttgggcctattggtgcagtttctctgcagtcagctcactttatagaggaagaactcggctgcttcagctcaatgtgagttaaacgttgcagtgtccagtcttgcttcctggcagttggggcccggagcagccccgaggcggggaggggggacattgtcccctttgactatgtgattgttggaagcagggtcctgagagggagtccaggaggcagcctaaatggaatttccagtctaaacgggcaaggcacagttgcgggagtcctggtgtaaagtccagtgagacagagactggggcttggggtgggatggggattgctgacaagagagaaggatctctgggccagggaagaggcagctgcattcgctggctgcgaggctgtggctctaggtgtggatatgctagggtgctccccgcagcccccagacctttcatatgtcagcattcccgtaggtggggcatgtgggacccctgcccggggccctttttccagtgtgactgtccctatagggtgaggaatctgaggtatcaagaagtggtatctccctaaaacttgtgcctctccctttaggccatgcacagggacagagaccctggaattccctgccccagtaacccccagaccccttacatggcctgcatgggccgcctccctggcgtgtcctgctgagggtaggctgtgcactgtgtgcacgtgcctccagccaaaggtggctgaatggtggccatgggcagggtatgtgnggacagagcttgggtgtgcaggctggggtgtccccataagcacgcccgagggtctttgtggcgcaggacacggctctggattcatgtgtgtgcctggtttcttgaatggtaaagttcatgcttattttctgggtgtgtttggggttgtccctccctatctgacanatggggcttgggaccatgcctggagccccagttgcatggggaggtggggttaagagcaggcctgtccccctgctcagcccttcttaccaccaaaccagccacacttgagcaggagcgcactgcactgtcattttacccaaagtttccctctagggctttgctgatgacatctcttggcttttgttagcattctggcgcaatatcagaaggattccagtctacatcgtggtcttctngagagctcatatttgatttcggctttagctcactggactttagcctggaggaatcccactgaagagtttttaatgttgacttatggaacttgtcccagcagcaaaccacagatactgtggcttgggggtgagcagctcttgtggaaacaaggcacttcccttcttcagctgcataggagtgcttcaggaaccttttgggccacattcttcttgtgatttcttgacttgtgggagggcagggaagtgatgtctgggtcccacagcgcacatggctgtccctggtgccgcccttccaggaggaactgccaggtcggatgtggagatgaacccggagagtgtccttcggctctggtcggccttcaggggcattcctgccagtctcagaagatgacagtctgcaatcgtgttatcatcaacgtggaaaaaataagggcaatgcagttttcatgtgtgtaaggttagcagctgccctttcttgggaagggctctttctgtataaaattttgaccattatatcttttacattttaaaatgtcctatctttccatgttgatgaaaagagctggtagtttctaaaggatattcttacttggcaaaataagaagtaagcagtcttatgttattctgccttcaaatttgaaacagttttattgagttataatgaacaggcgataagttttggcatatgaatacactgttaagccatcattgcaaagaagatagtgagaagtccaccctctgagggttcctcttgccacttggggtccctctgcccccacttcttccaggccaccactgcnctncnnnntgnnnnnnnnnnnnnnnntncnntntc

SEQ ID NO: 240744 - DNA, 472 bp, Homo sapiens
gtgagcttgaactaagtgatccatgtggcccccggtcacaaggcctagtgctaggcagcttacctatattataagtgcatgctgcctaaaaggagtaaatcctttttttgaaaactattaccatatttaatgttcttttttgagtcctgggaattactataaaatatttattatttcaaaaacaaaaataaagattttttaaaaaaagttttctagagcaaagccaccgtaagaaagtttgtaaccagaggtttttgaattctaatttgatgctgaaagagtagaagtattatgaatgtataagcaactccccattcccccattaatagtttttcccaatcaaataatgttgccataaatagttgttgttttatatattaatgggtttacagtgaactgccacttgtttgtttggtctaccttaatgtgttttactctttattttcttaatgattttggccgctaaaatgga

SEQ ID NO: 240745 - DNA, 463 bp, Homo sapiens
ccagctaatttttgtatttttggtacagacgggggtttcaccatattggccaggctggtattgaactcctgaccttgtgatccacttgtctcggcctcccaaagtgctgggattacaagcgtgagccaccgcacccagcctatttaacttcttatctgtaaaatgtgtatactcttagtaccttcctcataggaaggtactccatgaaagtacctctatgaaggtactccactttggatggatcatgagcatccatggtgacacactgctccaccttcacattttgtcctagtaagggaggttttgctaaccagggaaaaggctctgatccccaggtccgacaggctatgaaataacactttgaagatgtaaaaagcagggatttctgctgccctgtcctcaggcccccattccttaggatgacacatgtttacctctccagcctctcccttttgccaggcca

SEQ ID NO: 240746 - DNA, 264 bp, Homo sapiens
  misc_feature (17)..(17): n is a, c, g, or t
gggctgcagggaattcnggcacgagagagaaaaggaaggggaggctgaacaactttcaaattccgttatatatcaaaggctgttattattttactcaacatattttatgcattttcagagaaaaatatacttttgagagtgacttgctatttgaaattgacctagtcatagactcatcttaatatggaaaattaagaggtggttgtgattacgtgtgctttcatcagtgattcttttgagcagcatataaatggggttagtaca

SEQ ID NO: 240747 - DNA, 2794 bp, Homo sapiens
  misc_feature (109)..(109): n is a, c, g, or t
  misc_feature (1113)..(1113): n is a, c, g, or t
tatgcatttggttattcataatcagattttgttctgtgggttaaagttgaataatattttttgaggctcaaattgttctagctttgaccattttgggagctccttccgnttgtctcctgtgttcttctggtaagcccctgccatttttttttttaagtgtttccttaatttcctttactacaaaatattccaggctcatcttgtaacttcgctgccccagccctagagtcaggcacttctccacggagtcctgctttcctttattggagaatgctgtttagaaaccaaggtctggttgctaggtatgttcattgctacagcagttatcattgcttctgggtcctctcagcagacaaagctaggaaacagataattcagcacctatctgtatatatgtatgctaaagaatatgagtttgtactgataacgcttattctgatctaacctcaaaaagttcgttttattttagtctttcccttttcatgatgacttctttctccaacagtgaaaaaccctctcagtcattttcttagttggggtgaaggttattttccactggttttgctcctattatcgtggccctgattaacacacatttccacatgtggactatagattatttgactcaactcgcctttgagatgataacatctggaggcagaggcaagtgtttctgattttacatactctgtgattctgcacccagagctgcactaggatgtactgaatgcttgatcagcatcttacctgctgaataccccatttggatctgtgcccgctcggctatgctctccctctctgcagttcacaactctcctgccaattgtatttgtcttaaacaatactcctttcccgttcctagctttagaattctttgtgagatgagaactgtagcctaatgttagaagctctaaagcctgcccggtccaagatcagaaaccactaccactcatttccataccacctgctcttggtaggcatgtgtcagtagaatggattaattggaagtaaactggaataggacagagtgcagagacccatactgcctggccctgccacctgtgaccagaacttgtcacttcactgctctggggagtggaggtctatcagagnaggcaagtgtgttagtatgacacacttagtggcttgaaacaacacccgtttatcatttctcaattctgtaggccagaaggctgagcattgcatgactggcttcattgctgggggtcctagaagactaaacttagggtgtcagttgggttttcagggcctctgccaggctcagatggttgtggaaaattcagctccttgtggctataggactgaggtcccctgccccctcacccctattttccattgctggctaccaggcaggggccactctcagttcctagaggcccccatatttcctttccatgtggtctcctccatcccctgtgacacagcctgtctcccacattgagtcctgctcatgcttcagctctttttgccaagaggagccatccttgtaagggctcaccagctttgttctggcccactcaacgtaatttcccttctcaggtcaactgatgtggtcagcaaatacctgcaggctcacttttgccacataatgtgccatgatcccaggagtgacgtctcatattcatgggtcccgcccatacacagcaatgagggtcactggagtcactcttagtgttctgccagctgcagctgaacatgatcaggtcttaattctggcaccaaagtatttacctgtggatctgtgtcccatggttcccctgacaagataccagaaacttggtggcttaaaaacgacagaaatgtattcttataggtctggaggccagcagtgtgaaatgcaggtgtcaccaggaccatactccttctgacagctctaggggagaatgcttccttcttttcccagcttttggtggctcctggcattccttggcttctggctgcaccactcccatctctgcctctgtcttcacgtggccttcccctgttggtgtgtgtctgcatgtccaaatctccctctcctttctcttataaagacataggtcattggatttagggcccatcgtaaatccaggacaatttcatcttgacatccgtaactgattttatctgcaaagtctctatttccaaataaagtcactttctgagatttcaggtggacagttatttgcggggatagtattcaccccactagattcagggttgtgggaagtgttgcttactaaactctggttcacggagctgccaaagaaaagagatttatttttaaacctaggagagaaggcaagcttggctgctgtggaggctggggcccatcctcagaccatctgctcccctcatggtgacacagatctgaaaaccaggtgggttgaaggctggcctagaggccctgtgtccttaagatccagacactttgcagtacagtcagctcgcagtctctgtctttgtggattcaatcaaccacggatggaaaatatttgagaaaagaaacaaaactggccgggcgtaatggcttacccctgtaatcccagcactttgggaggccgaggcgggtggatcacgaggtcaagagatcgagaccatcccggccaacatggtgaaaccccgtctgtactaaaaatacaaaaattagctgggggtggtggggtgtgcctgtaatcccagctactcaggaggccgaggcaggagaatcccttgaacccgggaggcagaggttgcagtgagccaaggttgtgccactgcactccagcctggcgacagagtgagactccatctc

SEQ ID NO: 240748 - DNA, 376 bp, Homo sapiens
aaactctgcctcgaatctcgcttttgacttggtcctatgagctgagccaacatggcgtctcccactgcaccgcgagcgccgggctgccaggctcggcagggccgggtaatagaaaacacattggttaccaaaaagaaaaaaaggagggcggggggcgctaaaggccattccgtctgcaggcagaaaacccttttttaaactcttgctggcaagtgagtccggtcctcggttctttaattaaagcaacagaattcgtaaggaaaatattggtaacgctgtaccttctccccctccccctcccatattcaggagagttgatttcctgtcccctctccttccaagaaccaaattagaaaaataaaaagtctgtatccgc

SEQ ID NO: 240749 - DNA, 493 bp, Homo sapiens
ttcatgtgctgtagaccatgtctcttcctgcttcgtacccctgccaacgagctattgcagatgtgagatgtatgtgctggccgtggtttggtctgggttggttcttggttaagtaacagagttcttataactccccaagttgcatctgggcagttcctaccttgtctccaaccctttttcaggttgtcgttctgcccattggcctgagctttaactctctcactcactcactatagactgagcttgtggtctcagagacctttggttttccatcataagtgtttgatcatttgtgactgagggcagaccaggaggaccagggcgagagctgggctgggcagttagacaagtggagacttagtgggcctgcactccacctctgggaccctccttctcattgaaccagggcagtttctggtattttttgttttgtaatttgttctttagcataaacatccatttgaagaaacagtttcatagctaaaaaaaaaaa

SEQ ID NO: 240750 - DNA, 525 bp, Homo sapiens
ccttatttaaaatagtaaaaaagtggaaacaatccaaatgtccatcagctgacgaatggaaaaataaaatgtggtatatccatacagtgggatattgttcagcaataaaaagaaacgaagtactgattcatgttgtaacatggatgaatcttgaaaagttaagtgaaaaaagccagtcacagaagaccacatattgtattatatcatttacataaaatgtctagaataagcagatctatagagaaagagagttgattcgtgtttgctttgggctggggaaatgaggggaaggacagctaatgagtacagggtttctttgaaggggatgaaaatgatctataatttgattgtggtgatgtttttccaaacctatgagtatattttttaaaacattgaactgggccaggtgcagaggctcatgcctgtaatcccagcacttggggaggctgaggtgggagaattgcttgagcccaggagtttgagaccagcctgggcaacacagtaagatctcatctctgcaaaaaa

SEQ ID NO: 240751 - DNA, 435 bp, Homo sapiens
tgcattgcttaataatccttttaaaagtgttattgtagatgcccttgattagggaaatgcatttccattttctgagctgtagggtctaaaactgtgtttgctttcttgctttgttcttgcttgggtccttcatttatcagaacaatactaacaaatggctcttttctcaggtatgtgagccgcaggggtaactcagacctaaattgccttttcactttttttcttgctatgcatgcacatgcaaaaacgtccaccttcagactttttactggtacatcgcggaggaaacttgagtgtcggtttaagtctgcgtaactgagaccatagctctgtggctttcactgcacttcccagtgctgagtagactgctgggattccacaaataaataataaaaataataatgatttttcaagcatttggaaatgctgagttga

SEQ ID NO: 240752 - DNA, 914 bp, Homo sapiens
ggctgatcttgaactcctgacctcaagtcatccacccgcctcagcctcccaaagtgctgggattacaggcatgaggcacagtgcccggcctcagtttctgcagttcttgctttttaacagttgtttaccctacaaaaatggaaaatatacttggaaatatttgtggacatagggcttttaagtatatgcacttagagatagatacagacaacctatggattaggaaataggacactatccatgtctgaaatttaaataaggtccaaattagcttagatccaatatgattccccaatgcatatatgaacaatacgtgaacattgttgtgtgcacaactatggaaaggtcttaatccgcacagtgactctgagataagactcactgaaggaaatacagcagcaaacccaggagatgtgagttccaatcttcatttgtaactcactccaaatgagatcctagcaatgaagtaatttttttttgtttcccactaaaaacaaataaacaaaaaccttagtttttctatgctacagaattaggatgacaaatgaacttatcttgcagtcactataagaacactgacagtttcagagatagtattaaaaatcaactaaacacttataattattgtgaaagcatttatctatcaaagaaggttagcctgcagccagttggaaagttttttttgttgtttttttggtttgtttgtttgtttgtttgtttgtttgtttgatagagacagggtctcactatgttgccaggctctcctgggctcaagcaatcctcccgcctcagcctcccaaaatgctgggattacaggcatgagccaccgtgtccggctgccaggtggaaagaacaatttaaggagatggttaaaagtggaaaagccaataacatggtaataattgaaataaaag

SEQ ID NO: 240753 - DNA, 562 bp, Homo sapiens
gagcaacttcagtttcctttggtcttgctttgtttctgaaggctgtccttcaaaacaattatttctctgactttctcacccttgctgcagacccttgctaatccttgaaacaaatgagtcagaagcaacatgtggtgaaaatcagtatgcaaatatttcactgagggttactgctgtttaaaagaattcaatttttgctatgacatttaacagtgcagaatttaagcgtgtgcgtcaacattggggaaataatacatggtgaaggttgtatttcatcttctcagggagctaacactgtcctgttattgtttcagtagattttagttcctgattagtacagttagctttttcagtcatctagattcacacttcctcattgttagggagtgctcaaaagcagagagtcaaatggctgaatgttttttggtatccctcaattttggatccttttgcacctagaaacattaactttccctggcatcctgttacctgttacctgtgagctgccaaaatagtaagcggtgtatgattacattagtgtctgtaaaattgtaatttgaat

SEQ ID NO: 240754 - DNA, 616 bp, Homo sapiens
gagcaacttcagtttcctttggtcttgctttgtttctgaaggctgtccttcaaaacaattatttctctgactttctcacccttgctgcagacccttgctaatccttgaaacaaatgagtcagaagcaacatgtggtgaaaatcagtatgcaaatatttcactgagggttactgctgtttaaaagaattcaatttttgctatgacatttaacagtgcagaatttaagcgtgtgcgtcaacattggggaaataatacatggtgaaggttgtatttcatcttctcagggagctaacactgtcctgttattgtttcagtagattttagttcctgattcaaaacagcatggctgcttctcatttctctttcagcaatttgagggtaggagttagtacagttagctttttcagtcatctagattcacacttcctcattgttagggagtgctcaaaagcagagagtcaaatggctgaatgttttttggtatccctcaattttggatccttttgcacctagaaacattaactttccctggcatcctgttacctgttacctgtgagctgccaaaatagtaagcggtgtatgattacattagtgtctgtaaaattgtaatttgaat

SEQ ID NO: 240755 - DNA, 414 bp, Homo sapiens
cagttccttgtagccacgtgatcccttaccgttcttacacctgctgcccccccaccacccagaggccctcaactgtggctgaccggggcgtcgacctcacgacctcttccaggacctccccagctctgtccccgccaaaaccccccacaacccatctgggtgtttgtgtgatggccccctcttaggaaagagtgggggaccctgcctgaggctcccccagctgtgacccccatgccttctgtctgctctgcggtgaggaagaagctctggggtctcccatgcacccctccctctggtctgggtcccagctcccccaaccagcgtccagacctggctctgggcccaaagagcccacttttcggaattctaagaaagctgttctttccagcagccaacctggctctggcaaatcca

SEQ ID NO: 240756 - DNA, 748 bp, Homo sapiens
atacatgcttagatattgtattatgcatatccttgaatatatttagaagcatcacaattgaatatgtatggatttacctcaaagaagactgggaaatagttacaactggcatattgtcataaaaactagaagtattatgggttttaaaaaataggtctatgggccgggcgtggtggctcacgcctgtaatcttagcactttcggaggctgagggaggtagattgcctgagctcaggagtttgagaccagcctgggcaacacggtgaaaccccatctgtactaaaatacaaaaattagctggatgtggcagcgtgcgcctgtagtcccagctactcaggaggctgaggcaggagaatcgcttgaacctggaaggccgaggttgcagtgagccgagatggcgccactgcacttcagcctgggcagcagagtgagactccgtctcttaaaaaaaaaaaaatgtctaggaagtgttatgtttttctcagtgtgtgtgtggtccttgcactttcatatggctgcaaacactttaaattttgtgccctcccaacatagatatgagttatgttggaatgagtttattttaaaccagagtatgttctcattatagaaatgttacataggatgagaagacctatggaatactgctgaagcctaatttaacccaaagtttaggtggagcactttgtgctttcatgtataaaagaaaactgtttctgcgtgaataaagttttaatggtaaaaagctaac

SEQ ID NO: 240757 - DNA, 706 bp, Homo sapiens
atacatgcttagatattgtattatgcatatccttgaatatatttagaagcatcacaattgaatatgtatggatttacctcaaagaagactgggaaatagttacaactggcatattgtcataaaaactagaagtattatgggttttaaaaaataggtctatgggccgggcgtggtggctcacgcctgtaatcttagcactttcggaggctgagggaggtagattgcgctggtctcaaacttctgaccttgtgattcacccgcctcagcctcccaaagtgctgggattacacgcatgagccaccgtgcccggccgtaactttcctttataagcttaaaaatcattaaggctctgggtcaagaaagcagactagttactgagcattgtcatctgccttctcattttaaggcttcaccaaaatgaaaacataaactataaaagagaaaaaaaaaggtataattacaaacatgaataccaaagaaaacgggaaaggaggcatcaacaaatgagatatataactctttaggaagaggggattgattttacagatgagacgggttgaaaagccctagcctaaatgtactgcaaagaggtttctgaagatatgcaagttttcagaaaaactgacttctttagacatgagacgaaattcagaaaactaagactcctgatgatatggattttgatgttgcacaataaaatccttct

SEQ ID NO: 240758 - DNA, 626 bp, Homo sapiens
aacaaaatgaaaattatggaactgaaagtacagtagctaaaatgaaatattaattgggtaggcttaacagcagattgagttatggcattagaagtcagtaaacttaaagataaatcaatagaaattatttaatttacttccacagcttcactgcctgtggaggaacaggaacgatgtcaatcattggcaaaataaactaaactagatcttctcatatgtctccattcctatagaatttccctgtatccctgtaaaggactacctcaatagatctgtagtttccaaagatggggatttttttttagttcatatttaaagttgtggttaatttacaatagccttaagtattagaacaattagtgtatgtgttaagaatcttaagaacctagaggacagcctaacataagtcagtaaatctgataccaaataactatttatatacagttaaccctttggtataaaagagaatattttcatatttggtaaataacatttttatgccaagtgtataccttctctttgtaattcaggcacttatgtaagtatgcaagctttgataaattgggctaaagtttattttgattctcctgctctgtagattttttatttccttaaaaatagttcca

SEQ ID NO: 240759 - DNA, 391 bp, Homo sapiens
ggggctggtggtaatgttgagtgtcagtttcaaacaatagcagctggcagtgcctggtgggaagagactagaagaagtagaggaattccatgcagaccaacctactgtgtagctcttctcttcaaacttctgcttgtagaaagcaaaggtatgctctaaagtagaggttgaaactcatgagaatttaccttggtgaaagaaagggttagaagctatttttaaaaagcagttgcaggaagcatttctgaagtcagaacttctcaacccaggctgtacaccagactcttgtggaccttttaaaacatctaatttctatttttatcaaaggagacatgaatatggtgttttttaaaaaggtggagatggttttaagtttgtaaatgtatgtttt

SEQ ID NO: 240760 - DNA, 149 bp, Homo sapiens
tctgttgatttttttcccaccaaaactgccatgtcttctgcaatgacagctttatttattatttccaattctcttgccttttcttctcccttcttcttcttccttctcctcctcttcccctttttctccttctccttcttcttcttctc

SEQ ID NO: 240761 - DNA, 2547 bp, Homo sapiens
gagggtggtgagggtgctggtatctctgcctgggggtgggtagtgccaggaaggtgcctaagtgtccctgtcgggggctgggaatgctgagggagagtggtggtcacagatgtgtgaaattccccacactgcctgctgagctgtgtgcattttactccatggctgttacccctcagtttaaaagagactgagtccctgaaactcacagggcaagccccatcaccagccccgacaggacaggaagcagcagcactggggtctccatggcctgtttagggcactgtcagccgagggctcagtctagccactggtctctctgcgtgtctctgcctgagtggcccagcctggggcatgtgactctgtgctgctggtgggtgtacagaggagacggtgatgggactggtgagtggccactgagcagagtgacatgcgtggggagtggtggcactgctgtgggattttctgagcactccacgtgaaggtggcttgatattctcattcctgacaacagaccattttctcattgtgagaaagaggtagcaaccaagtgtcccatgagaaacaccacccagccggccagggagccatcgatggcgtcgggggaaggctttcagggtttggggacttggtttgggggctgtcccgtttggacagaagtggctgctcctcactgcttggaacagttctaccagtgccttgatgttctgaccaagcctctgcacggccagtgacaggcacacctatttgcaaagggtaagggttaacacacaggacaggacgggtgattcctggggaatagaattcttacttccgccactgcatgaagctaagagccagaaagtgacgacagtaccagagttccccgagcccatgttaatttactctgacagtgtgaaaaccatctacgtgggaaatgggtcgctcattcctgaggcgggccactgctgctgcagaagttcacggatttgatacccgctactggaggcccacccctgaagttccctaccatgggaccaccccttctgaagagttccatttttttcttattttgcttttggtctttttggaggcagggtctcactctgtcacccaggctggaatgcagcagtgcaatcacagctcactgtcaccttgaactcctgggctcaagcaatcctcccatctcagcctcccaagtagctgggactacaggtgcatgccactatgccctgctactcttttaattttttatagagatggagtctcactatattgcccaggctggtctcaaactcccgggctcacgcgatcctccagcctcggccacccaaagtgttgggattacaggcctggccatgagttctagaattggatgctcctgggctcagggaggcactcaggggaatgccagggaggggcagctctgctctctactctctctcgcatacctaggcacctggccaagtgaacaaaacttggtttccttctgaaacatggcctttctgctagagctgttgataggcatgaaggtgaagagatgcctcctaaagtgacgtctttcccgtgctgagctgattctcgtgatcgttaatgcttcagttttacttgatgactgcgcattcctggggacatcacaagctatctgttgagttctcaaatccagggctttccccaggtcttggcaggtacctcttgcaagtgccaaggagcccagcaatcatacaattcttggccaggcacggtggcccatgcctgtaatcctagcactttgggaggctgaaggcagatcaactgaggtgaggagtttaagactagcctggccaacatggtgaaacctcgtctctactaaaaatacaaaaattagctggctgcggtggcacatacctgtaatcccagctacatgggaggctgagacaggagaatctcttgaacccaggaggtggaggttgcagtgagccgagatcatgccactgcactccagcctgggcgacaaagtgagactccatctccaaatatatataaaatataatttttagaaattcatctatttgagtctcagactttgtaaaatgcagagaatgacccacgttgttgggttatgaagatgaaaacggatcaaagtgctccacccggccctgatgtatagcaagtgatcaataaacattggcttttaccattgccctttgcaagggtctgcccaatcaggtgacaactgctcactttccaaagtgcaccaggtagcaacctggccaagaaagacccaatgtcgagtgaacataaagaacacagggaggccaggcacggtggctcacacctgtcattctagcactctgggaggctgaggcgggcagatcgcttgagcctaggagttcaagaccagcctggataatgtggcaaaaccctctctctaccatcaaaaataccaaaaaaattaacagggcatggaggtgctcaagaggctgaagcggaaaaatcacctgagcccaggaggcagaggttgcagtgagctgagatagtgccactgcactccagtcactagagcaagattcctgtcttaaaaaaaaaaaa

SEQ ID NO: 240762 - DNA, 431 bp, Homo sapiens
tgttagtgttagtgtattttatgtgtggcccaagacaattcttcttccaatgtggctcagggaagccaaaagactggagtctagactttgacatcagacctagttatacctttgccttagactctggcaacactaaacaaccacgttccccctctcctcctcttttacccacctagtcactgagtaccatcagttactaattcaaaatgtctcgtttcttctatttctttcccacaacactagccaggccctcattatttcccaggtcagattttagtagcctcctcagtggtctctatgcctccattctatttttcctcaaaacctccttgttttacttctctgcttggaattctcccatgttcccaaggataaaatggagtgtaaacttctcagatataattagaaccctctaccatctagccatatga

SEQ ID NO: 240763 - DNA, 528 bp, Homo sapiens
caaaacgtccacaatttcagtaacaattttagtcacaattccagaacacttgttaccaattgccatgttatctcattcacagaaccatatattcccaatgataacagtaaagcaaaggactagatataattattttgtgaataaattctaaagtgttttcatgtgatctacatagaaacattaatagtgatcaacgctagtaactctgctattaaaatttttcttctgcaactctgcctgtataaggaggaacaacctcttacatgttctggtgataataataactaacatttattaagggctcactatgcccttggctctcttctaagcactccacagatattactcactccttacaacatcattttgaagcagatactgttattacccctatttataggcagagaactaggaagagagaggtctaaaactttatccaaggatacataatgtacaagtacatgagccaagatttagagttaaatccaaagtttacattttaccctgttgccctcctcataatagcac

SEQ ID NO: 240764 - DNA, 387 bp, Homo sapiens
tggaaactgaggctcaggaagcttcaataatttattcaaggtcacagagctaatttgtgatttagagggatttcaacacaagtctgtctggctcccaaagctcttccctccacactccaccaacatgctgcctcaggcccccaactcattttcgtgttcattgccccatcatctgctctctgcacattataaaggaggcaacttatgctccgcacagttggcaaatgcactcttccttggtccatggcagacagaggaaatagagcctgcgttcttttggcttgccagttcttctcggttcagcaatagaggcagccactaccaattgatctgtgaactggcagttaggggaagccattctatttgttaagaattctcagtcaacca

SEQ ID NO: 240765 - DNA, 425 bp, Homo sapiens
gtttcctgatttacaccacatccagatggtgctgagaggatatgaacaggcgagagaagtaacaaggatctcatccattcttgcttcactcaccacttcctttttctcagaggtcaatgcctgatgccaggtccactcactgaaattccatgaagactggaatttgttgccttggagcatgtatatacattctcttgttattctcctcccagttcctcatcaggaccttctgttgcttctaatagttaacctctttaaatagcacagtttccctcttctgcaagtaaagttgcagtagggttctgatggcattaatattttaaaagaacttgtgattttgtttacttaaaagtgagggatgtgaacagatgtcgactcaacctgagaaagaaggtatttgttcacatccctcactttataaatga

SEQ ID NO: 240766 - DNA, 396 bp, Homo sapiens
tccctcgtcaggtcagtcaccaagtcctttcagttctatctccaaacacatctcagtccctgccaccatggtctgttatctgaactactataacagtttcctaactggcctccctccttcctctctggaccctccagtgtgttccttcgtaacagctagagtggatttttaaaagtcctcccatggagttggagaccagcctggccaacatggtgaaaccccgtctctaccaaaaataataaaattagctgggcatggtggtgcacacttgtaatcccagctacttgagaggcagaggtgggaggatcacttgaaccccggaggtggaggctgcagtgaattgagattgtgccactgcactccagcctgggtgacagagtgagactccatctcaaa

SEQ ID NO: 240767 - DNA, 388 bp, Homo sapiens
  misc_feature (56)..(56): n is a, c, g, or t
atgtccgttatctaggtttgcccaggcacagactttatcccataaccttcactatncgcccaggtggccgtaactcaggccagctcagaggctcatgaccttcactccaccgcgcccagctgcttgtaggatttttatcagacggaaataagcaagagattctcataataaattacatgtgtatatttatcattgcattctgtgcaattaaaaaaattaaacttgataataagggagtggctcaacacattaactttgaatgttacacaattattaagtcatgtttttaatatgacagagatattaaagtcacagtaatttacagttaaagtgaattgaaagtggtgtttaatgtatacacatatatagtgtatttgctgcttgtaac

SEQ ID NO: 240768 - DNA, 262 bp, Homo sapiens
gtgttcaaaagtaatatatcttttaaaccacataaagagtaaagaaaaaaaagtatttagctttttaaaaaaaagttctattctagagtcactaaggattcataataagaatgaatgggccaggcgcagtggctcatgtctgtactttgggagaccaaggcaggtggatcacctgaggtcaggagttcaagatcaccccagccaacactgtgaaaccctatttctactaaaaatacaaaaattagccgggcatggtggcgca

SEQ ID NO: 240769 - DNA, 393 bp, Homo sapiens
gcagaggtaggcctggtcttaccagggcaaccacctaacgtggactcaacaccatctagtggtttaacagaaagaaggctgaaccttctgtggagacagataacaccatcaaatctttgcaagtttttatatacaatcaaagactaaggagctaccaaaggacaggattacatgactagaacaaaagggaaaacagttaataacagatccagagatgatccacatcattcaggtttattagatgaaacctattttcagtaacaactatgtcatgaacatagaggacgtatggagaaaattgatgtgaaatgaagaatttcattagcacattggaatggctaaaaggattaaatggaaattcaagaagggaataatacagtatctacatttaaa

SEQ ID NO: 240770 - DNA, 155 bp, Homo sapiens
ggttgagcccaagagtccgaggctgcaatgagctatgatcataccagtgcactccaaccagggtgaaagagtgagactccatctcttaaaaaagaaaaggtaaggtatttaagccttctctccttggaattaaacttggtgcaaaagcacactgg

SEQ ID NO: 240771 - DNA, 376 bp, Homo sapiens
gcactattcacaatagctaagaagtggaagcaacacaactggacactgatgaatgaattgatttaaaaatgtggtgtgtgtatgtatatatatgtacatgtgtatgtacgtatatatacatatacacaatattattcagccttaaaaaggaaggaaatcctgtcacacactacaacacgaatgaacctggaagacatgccaagtgaaataagccagtcacacacacacacaaccaaatactgtttgagtccacatatatgaggtatctaaattagtcaaattcctagaaacagaaagtagaatggtggttactagggaccaaggagaggggaaaatggggagttgtttaatggatataacatttctattttgcaaa

SEQ ID NO: 240772 - DNA, 2071 bp, Homo sapiens
  misc_feature (1708)..(1708): n is a, c, g, or t
  misc_feature (1739)..(1739): n is a, c, g, or t
  misc_feature (1753)..(1753): n is a, c, g, or t
  misc_feature (1966)..(1966): n is a, c, g, or t
  misc_feature (2048)..(2048): n is a, c, g, or t
tttaatttaagaagcattgatacaggaaatatcttaaacccaaacaaaaactcaaataaatttaactagagtacaatatgtaatgacatttaaactacaaaatattgcaagctacaaaaatattacaaactataaaagtatgggttagtattatatcctacttatcttttgtttaagccttaaattaaataggaggataatattaccattatggtaggaacaatgtgttctgtaacaaaaatagcactcaaaatattcatggcgtctgttttcttcttccaaatcactttatacttgaatgatttagttatgaatagaggttaaggtagacagtcttaggaccagagaaaatgagtgtttgtttcaaattctaattttgctgcttaagtttaataatcagtctgaacctccctttgttcatctggaaaatggaagtaaaaccacctggcatggtttcagtgaagactaaagacatgtaaaacaccaagctctgtgcttggttcataagagacgtttaacaactggaaactcttaataccatttgcattcttttgagggtaaatacattgatttccacctccattttttagcatgctaaatattatctactatataattttttcttatctagtgtgatactcttgatgaaatctaattcatcagcatgtcaatttgatctcttgaggtctttaacattgtggtatttccaactttatattctgcaaactgcaagcttccaaatcaaatgcactttgttctgatttagcgtattgaaattttctgtagaatggctagatccaaatagtctatctgggccccagcatcacataatatattcatgtaataaacctgcacatgtaccccctgaatccaaaaaatagttgaagttataaaaataaaaaataattattatagggtatattagtctgtgttcacactgctataaagatactatctgagactgggtaatttataaagaaaggaggtattattgactcacagttccacatggctggggtgggctcaggaaacttacagtcatggcagaagtcaaaggggtagctagcaccttctgcacagggcagcaggagagatagagagagcaagcaaaggagcattgccacactttaaaaccatccactctcttgagaattcactcactctcatgagaacaacatgggggaaatcgcccccatgatctaacatctaccaagtccctcccctgacatgtaaggattataattagagatgagatttctgtggagacacagagccaaaccatgtcatagggtaatgactgatttaaaggttttattcagcttccaaatgccaataccgttatacatcaagcactgtggtaagcagtggggacacgtatgaaaaccattaaactctcaccttgcaaagactgaatctctcagtattattttcaagaaaggccaaaaagagtatgtgtgtgcctgtgtgtgtgtgtgtgtgtgtgtctatttatatatagaaagtatgaacaacatatcataaggacaaaaaatgaaaagagacacatagcactatatactatggttctggtgaaggagggaataaagaagttgatacccaaaagccatagattgggcaagaaggattagagacttcctcagcacagttagttctgaaccagtaatagtaggattttcaaccagatgctgtagcaatgaaatttaaatgncaatctaaaagataatctaaaaataataaancaatctggaaatancattaactttctcttctggcgtctaaatcctgagtaattgtgccttagattgcagaagagtttaaattaatttagtgcaatgaagtgaaataagctgtctttacttttatttccccaattcgatataagaaaagagtataaatctgtagtaaatccttttacaactgtgacgtaagtaactcatttatatagtttcagtacttgataagtaancaaaacatcctttgctaagaaataaagtcttacaatatatgtatggtatgtgactatataaatgtatttttatacttgtatntgaaataaagcaatttttaaatc

SEQ ID NO: 240773 - DNA, 391 bp, Homo sapiens
agccacaccagtcagccatatgaggctacatcttttatatgatccccgcaaaacctgtacgaaaccccagcacatcccagaacccccgtgagctgctccgtgggagctggagagcctgccccagaatgggactccttcttggtgatctgattcacctgctgctgactcaggcctcagcttctgttgcccacgtagatgcagcctaaattaaaacccacgagagcttgaaaaaatgcagatgcctctctccccaccagttctcttagtgatgaacaagcaagtctaattttagcagagaagaatcttagaatgtgagaaacagaaaggactttgagatcatctcatcttgtggttttcgactctcactcagcaacagaatcacctgaggagg

SEQ ID NO: 240774 - DNA, 321 bp, Homo sapiens
tagccaacttggtttgctgggacttttctggtttaaaaactgaaagtctggctggttatggtggctcacgcatgtaatcccagcaatttgggaggccaaggcgggtggatcacaaggtcaggagttcaagaccaacctggccaacatggtgaaaccccgtctctactgaaaatacaaaaattagccaggcatggtggcacgtgcctctagtcccagctactcaggaggctgaagcaggagaattacttgaacccaaggcagaggttgcagtgagccgagattgcgccagtgcactccagcatgggcgacagggcaagactc

SEQ ID NO: 240775 - DNA, 444 bp, Homo sapiens
aaaagtgtgtgcagtgaaacattgtattgtactgagacccagaaattttgttgataggaatattagaaatgctaacatttttctaaccttaaaggaaagaaagaaaataaagtgttcccaaccattggctgttaccagtgcattcacaggaattaatgacaaattttccaaaggctaataagtagttctaaaagcaaaggatttatttcttcaattcatttcatacctaattaaagcataatagtgcccctttatatgaagtatgtttcctacggaaagatcgggcaatgtgctaaaagcatttcattttctagcatgagatgttcttgttttcatggcctgccctttcaaatatggccagaattaaatattgtttaccttgcattttataattatttcctgtacttgatggaataaaactaaaaataaaacattaaaaaaatt

SEQ ID NO: 240776 - DNA, 358 bp, Homo sapiens
tttttttttactacacataaaataattgacataaaatcaatttaataacacgtaatgagtgcccgttatatgcaaggcatttaaattgtctgactggccataatcgggtcacatttaaggtttgttacttcaattccaagtaatgtggtaatacattattccagaactttttggaacctgatggcccgttttttaaaagtcgttttgactggactggcattttggacctctgctctttcccatttccctgtgtgttagtaactgactttttttgatatgttttatgtttgccatatttcacagatccttttattttgctcacttttttgtactcctctccatcctgcctttcattctc

SEQ ID NO: 240777 - DNA, 397 bp, Homo sapiens
tatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttg

SEQ ID NO: 240778 - DNA, 314 bp, Homo sapiens
ctccattcttatcactattaacatttttccttgtgattattcttttactttcttttaagatgagaaaaaaatagacttttattcttgactgaataggtaaaaaccatcaagaaatgtcagattttccagagaataatttcaacagagaagattgctctacatacaagaaactgaggccaagagagttgattgacttgcttaacactgaagcaagcatattagcaattttaaatgacattttcctataatgttttatattatgtataaatattcatataatcagaattcagtataaggtatgtatcttaaagatt

SEQ ID NO: 240779 - DNA, 706 bp, Homo sapiens
gtagacatttttatgtggataaagtgtaagtttgtaaggaacagtggagaaacaagaagttgtggtaagggacagaaatttaagaagttaagtgttctgggtaaaaacaaggtagaggcatgagtcaatgagctggttacttagatggagaagagtgaaagttttcggagttttactagtaaggggcaaattaatcagtagcatttactgactgtctgctatggtccagatgctttgctaggcactttccatatatttctaacactatttctgttctgcaaagtacatatagttgttttcactgtgcacatgggagaatgaaagcctggagaagttcaataatttgcccaagcttacacagctggcaaagaattcaaacccagctgtgtatacagtaagttctcacttaacatcattgatgggtttttggaaactgtgactttaaatgacacgccatataacaaaccaattttcccactgactaattgatataagcaaatgtgaagtgtctatggcatattcttggtcacaaaaatatcactaagcttttacgtaaacaccaaaaacttctgttattaaacactgaaataaatgtgagctatacgtacatttaagaaagattaatatgaacaagtaagataattatttacctaattatcccagttcagagtgttgggtgaccggaacctctcccagaagcttaggg

SEQ ID NO: 240780 - DNA, 419 bp, Homo sapiens
gtggtgggtatatggtgatttaagaaatatgaaagggctatcaaaagatgcagtactacactgtctaatacactggccattaagcacatgtgactgttaagcatttggaatatgctagaacaaactgagatgtgctatgcatgtgaaaaacatgctgaatttcaaagaataagaatagaaaatatctaatttatagtactttatattcattttgtgataaaaatttaatatatattaagttaaaatatatcactaaaattcatatcacctgtttcttttttattttttctttgtggatgttagaaaatttaaaataccacatgtaaattaaagtataattctattgaacaatgctggaccagaatctaggaattgtgcttgccactaacaagctccttgtcctggcctccatgacttaa

SEQ ID NO: 240781 - DNA, 438 bp, Homo sapiens
gctgagcatggtggtgcatgactgtaatcccagctacttgggaggctgggtcaggagaatcgctttaactgggaggtggaggttgcagtgagccaagatcacgccactgcactccagagtgggaaacagagcaagactccacctcaaaaagaagaaggagaaggagaaggagattatctacattcctgaggaggagaagttgtacttaaactaccttgatccaacttccagctttacaatcattgccccccaccatgcatatatcatacatatatacctgctagcatgaatacctgcatcatatctagaattaatgggaatagtcatagggccaatctttcttatatcaagcaagctgaacaagggtccaagggataaggccacagctacttcctcctgctttagaacagagctaaataaacctgttcctaagtcttg

SEQ ID NO: 240782 - DNA, 406 bp, Homo sapiens
ccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggat

SEQ ID NO: 240783 - DNA, 927 bp, Homo sapiens
atgccaagtagtccctaccctctttaaaaatatcggtgggaacccaagctagtgtgaggatgagggaggtgccttgtaaaagccacaaaagaagggatgaaaacagaaaacttttatattgtcaaatgttgtaaacaaagtcaacaacatgataaactgaagaaattattgacagtggacatggcatacaagatgttaagtccatgatgtataaagaggttcggatcaaggagggacagtcctatggaaactgggccgagtatataacggaatccaccaaggaagaaagcggaatggccaataagcatatgcagagattcttgactagtaatcagagcagggcaaacaaaacaacccatatgccagtttttgtttatcatattgtaaaaatttaaagattgatgatctctaccccgcacaagaaacgaggtgaacaggtgctcttgaaatactgtggatgtgaatacaggttgactgagctggtatctccactgccaccaccgtcgtccaggctgctgtgggctccagcctgaactgttataaatgccctagcaccttttcttggcccaaatcacttctggacacaaatcagaccctgctacactactctttaaaacccttcagtagtttacgctcttcccagtttgaacactgaaccccatcacccgtccctcaaggctctgcgtggcctcactcccgtttacctcttcatcctcatataggcccccttccgtgttcccttgcccttcatccacacaggtcacacgcagctcatttcctcccgggtgctgctgtcttttctgcctggagcctttgcagtttgcaggtgttttactctggaaagtcccacctcacctccacaacttttcaaccttcaggtctcagctcaagtggcacttccataggaagctgtttaaaataaatgcc

SEQ ID NO: 240784 - DNA, 448 bp, Homo sapiens
caaacctcagcagattgacttgccaacctaaaataatgaaaggggtcagaatatgatttaaagagcatttaaataagtacaaagtgtgaggtaggccacccagaaacaccaactccgaagaaatggagtcagttttccgaagtaggaagtgaaggcttcatttatgtgggctgagacagtggagtttttagcaggattacaacattattcatacaaggttggtgtgtatgttatagcaatttgattggctctaggtgatgtttctttttggggaggggatatttaacattttcttaacagagggtgtaatagtcctgggttttctttcacctggtctaagcgaagcagggcaatgaagggggagttaatctacaacaagggtcattaattcagagggcgggaggcttttgaccctgacatggtttccctttagtcaatgtacagagca

SEQ ID NO: 240785 - DNA, 224 bp, Homo sapiens
tcatagtgtacatttcctctcgcagcagcttgtgtttcttccttcaagagtctgcttagagataataaagatcaacactattccttataacaacacctcagtaattttccattacctttccaaatcctataaaacggccccacccctacctcccttcgctgactctgctttcggactcagcccacctgcacccaggtgaaataaacagccatgttgctccccca

SEQ ID NO: 240786 - DNA, 895 bp, Homo sapiens
cgcaggagcccagttacgaaaggccgtttatgcttgcctaggagtttcagctttaccctggagaggtggagaactagtgagagattttatgcagagaaattatatgatcctgcttgcattttggaaagatccttgagtggctctgcagaaacttgatggaagggaaagcaaggatagagacaacaaaaccagttagccaaggaaaaaataagagttcagaaatgaacatggcaaggtaaaaaaatctacaagttttcacattaaacacagactctttcatcttcaaccccagaaaattacgaagtgttctccatgtcttcaatttgctgctcagatccactcgcctcccttcgacgcagtatctgcatctggaagacggacctacttcagttggccaccttgccctctaggttccagctggactcagtcaggacagatcagagagactgaggagggggaggcctcctgcagggtcactgtgaagtacctgtggatgccactgaaatctcagctcatgtctggtggccctttttgccaggctctggtcttaagatggtcctgggtccttactgccactcccagtgtcctctactgtcccttgtggttttcctgcacaaggctatatcttttctcttcaggcctccctgttccctgagatgcgacaatattgaaattaggctatttaaagtacttcatgactaaaacacgaaaagcaatggcaacaaaaaccaaaattgacaaacgggatctaattaaactaaagagcttctgcacagcaaaagaaactaccatcagagtgaacaggcaacctacagaatgggagaaaatttttacaatctactcatctgacaaagggctaatatccagaatctacaaagaacttaaacaaatttac

SEQ ID NO: 240787 - DNA, 455 bp, Homo sapiens
ccatgagctaacacaccaagtaatctgttgtgttcacaaatgtccaagagaataacaagagattaaagaaaggtaaatacagccacctggcaaaaatatttacccttttaaaaatgatggaagttatatatagaagaaatgtttttggtaaaaatatttgaaagtttgttttataatcataagtagcttgggctattttgactagaggggtgtgtgtgtatgtgtgtgtgtgtgtgtgtgtggttggcagggagagaaggagggaggcaggcagctggtagggactgtggagtgtgtcagttgggagagggaaatgagatgattaagttagtaagaatagaaaacatgtaggaaggcggatcttgaaatttcagggctattcattagtcattagttgaagatttcacagagaaatggtagaaaccaccagtaattaagaaatagcattattgttt

SEQ ID NO: 240788 - DNA, 370 bp, Homo sapiens
ttctgctaacagggcaggtttagaaaaacaaagatacagcaacataagcattgggctaaacttacttgagagctttggaaaacactgaaaaagtattagttttgttcatcaaatggtataatctaaaatatatcactttcatggagctgttgttagactaacctgactgaagattttcttgaatatattacattatttctggataataattctttatgccatgtcagtattactttcttccccttggcctttacctacccctccttgttggttcctcttcaaacataatggaacatacctttctgctttctttaaaaatcagtcagcccttctcaacctccaattatcatgggtgcattgctatgggttg

SEQ ID NO: 240789 - DNA, 274 bp, Homo sapiens
atttctcatgttctcttcccagccaatgattgaacatggtggcgttcctgcaggacctgggtctcctcaaccaggagatgctgcctcaagaactccccagaagcctggctgaaactttcttggaataaggctacagtctgagactcttcctacttaatcctccttcacaggggtcagacctacatcatggtctgatggttttcccagcgttgttggcttcttccttcttctccttcacaggcagtgccctcaataaatgctttgctcatctaat

SEQ ID NO: 240790 - DNA, 174 bp, Homo sapiens
cacaaagagttggatgctgaagccttgagatcgcatgataggccacaggggcacccacgtggagtgggcaggcagggcagtggcgggacaagccacaggccagcagctccctgcattggtggatttatggggagaggaaagggatccgtgagtggagagtggagccgatgggaa

SEQ ID NO: 240791 - DNA, 1849 bp, Homo sapiens
  misc_feature (602)..(602): n is a, c, g, or t
aattgcaccactgcacccggcctgggttaaagagtgagaccctgtcagaaaaaaaaaaaaaaaaaaagtcatttcataaaattgttggaaaatatgcatttctgaaggagaggcgtcagtgtgaagaacactcatctgaactaagaatcagaaaatggatctgaatttcagctttgctattcattcagtgtccttaaataaatcatgcaaccttgcacatcattttcttatttatacaatgaaagcattggattgatcattgctaacatttctctctgctctaaaactgtgatttttatcctttgctatttgcaagaaccagaagagataaaggttgccttttatgttagatttgattctaaatctaatgatataggacagcggtgcttaagctatttttgtgaagtgataaggaaaaaccctgggaaaggttcagtggtggtttgcacagctgattatttgttatgattaattgttccacttttattttcttttgtggcctgtaacctaatttttcacttagtattgggattattttagtacaaacaagtgatatatttgtaagaagggatccagagagtatggtaaaatgtctggatgcngatgttctctaagttaaaggagattctagggggtagtctataataaaggaaaaacacattttttaaggttttaatttttcagagtgcagggaggtgctaggtgctttcctcacattaagtataacatttccttttacagtatgtcagcatattgttgaagttttccaatatgaaaataatatctatttactagcatattaaagcttagcaagagaattttaatagcctcatttagcctcctaaacagtcagaggcagggaaatattattagagtaacaacactgtaggtgctctcttttgtctctagtagcaaaatgaattctggctaccatgtactgtaggagtgctgctggcttgaggctcctgagatctggcatggctgttatactgacttgttttctttcaaattcatgttagaaaaatctgtgcgtgtgtgtgtgtgtgtgtctgtgtacacaaatatttatattaccgtgtctcagtgctttgagactgtgtgaggcgggggaagagctgttgaggctttttatagataaagttgataatgcttttttgacttggttttctgttaccatcttttttgtctctattatgatatctattatataagtcagaaggagaaatgacacaaatgccagtataccagttcaagataggatcttggtttgatttagctaaaatttaccctacttattggtgcaatttttaataatagaaaaccattcctcattgcttggaatttttatctgcactttccattttgaatattattgttagttgttgaacaccaggtttactctgcaggacaccaagcaaagctttagaaatttctgccatcattaaaccctgaacagactgataagcagcaaaattgaatcagtttaaaaaaaaaaaaaaacttgccaacaaaaaaagtccaggaccagatggattcacagctgaattctaccaaacattaaagaagaattggtaccaattccaaaagattgagaaagagggaatcctccctaaatcattctatgaagccagtatcactctgataccaaaaccaggaaagaacatttaaaaaaaaactacaagaaataataaataaataaaaattaaaaagaaaactacagaccaatatccctgatgaacatagattcagaaaacctcaaggaaacactagctaactgaatccagcaggacataaaaaagacaatccaccatgatcaagtaggtctcatcccagggatccagggatgatt

SEQ ID NO: 240792 - DNA, 613 bp, Homo sapiens
cttccctgcttcgaaacaggccatctgccccttggtgttgagtatcccagtagccattgggttctagaccaagctggacacagtgattcttgtgattcaaatgtttctcctcaactgaaaaagctcagggtgtcttttggactgtccctcaaaacctagctttccactaattagtgaagcatgacttttccatgccatgtctgttctgggaagtttcctcttcatcgtggccttgggccccagggaaatttcagtggatgagcagaagaagtggaaaaggggatgaaaagtcaggtggaatgacatcatccatcattatggcatcatcacagctcttacatcattgtcatcatagattgtcactgttatggattgattttcttctgattcttggtatccatttcttcacatgtgtttaaaactcttttgactgactgcttacctaacagaagtttcttgtgttgagttcctttgccagataaaaacaaaataaggctgggtacagtggctcacacctgtaatcctagcactttagaaggccaaggcgggcggatcacttgagatcaggagttcaaaaccagcctggccaacacggtgaaaccccgtctctatt

SEQ ID NO: 240793 - DNA, 290 bp, Homo sapiens
aagggtgaaggggttgaagtggggaggatgaggagaaattggttaatgagtatgatgtatattatttgagggatggataccctaaaagccctgacctgaccactatgcaatctatgcatgtaacaaaattgcagatgtaccccatacatttgtataaataaaaaggaaaataaaaatatgtgccttcttgtgatcagttttattagagggtgccttatcactgtgtggtcaaggaaattctgcctttacagttataaacacacccaccactttgaacagtgtttagttga

SEQ ID NO: 240794 - DNA, 580 bp, Homo sapiens
agagtatcaagtttcattctcacagaccttcagtttagtttttaactctctatcttaatttgagaatgcaaatgaaactacctaatagccaaggctacaaatatataaatatataaaaagttaattatcggccatattcttgtactaactagtccagtggaacgactagcgagttctggattatctttgctaatgaaagatctaaaattgtcattttaatgcctatattctttgatgaaaagaaatatactaattcattagaacttcagtgatagtacagaattcctgaaattgcgttgcttttggttttgaccatttaatcatttttgttttgattatgaacattaaaatactttccccttagcatatctgtataaggcacaatagaaataaagtgcagataatttccccttgctttgtggaacagtgaattatagctcaagtctgcaaataaattctatcttccatcttttattataaaattagaggtatattcttctagaagtctagtagtcatcatttagtagcagctctttcgatatgtggaaattcatcttttttgttgtcattttttaaagaa

SEQ ID NO: 240795 - DNA, 414 bp, Homo sapiens
acccagggcgctcctgtggttcacctgtgtgaatttcatgagttttgacagcatgtacagtagtacagccactgccatattcaaggtgcacagcaagggagtcctccattgagacacagtaaaccggccgggcacggtggctcaagcctgtaatcccagcactttgggaggctgaggcgggcggatcacgaggtcagcagattgagaccatcctggctaacacggtgaaaccccgtctctactaaaaataaaatttaaaaaaatagccgggcgtggtggcgggcgcctatttagtcccagctacttcggaggctgaggcaggagaatggcgtgaacccaggaggcggagcttgcagtgagccgagatcgcgccactgcactccagcctgggcgacagagcgagatttcgtgtca

SEQ ID NO: 240796 - DNA, 474 bp, Homo sapiens
gaggttctgttataattgggtatgaggtacagtacattacggataaagagtgagattcaggatgcctttgatttgtgtagtattttacattcttatgtgcagcatctatctgagcttttttaggtaggtaggatagaaacaatatccccatattatggataaggaatctgaggatcagaaaggtcactccaggccaggtgcggtgtctcacacttgtaatcccagcactttgggaggcccaggtgggtggatcacctgaagtcagaagtttgaaaccagcctggccaacatggcgaaaccccacctctactaaaaacacaaaaattagctgagtgtggtggcatgcgcctgtaatcccagctactggggaggctgaggcaggagaattgcttgaacctaggaggcgaaggttgcagtgagccaagattgcaccactgcactccagcctgggcaacagcatgagactgtgtctca

SEQ ID NO: 240797 - DNA, 467 bp, Homo sapiens
tgtcactaaaccagacattggcaaatgtcagtccttttatggaagtaccagccttgagctaggaggtctcctaggcccggagatcctcagcagcccactgtcaataggtggttgttatcagttccagtaaacatttttaaatatcctggaaatgcctcaacagtggacctagatatttccctttcagccggtaggcaagagtcggtatgctctttgaagttttgcggtgttataagacactcaagaaaaatgtgtggtaaagtattctaggtatgtttaaattgtcagttattgcttattctgtttgtgccttcaaagaatgtttttgttaaggaagtcacagggatttgacttacttctccctgactgaagagaatagtggaagactgcctccagatttgaaaagaaattagtcacaggttttttttgtgtgctttcagcctggagaacagacgcctttccaccaa

SEQ ID NO: 240798 - DNA, 472 bp, Homo sapiens
aatcatctttgtcaacaccatcacagacacacccaggaacaataatctgcatccttcaatccaatcagattgacaatattaatcattacacaccaggatcaagtgggatttatccctagaaagccaggatggttcaacacctgatgcaaatcaataaatatgacaccccattttaacagaataaaagataaaaaacatgatcatttcactaagtgcagaaaaagcttttgacaaaatttgataattcatgataaaaaacactcaaaaatttagggatagaaagaataaagtacatgcttattgctatagaactataatttcataataaaggctatatgtaataagcccagagctgatatcatacttatcagtgaaaaaccaaaagtatttatgtcgtgagcaagacaatgatgcccactctcaccatttctattaaatataggactggaagtttttgtgaggcaattagaca

SEQ ID NO: 240799 - DNA, 292 bp, Homo sapiens
taattcaaatgttgacatctcagcttgggtcttcaataggaattttaaatttaatatacaaaactaaattcattttctttcttccaaatcttctccttcaataaccaataacctttcccatttaggaaaaagaatatctatccttctagctgctaaaactaaaaacttaaaggaatcagtttctcttctattttcctcatgacccatatcagcaaaatatgttggttttgtttttaaaacatttccaaggtatggcttctcaatacccctgatgaaccatcattatctcttg

SEQ ID NO: 240800 - DNA, 777 bp, Homo sapiens
gcccatgacccacctaacaagggaaggacactgtggatcacacctttagcaattaacaaaattcctaaaatcaagtagatttggaatcttaaacccctggtccaaaaatccaagattgagaccactgacaacatatgatatttattattattattgatactttttccttattttcttggatatcaaagggaaattataatttcaacattagtgctaatcctacaaaaattacagtccatcgtgtgtaaacagtcaaggagatggttccacatataaaagatcaaaactacaactattatcatcatggtgctgcccacagcgtaaacctgctacagaagattagaagacttgggacccagctatgaccaacattaacatcgtcatggcaaaagcaccaagacaagaggtggacagtaggaactctcatttctcacaggcccttagacattctgcttatggccagtaatctctttattccagagaagcaggctctgataatcccaaacatgaaagacaaaaatgtagccaacagaaccagaaaggcatatcctacatctcaaactggcaacagaatgaaaactgaacctgagaggccaaatggtaaaaagaataacaaaaggctcagaaactgcattgttgcccattctaaacggcattgcaacttcaaacattgcacattctggcatgtggtgtttcaggaaatctacaaaagactgccccaagaggtaggtttataaatacaagaaaaaagattgtttatcgctgtagttttcattt

SEQ ID NO: 240801 - DNA, 455 bp, Homo sapiens
cacgcttagcatccccagaagaagccagagctcattagcagtgactccgcccatatccccacagtcccttcttcccccagcctgggcacccactcatctgccttctctctttggatttgcctattcaggacatttcatgtaagtagaatcatacaatatgcagccttttgtgtctagtttatttcacttggcatgttttcagagtcccttcatattgtagtgcatatcagtgctcaattcctttttatggccgaacatttttcccttgtacagatgggccccattttgtttatttatcagttgatggacatttgggttgtttccactttgggctattatgaataatgctgccataaacattcatatagaaatttttggggtttttttgggagacaaggtctcactcttgtcacccaggctggagtgcagttgtatgatcacagctcactgcagct

SEQ ID NO: 240802 - DNA, 625 bp, Homo sapiens
tctcacagatgcagttcctgcattagtattgataaatgtgtggctgctccacttggagtgttttcaaagcataaatcacagcattgatggtgctgtggtttggctcttccagccctcttaacaacggtctgatggacttggcgagagtctagccacgtgttctggcctctgtcactctcatggctgaaacgcatgcacacccacagatgggggccccgtggtagagatgtgcctctacttgtcaaatagactgactccaaattcggaaatatgcctcaggaatctagaaagatagaaaaggagtcttcgtcactgtagggtctcattcacaatatggaggagagatggaggggagtttttggtataaattttgcctcataaaaattctccacgttgttttgtactgtatgagggtagcgagaaattagttgatggttaacaatcaagctggagaagaatatcctcaatttttcacatggaaaatgaaaaactacaactccttccaaatatatgtatgtttcttttctgaagatagacgtgtgtgtgtttgtgtgtatcatataacatttattttttgatttctttgttatcaacagtaaaaatacagaaaatgatgccaaagaga

SEQ ID NO: 240803 - DNA, 380 bp, Homo sapiens
gcgggcacctgtagtccccactccttgggaggcagaggcacaagaatcacttgaacccagaaggtggaggttgccatgagccaagattgtgctacaattgtgtggcggctcatacctgtcatcccagcactttgggaggtcaaggtgggcagattgcttgagctcaggagctcaagaccagcctgggcaacacagcgagacccccgactctactaaaaatacaaaatgatgagctgggcctggtagcatgagcctgttatcccagctactggggaggctaaggcacgagaatcgcttgaaccccagaggcagaggttgcagtgaaccaagatcgtgccaactgcattccagcctgggtgacggagtgagactccgcctct

SEQ ID NO: 240804 - DNA, 157 bp, Homo sapiens
aacattctgaagtaggagaacttgttgccacaaaggagtctgatccttctccacctcaaagcccgctgggcattgctctgaacctgcaggattccaggggaagagagcaataggcacatctatgaccaggcagactcctgggcaaggctagatcttt

SEQ ID NO: 240805 - DNA, 1217 bp, Homo sapiens
gtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataatgctgctgtaggccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaa

SEQ ID NO: 240806 - DNA, 547 bp, Homo sapiens
atttagtttgtagcctttttctataaaatcgtgaacttgcatatctctcaattactttaaagccctcaaaaatcctacccttccatcttcatcttctctgctaaaatcagaatcttcaggctagcaatggggcacacaaggacaattaatcccacgtaatcactgcacaccatgtaaataatcagctgtcattttctcaactaaattccctaattaatacaataatcaaaacagaactttcaaaatatgtgtttaccttttgaaaagttaaatatcttgtgtaagtattgtaaagatgctcttaatgggaaaataactttaaaaagttatgatctagtatgtaataattttataataagagcatgcattaaatattataaaagctgaaagattttaagtttagggtatgtgcatttatcacctttaaatttataacttccaactgtaagcctgaataagatataaattcatttgtctttgagtgaattaaagtaaaatggtttattttgatcattaaactttcatatgatttacaacttcttggcaa

SEQ ID NO: 240807 - DNA, 343 bp, Homo sapiens
ggacaagcttagctttttcatcattggagaattcacacaaaaaaaggaatgagcttggacagatcgtgggagaactttcaggcactaatcaggccaattcatccccgagaaaaaccttgatgacgaagaaggggaaaaagtcttccagtttttttccttattggatttcacagaatcctcagtgatatatagagaaacttgctggaggagttcagggtttattaatattcacattaaagcattaatcccattaaagtaggggtttaaacttttttacttctttcaccccaatcaaagctttcattccttacatctctattgagtgaatgaagcaacaggcaaa

SEQ ID NO: 240808 - DNA, 246 bp, Homo sapiens
cacagggaccgggtgcaatggctcatgcctgttatcttagcactttgggaggcctcaagtgatctgcccaccttggagtcccaaagtactggaaatataggcatgagccaccatgccccgctgttttctacatttcttttatatgtaaatttctgtcctgagcagatgattcacttccagagaaaaggatctttgcattccctgctgtctggcattgtgcataataaatatatactggcaaataca

SEQ ID NO: 240809 - DNA, 481 bp, Homo sapiens
agagtcctaacctcccacttgtcttgattgatttttacttttttaaagtccttgaattcttcctcaagtgaaatctcaggtagaggtgcaatatgtaatacagacaaggtgcgggtttactctgtcaaagctgggataggaggcctagaccatgattctcaaattttattctgcatcagaatcacccagagggcttgtgaaaataaatggctatacaggaggaacgagttgaggagatgtatcgtacatcatggggactatagtcaataacaatatattgtatacttgaaaattgctgagaatagatttcaagttttctcaccataataaaatgaaagtatgtgagttaatgcatatgttaattagcttgatctagccattccacagtgtatacacatatcaaaacataccataaataccataaatacatacaatttttgtcaattagatatgcattttttaaaataagaggaaaaaacta

SEQ ID NO: 240810 - DNA, 518 bp, Homo sapiens
gagatggagttttgctctcgttgccaaggctggagtgcaatggcacgatttccgctcactgcaacctccgcctcccaggttcaagcaattctcctgtctcagcctcccgagtagctaggattacagaagcatgccaccacgcctggctaatttgtgtatttttagtagagacggggtttcatcatattggtcaggctggcctcaaagtcctgacctcaggtgatctgcccacctcagcctcccaaagtgctgggattacaggcgtgagccactgtgcccagccggaacagacatttttacggagccaaagccttcaatattttcttttgcgatcccttccattgcttttagcttacaaatccttctccattcagaaatctaatatttacctattttcttttaagatgctgtaatctatcttagaatcatttaatctgaagttatgcagtcaggctattttttttcttttttctttttctttttctttttcttttttttttgatggagtctcactctat

SEQ ID NO: 240811 - DNA, 582 bp, Homo sapiens
acagacacatattctctagctcatttttctcttctgagatgctaaaccatacccgctgggtatcagcagtagtcctgtttgttacctattctgtcattgtggaatggaatcagaagctggcaaaggagctaattcttcatcctttctgcatcatggatgtcccattctttgttgatattccttctttaatacatccatagacaaagcccatacccaatgaggacagatcattaaccacctgttctgcctgggagctgatggcagcagcagctgggttgatcttagttggagggaatggcagaactgtacatttcttggggagatggtgtcaccttggactctggaaatgttagaaagattctaagtaagttcaccagtagctgggctgttctatcatgagcattcagacatctgatggatatgccaacttgtcaggactggtagctgaaaaagtttgctctgaatgccattactgattttttcccaccccctatctccccaccctttggccattctcttaaagccagattctaatctttctttgaaaagggtatttctcaaaagaaatgttttctccctctg

SEQ ID NO: 240812 - DNA, 430 bp, Homo sapiens
aagaatccgtctcaaaaaaaaaaaaaaaagcagcaaatcaacatggtacatgtatacctatgtaacaaacctgcatgttgtgcacatgtaccctagaacttaaagtataataaaaaaaaaataatctaagttcatggggggggttgggtggttctgagggaattgatggcaagaaaacataccaaagatatagagtatgatatgggcaaatactgatgatttgaatagataactagagatggtgacaggtgccatgttttgagactattctctataacgaatattgtgctaaacaccttaaatacattgtgtaatcacagaaacaggaaaaattaattctgcctgtaggggttataagaaaattttctgagtaaaagatattaggggatggaaaatggggaaataactaaaataagctaacaataacaac

SEQ ID NO: 240813 - DNA, 509 bp, Homo sapiens
aaattgccacagccaccccaaccttcagcaaccaacaacctaatcagctagcagacatcaacatcaaggcaggaccctccaacctccagcaggaaaaagattaccacttgctcaaggcccagatgatcattagcacgttttagcaataaagtattttttaattaaggaatgaaagtgtgtgaaccgtctagtggaacggtgtgaatactatttcaatagtgctgttcctgcagagctgtctttctctaactgatctgagaaatgatggagggcaagacagagacatgcacagggagaacatcatgtgacaacaaaggcaaagactggaagttatgcagctgcaagccaaggaacaccaaaaattgctggcaaactgccagaagctaggaggatgcaaggttagaattccccaagtctcagagggagcgtggacctgcccacaccttgattttggacatgtaacttccggaaatgttagacaataaaatgcagttgttttaaaccatcca

SEQ ID NO: 240814 - DNA, 608 bp, Homo sapiens
aaattgccacagccaccccaaccttcagcaaccaacaacctaatcagctagcagacatcaacatcaaggcaggaccctccaacctccagcaggaaaaagattaccacttgctcaaggcccagatgatcattagcacgttttagcaataaagtattttttaattaaggaatgaaagtgtgtgaaccgtctagtggaacggtgtgaatactatttcaatagtgctgttcctgcagagctgtctttctctaactgatctgagaaatgatggagggcgtatctaaaaaacgatgagacttggtgctgaaaaccagacttcagcctccaggagaactggcagaagcaagctggtcagcgagaaacaggaccaacaagaagacagagacatgcacagggagaacatcatgtgacaacaaaggcaaagactggaagttatgcagctgcaagccaaggaacaccaaaaattgctggcaaactgccagaagctaggaggatgcaaggttagaattccccaagtctcagagggagcgtggacctgcccacaccttgattttggacatgtaacttccggaaatgttagacaataaaatgcagttgttttaaaccatcca

SEQ ID NO: 240815 - DNA, 514 bp, Homo sapiens
agctggaaaatcattagaatggcatccggtgccatttccctcactcctgcctgcacaagcatctggaaggaagagtgcttggttgaagagcaggcaggcggcaaggatgacaggaggggatgcccaccggagtgctggcaagtgcaggaagtggaaccggaggcccagagttctagccaatttcaggagggtctctatgggaatcctagggctgctgcataaatcaattacatagcccagtttaaacatcatttttgcatctgatagtaataaatgaggaagggaattgtttctgtattcactgagacaatttgtgtttccctgaagagttttaagggcaacatactaaatgacactaataaagtaacaactatctgcattatttaagctgcattaagaccagagctcaatattttaactagtagcctgctgtccttgagtgtttaacaaaccggagagaaacagattactccctggtcaaaacactgcagaggcttcatgtcacactcaggaa

SEQ ID NO: 240816 - DNA, 398 bp, Homo sapiens
ttgctgaatttgttagctctagcagtttgttgtggattctttggtattttttatatagagagaatcatctgcaaatacagataggtttattcttcttttccaatttggatgccttttctttctcttgactaattgctctgttcagaacttccagtacagtattgagtggcagtgtgaaagtgagcatccttgcctcgttcctgatcttaggggggaagtctttcaccatggagcatgatattagttgtggattttcccataaatgccctttatcatattaaggaaattcccttctatccttaatatgctgattgttttgatcatgaaagagtgagcccattttttctaaagtgaaagtttggctcaaagtaataaagtgctgacctgaaagaaaaaag

SEQ ID NO: 240817 - DNA, 381 bp, Homo sapiens
aaatagttccacatggcttaaaatgcaaaacacgcttccctttcactaccctttggtgcttcctaaaagccaccattctcaactcttttagctcttcccttagctattgatttttgtatttgttaaaaacatgctcttactgctgtttgttgtttttcagtttgagatattatattatgattattattattaatattagagacagggtcttgctctgttgcccaggctggagtgcagtggtgcaatctcagctcactgcaacctctgcctccccggctcaagcaattctcccacctcagcctcctgagtagctgggtgccgtgttactaactctagtatgtttttgtgtcaatcgctgtgaaataaagtttgaaaacttta

SEQ ID NO: 240818 - DNA, 340 bp, Homo sapiens
agcttggtaggaattttcatgggactcatcattcagatactatggatcctgcaatcatcaccaggcaaatatttcccaagcatatcctctgtgcaggcaccaagctctgggctgggaaagaaatgtggacctgatgtgctccggcctccagggggcgtggattttaagccggtggttttcaatcccctccaacccagggttggtgcacactctcagcaaaatagttttcagcatgcatctccaatatatgtacagtttaaaactgataaataatatgcatatgtactgctatttcattctctttgtaaatctttaaataaaaattaggaaatttaaggcc

SEQ ID NO: 240819 - DNA, 596 bp, Homo sapiens
ttataaataaaaataacttcacaatgaattcagttaattaataccacctgagtggaacacagaaataagaacaaatcctgcacagagcagcacaaggagaggtaccctcaccataggggaaggagagtgaaatgagcacccccagcactggacccatctcagtgccaggctggtcctcacggtcccaggttacaagttcgtccctacaaatccaggatccagacctgccacagcatcagcctggcccttgaagccccaagctccaggtacacctctgcaaactcaagctccaggcatacctcagagccaggctggccttcacagccttcacaggctggcttcaagcctgccctaatgtcaggcaagtccctgtggacccaggctccacactggctcctgtgatactaggctccagtggacccagggttgaagcccgcttcagtaggcttaggggccatgcgtaccctatgagatctgagtgctggcctgtccctgtggacttaggctccaggcccaccatgaactgactcacacaccaggcaagcctgcttgctagctcacctagctggtttgctcagactctcttgatgggatga

SEQ ID NO: 240820 - DNA, 364 bp, Homo sapiens
atatttatagcaattggatggagtcattttatgtctgttgaagctgataataataataacaataataataataataaaacttagctgggcgcggtggctcacgcctgtaatctcaacgctttgggaggccgaggtgggtggatcacaaggtaaggagtttgagaccagcctggccaacatggtgaaaccccgcctctactaaaaatacaaaaattagccaggagtggtggtgggtgcctgtagttccagttactcaagaggctgaggcaggagaatcacttgaacccaggaggcagaggttgcagtgaaccaagatcacaccactgcactccagcctgggcaacagaggcaaggctctgtctca

SEQ ID NO: 240821 - DNA, 404 bp, Homo sapiens
taggggagggatagcattaggagaaatacctaatgtagatgacaggttatgggtgcagcaaaccaccatggcatatgtattcctatgtaacaaacctgcatattctgcacatgtatcccagaatttaaagtataatttaaaaaaaaaaaaaaacttgcaaagtcaattcaccagtctctcaccttgaggaactctttggaatcaataggaacagagtagcaccagcccagtgtggcagtgcagagaggagccggagaagatgcctgccctccccaggaagccatagagggagatttgctccagctcacaagttgaaattcttcgttttgaggaatttaattatggctaacagcgaggattaattgctttatactgtgttagtataaataaatactttcttcatt

SEQ ID NO: 240822 - DNA, 290 bp, Homo sapiens
ctgcccattgttaaaagcgctgtgaactaaggctgggcatggtggctaacacctgtaatcccagtgctttgggaagctgaggcggtggttcaactgaggacaggaattcaagaccagcctgaccaacatgatgaaaccccgtctctactaaaaatataaaaattagacagacatggtggcgggcgcctgtaatcccagctactcaggaggctgaggcacaagaatcacttgaacccgggaggcagaggttgcagtgagctgagatcgcatcatttcattccagcctgggc

SEQ ID NO: 240823 - DNA, 480 bp, Homo sapiens
tgacttcctcagtcactgactcacaaacatgcaccataaactcctgccacagttcctggtatttaaaatagcattttggccaggtgtgggggttcatgccacccaacactttgggaggccaaggtgggagaaatgcttgagcccaggagttcaagaccagcctgcacaacatagcaagaccccatctctacaaaataaaataaaatgaaacaaaaatagcattttgtggaaaactggagtaacaagaatgtacagagtaagaaatacacttgtctgtattacaaatgaatagaattctggtatctaaggaaggaaatctctaatcagagccatagagaccagaacataaaatctgttacacaaaaaatcttactgctcattgcttcctaattctagtcataaatcctcttaaaggatgtccccaactttcatttaaaaaacacaatacaagacaaaagcaaaaaaaggaaaaaaaaagag

SEQ ID NO: 240824 - DNA, 512 bp, Homo sapiens
tgagccaggggcataaacacctcaactgcactgtccttcctgcctcgagtctcctgctagtcagtgctcaccactgatcaaaccaactgaagctagaggccgaggaagtccacgatgtggcccatacatgtcagcttcccaggcaggtggagaagagtggaaagtggatctggggaggaaataagaaatatccagcccctagacttagtggccatttttaaaattaaaaaccaacacatgacctggtgcggtggctcacgcctgcactcccagcactttgggaggccaaggtgggccaattgctcgagctcaggagttcaagaccagcctgggcaatatggtgaaaccccttctctacaaaaaatacaaaaattagctgggtgtggtgactcactcttgtagtcccagctactcaggagactgaggtgggaggattgcttgaagccagggaggttgaggcttcagtgagccacattcatgccaccgcactccagcttgggtgacagagccag

SEQ ID NO: 240825 - DNA, 375 bp, Homo sapiens
attaataaaccctcaaagatctaaaaaggtgaattaactctcaggggctttaacagataaattaacttgaacctgcctagttgtctgtttcagagccagaattcgaacatggattcattttagccgcagtaagcacctgtgttagtcagaattcagtgtgggtaacagaagggcaggccagattggagagagctggaaacatattccaggtagagacaatggtgcctgatgaagcctaagggtctgaatgctggagtaaagccaggggttatttacactgtgactgggtgtgaatctacagatagatctgaaactagaagataagcccatgaaggaaatgggaaaatgtgccctgattttgagttacattagcaa

SEQ ID NO: 240826 - DNA, 491 bp, Homo sapiens
ctcttgtcgaagctatccagtctacggtattcgttatggcagcctgagctgaggaatacaccacacattaaaaaagtaaggactgtgtgcatttgggaagaagtcatctagtcctgcaattagatttgggaggcaactataatgcataaacagtttctgaatttgtgaatttcctatttctttgcttcagaatagtttgacctttagacatacaggctcacagattgctgaaaaatcacaaggtctgtgatgaagctgtgaaaataattgaaaggatttgtttttctaaccctggctctatccatctgattacactgtaactaatatttgctgcaaaacctgtggacaaaaattattcataaactgcaaagaaattgcacagccatgaaagaaatcagtgtgttaaaagggccatgttttctccctctaagcaatagagaatctgtgagacactttgttgtacaataaataaataaataaaataaaaaaaa

SEQ ID NO: 240827 - DNA, 675 bp, Homo sapiens
ttttccaattttaactctcttggacagaaatctttacttctatacatatactgcctttcattcttgaacaaaaattttaaaaataattctattttaggattcagggtcattatgaaatccattcataactgtgcaacaacactttgagatcttcagagaatactgtaagtagggaacaacaattagttttacgtagctcaaatacagtatatgtgggaaagggtgggagactgggctaaacaagatagtttggaggcagactaaggaatttgatttttatttcaggaggcagactaaggagtttgatttttatttcaaagagtaagaacttatccttttttggtgggtaaatgaaatgaacagatctattttccaaaggccacaaatgaataaaatagagtgggaaaaaactggaatccaacaagaagctctagtaagaggcaacagatcaatggctgggcgtggtgactcacacctgtaatcccagcacgtaaggaggccaaggcaggtggatcacctgaggtcaggagttcgagaccagcctggacaacaaggtgaaaccccatctctacctgaaaaaaaaaaaagaaaacgataaaattagtcaggcatggtggcatgtgcctgtcacaccgctgcactccagcctgggtgacagtgcgagacactgtctca

SEQ ID NO: 240828 - DNA, 467 bp, Homo sapiens
tgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgtggtggcttacgcctgtaatcccagcactttgggaggccgaggcacgtggttcacctgaagtcaggagtttgagaccagcctggccaacatgatgaaaccctgtctctactaaa

SEQ ID NO: 240829 - DNA, 518 bp, Homo sapiens
tcttggcaattccagagatgggttcaaagtaacaagacgaaatttaataaaataaggtttaagctctaacaagagttacaacaaatagctcctccattacaaaatcagagacctggaaatctcagtttacctgggccaacagtgtgacatgagtgctactgtggtcccagccccatcaatagaaatacagtgtccaaaaaataggaggtcacactattctggaaggtgaccagtatgaggaacaatctgggaaccaggtaactttagaaatgactagagcaactgcagatgttgagcttgaacagatggctggtggaggggcactccttagaacattgcaggaacaggcttcagttcaccctctaaagggcgattgggccttttctgccaaattccacagggtgcacctaggactaatggttaaagtcaaagcagagtgaatttggttccatgttcagaagaattttaccatcctcagaaccaatttaaaataaattgcattgctttgtacattagtg

SEQ ID NO: 240830 - DNA, 201 bp, Homo sapiens
ggtttctaagaactaagaaagtattactgtggggaactcagcaggtggctgcctgcgaatgaagctcccagagaggaaaatgttctcgagagagggagagaagcagtttcctcatttaggtcaccagatctggctgtgcctaaagcaaggcctggatatttcaattacaacagccaaataaatttccctttttcgcttaag

SEQ ID NO: 240831 - DNA, 454 bp, Homo sapiens
aaaaaattgtgactcactttattccaatatttgctttatttcagtggtttagaaccaaatccacaatatctcaaaggtgtacctgtaaatacctgggcaattataaaagctagtattattgtaacaatgatttgtaactccagtttttgttttctccatgatttgagagacttatacgttttaaaaattattagtctaaaaactaatattattataactttggtttgtgactccacattttgttttctacataatttaagagactcatgtattaaaaagatttagtttatgttttggcacacacaatgtataaggatgtaattttgttatatcaacaaccagaaggaatggggacagaactgtaaagcatagtttttatgtgattaaagttgaacttgtaaaaattcaaattaaagcattataaccttagaatgttaaatgtaatccctatagt

SEQ ID NO: 240832 - DNA, 525 bp, Homo sapiens
tagttataagaatcttgaacaggtatttcacaaaacaagagatacaagtggcttataggaatgtgaaaagatgctcagtgttattagataaggggaaatgcaaccaaaatgcatcgaaactggaaagactaccatttaaaatgataatactaatattggcaaatatgtggggaaactagaagtcgtgtctatttcttgtgagagtgtaaaatagaacaactggctgggcgcggtggctcatgcctgtaatcccagcactttggggggccgaggcgggcggatcacggggtcatgagatcgagactatcctggctatcatggtgaaaccccgtctctactaaaaatccaaaaaaaaaaaaaaaaaaaaaaaaattagccgggtatggtggcgggcgcctgtagtcccaactaatcaggaagctgaggcaggagaatggcgtgaacctgagaagtggagcttgcggtgagcccagattacgccagtgcactccagcccagacgacagcgcgagactgtgtctcaaaa

SEQ ID NO: 240833 - DNA, 551 bp, Homo sapiens
cccccaaacccataaccacagttgaaccatgagaaaaacagcagacagaccccacctgagggacagtctacaaattacctgaccaacagtccatcaaaagcaaggaaagtctgagaaactaccacagccaagagcagcctagggaaataagatggctgcatacaatgtgagagaccctgtggaacagagaaaggatggtgggtaaaaactaataaaatccaaataaactacagagtttagttaacaataacataccagtgttgtggaaaatgtaccgcagcaatgtcaggtgttaacaataggagaaactgggttggggtatatggcaattctgtactatctgcaaaacttttctgtaagtctaaaactattctaaaagtttacattttaaacagtgagtcatctgtctgggctttaggtaatcctcaaaacctagctatctttgattccccttttttgccatttatgaaggatttgagcttctgatgtggggggtatccaagcccctagatcccaacctcatttccataggaagaatcatcattttcaag

SEQ ID NO: 240834 - DNA, 318 bp, Homo sapiens
ctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttca

SEQ ID NO: 240835 - DNA, 425 bp, Homo sapiens
cttccatagatattaccttcctctcctccattccaaatccaaaggaccattctcttaagtaatgaaggccttacagggtgatgaactgtgaaccccaaacatctgagacaggtctcggttaatttagaaagtattttgccaaggttggccaggcgtgctggctcatgcctgtagtcccagcactttgggaggctgaggcaggtggatcacctgaggtcaggagtttgagaccagcctcaacatggcgaaaccctgtctactaaaaatacaaagttagccgggcgtggtggtgcatgcctgtaatcccagctactcgggaggctgaggcaggagaattgcttgaacctgggaggcagaggttgcggtgagccgagatcacgccattgcactccagcctgggcaacaagagcaaaactctgtctcaa

SEQ ID NO: 240836 - DNA, 227 bp, Homo sapiens
aggttagttccttctgtaagctccacctcctccaggggcacccgctaattggctccctcagatcctggctagccagtacaaggcctcagcagtgcacagatcccatctccagccagtccaggtggcgctcgcatggtagggtgcatgaacctgtgttggagtacaggccttctttgctccagttgtttcccaataataaatgttataaaattatcaaaggcactgta

SEQ ID NO: 240837 - DNA, 494 bp, Homo sapiens
atcaacaatgctttcaagaagaaagacttttgatcaaaagcgggaaatgagaaagcgactttcctctgaaaagtgcctcccagtcccgaggctgcgaggcccccacgccaggctggctcccacggaagccgggcacccacccggcccgaccaggcgccactccgccccgtgacccgcggaggccccggcccaccccggggacgcccgccccacaccgcgtttgcaccccgggggccccttgccgcagaggcggacggcgcgcctctcccgggcccctggggtccgcgcctccctcgggcagactctttcgactctgctcgagcctccgcttcttcctgcgggcggacgccccggacacaaccggccccgctgttcacgcaggggcgccccggcggggcgggcagagacccggggacgcggtcccgtcccgagacgctcagctccggcccaccgctcgcagctcccgccccgggcgcaggtcccgaccccacggg

SEQ ID NO: 240838 - DNA, 458 bp, Homo sapiens
caggtggagtgcctttctcggagttcaacagagccttcctgtcgcccaagggacaactccactgaatgcccaagccacacccaaaacctaacaagtaaaaaccaaattctgtgctcccccatcctgggccattcctggtttctctactgctgttggtgataccaccatcagcttgtccatcatgaccctggccagttcctcccacaaccctccacagcacccagggacctcacctccattccatccgacacagatctcctcaccacaaaccttggttttgcaacagcagccatgagacctttacaccctccgcccttcatcctgtcccccactgaggccccagagccattccttaaagcagcgcgccacaaactataacccacaagccaattctggtacccagcctgttttgcacagccagtgaactgacaatgatcttttcatacagccagaaaaac

SEQ ID NO: 240839 - DNA, 585 bp, Homo sapiens
  misc_feature (582)..(582): n is a, c, g, or t
gtttgagaaggagggcctttgagacctcagggagtgggagacactggctcgagaataataataatggcaatttctctcatctgtgttttcagggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttggtgcattgaatgaacagcgggacattggacacctgctgatccatcaccccgggcccgggcaggcccgtggatgaagagagatggagaagaccaggcatgagactgtggagaagccacaccaccagaaacccctgccccatgcgccgtccagcccacacctgtggatgcacgggggattgcaggcagggctcccaccgtggactcaggaacaggcagggaagctgctgcctcaccaggcgaaggggccaggagggggaggcggagaggcccgtctagcccctgcggctgtcaccgtggtgcctcctcactggccagtgcgnccg

SEQ ID NO: 240840 - DNA, 791 bp, Homo sapiens
aacttgtaacaagtaacaacagagctcaggtcccagaccgcactgaagctctgtgagacctctcctcatctgtgcatgaacgagtgtctgactctggagcccagcctgctgcttcccagtctggtggtgaatcctccgtagtctgggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttgggtatgtcatttcccatttctcaccctcaaataggactccgcttcccatctaagcatttgtataaatattgattattggttagtgtgtatcagagagctattgagtaaaaattatatcagaaaaattaagaatctctagagatggcaaggtgtgaaacaaaaaacgccaggaaggtaaatgctcaaagttcaccacacaccacagtgagaagtgttgggggcccaggtctctgaggctgcccagaggggctcaaggtttgtagtgaatacaggaatcagctggaagctgtaggccatgtgacccttggacccccattccaggagtagttgaacacgtctgggcaggaccccagaatctgcattcccaagggagtgcctggtgattctaatacagcagggcctgatccaccctgaatccattgcccatctccatcaaagcttcctttcaccagtcaagcccctggctggggaaaggt

SEQ ID NO: 240841 - DNA, 558 bp, Homo sapiens
aacttgtaacaagtaacaacagagctcaggtcccagaccgcactgaagctctgtgagacctctcctcatctgtgcatgaacgagtgtctgactctggagcccagcctgctgcttcccagtctggtggtgaatcctccgtagtctgggcatggactggaactcccaatacccctgacatgggctgagtcaacgtggtcatgaacatgtgacaggaggcagcagaagttgcagagaagagtgaggcacgtttgaaaaaggctgaaaaatgtttctgtccaggcaagggtgtgtgctgaatgactcaaggattttttggcaacacaaaccaacacgagccgtgtgaggatcaggtgacagctgcccaaaagctgacacaaggaacaagcctggaggagcgaggatgggtgctgtgaaggaggttgtgcagctgggcccgcagtcggacctggtgagatcagaggagggggtgccaccagtctgtggacgaagatgagaagctggaatagagcagaaaacaggaggctgccactctccatctttcccaaagtcactccagga

SEQ ID NO: 240842 - DNA, 662 bp, Homo sapiens
tgggtacttatatatgtgtagagtctatttaagaagcctctcaataaattatgtttcacttactaatattccaactttacaagtgaaacaaataagatatggagaggtgaagggatttgcccaaggacgcacagctagaaaactgatgtgaaactggtgcaaaacaggataaggaagggtagactttgatgccagtttctcaaccccagtgcaatgactttctcgtcatatagcttcaccttcatttctccccaatccaaaaagaagaaggacgttgagctcaactgtggtgaaaaactcgctacactgcagagccatgaccttcatccatgccatcaaccatgcccttttcctcttgcagtgttgtgagaagccaaaaagttcagacttgtgcagagctgacaggaaggggcctgtgagggtgacggattttgctgctatacagttatggctgtagattacagtgcggggaatgagagctcaaactggagtgaagaattaatagttgagttctctggcttgtaaattggcatctgtggcatgctgtgagatctggagttgacattgagtggcacaaatgagaggtggaaggcaagtccctagacacagccaagagactggttaattttggaaaggcgaggaatggataaaggatgaaagac

SEQ ID NO: 240843 - DNA, 346 bp, Homo sapiens
ctctctgcgggctgaggtcatgcccttgccatttatgatggatacctttaggcactaggatgtgtttcctccctgagtcttctcccttctctaaagaccccaccctggtccactttcttccagcataacgtggaaattggagcccttgcttgcaatcttcctctctccagtttcccattgcactcctaacttgctcattctctttttcctggggtggggagtggtgcatcttgcttctcacctccaagcttctttgagactgcacaaggaccccccatcccatcactcagctgtcaacagagtgcagcagggaccgcttcctatgtgtgcagacgccatgggatac

SEQ ID NO: 240844 - DNA, 447 bp, Homo sapiens
cttcactagtgtctttatattggcagcacgtccattcagtccaccttgtaggcaagcataaagaaaccctttagccgaagagttccctattttttcttattttctaaatttcttattaaaaaaaaatttgctatcacatagttctgtatagttccagtggataataaatcactcgttctcaaattgaatcacattcaaagttcactactcctactattctaaaaagaggcgccaccttggtagcagcccacatgtgtaagtatgttcttggttcaaactgtgaatccctttgctgtgaattctgctggtttatgtaccctgaagccatttatgagccagtctgtgcgtgcaggaccttctttgtttttgtttttctgagaggaagtttcactcttgtcacccaagatggcaccaccgcactccagcctgggtgacagagcaagactc

SEQ ID NO: 240845 - DNA, 789 bp, Homo sapiens
caggcaggagacagcgactgcttggtccggggcaggtgagcgcagcgcaggccagggccctacctgtccacggtgcgcgcgagcggccagcagagggcgccagaggaccacgagcggcccgcggaggagtccgcgccggccccgatgcccagctccgcgccgcgcggacccaccgagcccgcgctcagacgccccagctccgccgagaggccgctcgctccgggtccttcctcttccccaggtgcaggcagagcccccggggccatggccagcccttccggcagctccgaagcccctggcaagccccgaggcagggatggccggcccaggagggaggaggacgacgtccctcccgaagagaagaggctgcggctcttgctggaggggggaagcgcacagccccaggactgcgaggacgggcaggacgcgccgcggtcggccaggaaggagaccggcacccagacaggtggcgacggcagaggagtaacacagtggctcacacctgtaatcccagcactttggcaggtcgaggctggtggatcacctaaggtcaggagttcgagaccagcctggccaacatggcggaactgtctctactgaaaatacagaaattagccaggtgtgatggcacacacctgtaatcacagctgcttgggaggctgaggcaggagaatcatttgaacctgggagacagaggttgcagtcagccgagatcgcaccaatgcacttcagccagcctgggtgacagagtgagaccctgtttcaaaaataaataaataaataaaatag

SEQ ID NO: 240846 - DNA, 659 bp, Homo sapiens
  misc_feature (553)..(553): n is a, c, g, or t
  misc_feature (645)..(645): n is a, c, g, or t
caggcaggagacagcgactgcttggtccggggcaggtgagcgcagcgcaggccagggccctacctgtccacggtgcgcgcgagcggccagcagagggcgccagaggaccacgagcggcccgcggaggagtccgcgccggccccgatgcccagctccgcgccgcgcggacccaccgagcccgcgctcagacgccccagctccgccgagaggccgctcgctccgggtccttcctcttccccaggtgcaggcagagcccccggggccatggccagcccttccggcagctccgaagcccctggcaagccccgaggcagggatggccggcccaggagggaggaggacgacgtccctcccgaagagaagaggctgcggctcttgctggaggggggaagcgcacagccccaggactgcgaggacgggcaggacgcgccgcggtcggccaggaaggagaccggcacccagacaggtggcgacggcagaggagtaacttcactcttctctgcaacgaatcccaaaagtatataattgagctgactgcaaggtacttgacacncaagagactccacaaatgggattcagcctctggaaagtggtggtagttccagatttatgtggatgttactttgtttttccctataaaatatnttatttaaactatc

SEQ ID NO: 240847 - DNA, 557 bp, Homo sapiens
agtttaaatattacgtagtttgtgaagccttttgcaattctcccaatcagaataaaccagcctctaatccatggactcagaatgaatgaatggtctactgccacccttgtcacaggggaccaagcaaccttggagaatccacctgcaacattcctcagagaagctgcaacattactttaaaagaagttacagcagtgcatactattgttgctttcctacaatgtagcaaacagaaactttggttccagaatgttcctgaatataacacagtaaaatttcttgataggagtgcttcacaaaagatgtcattgaagatacccagtttggaagttaaggcattggctctgacattacttttgccccatctaagcttagtttggtagagtcatatatagggcaggatctagctaataattgtccttaactcaaaagcataatcttatttcaggtagaaagccacactaacttaattgccaaccagataaatggtgatcacttgaaatctgttttatacttataaataaatcttgaaatattaattatccgtgcttaaaaaa

SEQ ID NO: 240848 - DNA, 568 bp, Homo sapiens
agccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaatataccatagacagtgagtcttttctcaataccagtagcttaataataccagattcaaagcagacagaaaagagacaggggtgatggctcatgcctgtaatcccagcactttgtcgggggtgggaggattgcaggaatccaacctgggtaacatagaacccctctctata

SEQ ID NO: 240849 - DNA, 556 bp, Homo sapiens
ataattagctggatgtggtggcacatacctgtagtcagctacttgggaggctgaggtgggaggataccttgagcccaggaggttgaggctgcagtgagctgtgatcatgccactgcactccagcctaggctgagtgagatcctatctcaagaaaaaaaaaaaagatgacttttttttcccctaatatcttgaactttaaaaatcttgtatttctaaataagcttcaacaattataaaatataaagtcaatggaagaaaactttaaagagaatattgatagaattcactacataaaatgtgatgctttcaggcatccaaaactctaatcaaaattttaaaataacagataagttgagacgtgttaatatccttactattcaaataattcttataaattaataagaataatatgaaattgaaatgagcaatggacatatataatttacgaaaaagaagtacaaatgaccagttgccttatgacaaaaatttcattctcactaataatcaaagaaatgattgtgcagcatctggattttatgaaatgaaaataaatatt

SEQ ID NO: 240850 - DNA, 486 bp, Homo sapiens
gtcccctgaatacacagtccatgtgaaagagccacaggagaagaagtcattgtatgagaaaaagaaatatgaagacccagcctgtacttgacatctgtgatgaatgcagcctttcaatgatgaactcctgccagccccacctcaatttgaatttgcattctccattaatgtggttataatgctggccctggtcaaagtcccatcgtaagtctcctgtttcctgggtataatacaaacatcaaggtcacatacaagccagctgttgactaacaaaacagtgaactattattgaagtagccttgggccactgtacagagtattctttacatgcaacaaaagctatgttggggacaatgtcagaaatcaattagaaccaccaaagataatctttcattctctctctcatacaagctctatttcactttgtctttcttttccttttgaattgttttgcaagcagtattaccaataaatctatatctgatc

SEQ ID NO: 240851 - DNA, 372 bp, Homo sapiens
tatacatcactgtgaattgtgctctgtgtattttacccatctccacgtattttacccatctgctccctggctgatgggtttggagatggcgtctaacaccctgcctccacaaataatgctgctccagatatcttcctggatggtctcaccagatgatttctacccaggagcagaattgctggccacagggcatactttgagtactacaagactggtttcctcaatgactgacatcctccattctcttccacctactcccatccccaaacaggacatgtaaatttctatattttacctatatatcatggcagtatccagctttattgtaggtgtaaaatacacattgctgctttatcatgtacttttctaata

SEQ ID NO: 240852 - DNA, 647 bp, Homo sapiens
gcggccgcatgtagcgatgtggagcgcggcgactcggagtccttctcggagcccatggccggcagaggccgaggagccaggggcgcccagcgccgccacagctcccgcctcagcgcccctcagccagcgcccggccgccgccgacgccgccaccaccgcctcaaccgccctcccggcgatagaagccgagcggcaacgacgaagtgattataaagcctccgccccgcgcgccgctgccctgcgcaggcgcttcgctcaaacacctcacaacccttgcgccccggtctaggagtgcgctgggcagggccgagcggggtggggccgagcgagctggggcggagctccgcctcctgccggtcaggtggttccagggccgccatgttgcggagactctcagagatcctagcccgctgctctccctggtctccgcctccaattccatcaccatgacacccaaggtggactttttggtttgccgttcctcacaggttgattgccacttccagtaaatgatggttcagttacattatttataaaaagcaggcaggggttgatcagatggtgactcccaactggttcaccttccaacatttctgtttattaagcagacggcataaattaataaagaatatattcattcacaaaaa

SEQ ID NO: 240853 - DNA, 479 bp, Homo sapiens
gtttcaaaaaaaaaaatgtaactccagattccactatgagaaagtgataaatttagattactttgtgttgaggaactaacaggaatactgattctgcattcctataactctgttgttaatactttagtatactttatgtgtcttaatctttgcaacaatcctatacattcatttatttcatttaataaatatttattgaatgcccactctgtgccaggcattgtactaggcagtagagataaaatggagagtgggaacagaggcaggcttcacgctcattattatgattttattcatttttttaaatcctgtcaacagatatctattgatggcctagtgtgtataaagtactgtttctaggcaccagaataaagtaggcagaaatctgtgcctctcaagtagattacattctagatggggaaaataggatgtaaacaaggtaaataaaaagtatagtatattggcgaaaagagctaagc

SEQ ID NO: 240854 - DNA, 458 bp, Homo sapiens
tccacaatagatgttccctgcctatgtggtgtttttaattaaacgttgacatcattctcacatgttcactgttattagcactgatggatgtaatcttcatgttttcctctgaacactgcatgccaagaaaggggccctctatcctcacggattttctaggcaagagaatatcaggccctcatctgtcatatttccatctcattcagcacaaaacaccctggctcatggaaactgcaagcatcgttgtcagctgcacctgcaggcaccacgggattgcaagtcagcataccctttcagaaatgaggatgaaattagaggtagagagaaaattctccactgtcctctcacttgtctctgttatggtttctgctatgttttcattgattatgctatagggagaaaggaggaaaagaatcccctaagaagaacagtgtctcactggacattgtttctttgca

SEQ ID NO: 240855 - DNA, 1128 bp, Homo sapiens
acaccacattgttgttccatccttctctgtgcctttgggcaaggactctccgttctgtagggaccaccaggtggaattaaagtctacactcctccaagagctgatcttggggcggccccacctccatgcccctctacagcgtgccattctcatagaacacactaggacctttgtcctctggagctgttcagtgcagcagctctgacctcatccttctccagaagcctccaccttctctcccctctctcctcctgcgctttgtgtgtcctgttcttccacttcggtgacctgtctcctcccctaatctggctcagagaggggtaccagctgctgctgctgctattgcttcttcttctgttaaaggttttttatttttttccaatgacaaagctatgctcattctgaaaacatgaaaaataaaaatgctcaaaaaataaaactcactctacattcattgctaggagagaacagcctgctcccattccagcctttttatctatatccacttaacattaaacatacagagtttctactctatttagtgattgtcacctgcactttaaacttaatggttctttatgagcattttactgggtagttgttctacaataacattactggaactgtttgggtttcccttgaccctcttaaaaattactgagaaccctgaagagcttttgttttataggttacatctatcaatatttgctttattagaaataaaaactgagaaaaagtaaatatttattaatttattttaaaaatgttaacatggaaagaaattatattacataaataatgtattttagaaaaataattatactttccaaacaaaaataattagtgggaagagtggcattgttttacagttttgcacggctcttgaatgtctggtgtaatagaagatagctggtttcatgcctcctcctgcattcagtcggtcactatatgttgttttgtttgaagtatgtgaagaaaattcagccttatgtagatatgtatatgggaaagaatagaggattttaatcgccttttcagataattacagatgttcttttttcataccacaccaaaatgcaaggagtcgtttcttaaaggttaagtgcaatgtcagaacctgaaaaaaaa

SEQ ID NO: 240856 - DNA, 364 bp, Homo sapiens
tcaggggcttttagtctttttccaacaagcagctgccctggaaacttgacatctgtaactcagggcaggggaaggaagctctccttgttttggagcatttctgtcaggaagcctaattacagaactgaccagaagccacgttgtgagagattgtcagaagagccatgcggtaagcgctggcagaaattagagctgggatggcctcagctctgctggtgacaagatcctgccaggcctcggcacttaatgaccttatttacccatccacacggaaccctcagaaaagccctgtggaatcgatgtaattttctctcagctttgaaagttataaaatatttagcatctcatgctacatggtgaacag

SEQ ID NO: 240857 - DNA, 546 bp, Homo sapiens
gaaattgtttgctaaatctgaacacattaaaataaggaactaaacgacaaacttgaaaaaggatcattttaggccaaataaatgggcaagtcacacgtaatcataaactgttgtaagaattaaaatacctgtaagggagaattgcttgaacctgggaggtggaggttgcagtgagccaagatcttgccactgcactccagcctgggcaacagaatgagagtctgtcttaaataaataaataaataaataaataaataaataaataaaatccctctaaggactttacaacactgcctggcacgtggattctcagtacatgttaatagacattattatttttgagattgttatttgaagaagtgagggaggatactgagtagtctgaaaaataaacatatgttcaaaaaaggtattaaagtgatgctgtccaatgtggtagccaatagccatatgtagctattcagcactgaaaatatgggtagtccaaattgagatgtgctgtaaatgtaaaatgcacaccagatttcaaagtcttaatacaaaata

SEQ ID NO: 240858 - DNA, 795 bp, Homo sapiens
ttcctgcgcgtcctgtatctatggagacggcaatatggaggcgatcttacatttctttgatttcatctgaacgtccagttcacaattggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgccccttacagccgtcatctacgaggtgcaggccacgtgctggtacggggcgggcagccggcagaggagcagcatccagctgcaggctgtggcaagtgcgcccagctgctggtgagcataaagcacaagtgcccggaggaccaggatgccgagggcttccagaa

SEQ ID NO: 240859 - DNA, 716 bp, Homo sapiens
ttcctgcgcgtcctgtatctatggagacggcaatatggaggcgatcttacatttctttgatttcatctgaacgtccagttcacaattggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggtaccagtataagggatcaaggacccagtgccacagccttgagccccgaaagcaggctctcttcaaaacaaaacaaaacaaacaaaaaaaacctttaacatgccatataaaagccagtgagtgtttaaaatacgtgcagtatgaataattatgcagctataatccattatttttcattgtggtatagtgtcccaatgtgtgcctgtaccataatgtattcatccagaatgaaggaa

SEQ ID NO: 240860 - DNA, 481 bp, Homo sapiens
atgtgttgagtggagactttttcagagctctgaggcaggagctgtctgtacagtcccctgaggtcagaggcattaatgagtcaggacagggctgcaagaccatcccgtggcagaaaagtaatggactctctctgtgtctcctcagcttacatttctttgatttcatctgaacgtccagttcacaattggaggtaggagccttgcctgccttgtctggtgcctagcacagtacctggtacataatagtaagtgctttgtgaatgaacgaacgactgaatctagatagtcccctccagagggtttagacatgttgccaactaggaaaaccagggtcaacagaatcttccgctttggaagggtgttggtgggtggtgggggagggataagagagtgtctgatggaactgtataaattcctaaagggtgatcatgaaattgtttgctaaatctgaacacattaaaataaggaactaaacgacaaa

SEQ ID NO: 240861 - DNA, 682 bp, Homo sapiens
ttcctgcgcgtcctgtatctatggagacggcaatatggaggcgatcttacatttctttgatttcatctgaacgtccagttcacaattggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgggacctgcccaccttcttcacctgggagttctccagcccattccagatgc

SEQ ID NO: 240862 - DNA, 672 bp, Homo sapiens
tctcatctgttaaatgttacctacctaatagggtagttgtgagaactcaatgaaataatgtacatgaaatgtttagcacaatgcctggtccacagcaaatgttccacaaaaattaacctctatggtagcattctagactttaagccataaaaaaaatcatagattatttccaaatggaaagaatcctcattggttggtattctcagtttactccaagaaaaacactctttgtactagcataaagaaaggagagaacttggccaaaaaataaaaatacctggataaagatccgtgcagtgttgttcttctaatttcaccttttagtaaggactagtatttaatattttttgtacacctccatgtgtcaggcactctgtattcacagcagtcctgtgaagtggctataactgtctcacattacaggcaaggaaactgaggctcaaagaaatgaaagaacatggccaagcctgtgtactatgtcagcagaagagggatttgaatgccagaggcaacgctatttcagttcatcttacaacgccttagaagtagaaggaaagaaaggttcatgggcaaagtctggccctgctatggactccacggtaatagcaatatttctactttgatgttcccattaaaatcttatcctctagctgagggggcctggcagagtgg

SEQ ID NO: 240863 - DNA, 307 bp, Homo sapiens
ccggaaagggcgtggaagctccgcgccccttcccacagactttcccccatccatctcttcatctggtgttcatcgatagcctttgtaatgtccttaatagtaaaccggaaaacatgtacacctaacagcatggtaaggaagccccagaaggatgtttctaaagaccatgagggagtctgaaacctgaaatcatgccaaggactctctgcttctctttcacttggggtgtctatctgatgctgccacaaccagttgaaacgtataacattaacaataaaaattagtttttttgtaactaattttatgc

SEQ ID NO: 240864 - DNA, 408 bp, Homo sapiens
agtgaaagaagccagagcaaaagactacatattgtatgattctatacatatgaaatgtcatctttagaaaagagatgcagatgacaagctggccaggcctaattccagccttaagactagcattggccaggtgcagtggctcatgcctgtaatcccagcactctgggaggctgagacgggcggaccacctgaggtcaggagctcgagaccagtctggtcaacatgacgaaaccttgtctctactaaaaatacataaattagctgggtgtggtggtgggtgtctgtaatccctgctactcgggaggctgaggcaggagaatcacctaaacccaggaggtgaaagttgcagtgagccgagatcgcgccactgcactccaagcctgggcgacagagtcagactctgtctca

SEQ ID NO: 240865 - DNA, 413 bp, Homo sapiens
taggtgctttccctacatttttattgccttttaatgaaagagatctttgggtttttggggaggagatgataaatagtagggagtgtgaagtttaaaagaacatatatcttggctataaattccataatgtgaatacaacctcttttgtttagatctcttaattttttctcccagcaatgtacagtctgtttgggaatcattcacatacttaagctgtatttacatataagaatcatgctttggtgaagtaggtgataaaggcatgggaatcttccagaatgtaaagagaaaaaaaaatcaaataattaggagtaaaaaaaaacactccaaacttaaaaaacattcactcatatttagattgagagaaaactcaaaatgctgagcacattcatcctgatgaaatttcgtaatta

SEQ ID NO: 240866 - DNA, 465 bp, Homo sapiens
tcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaat

SEQ ID NO: 240867 - DNA, 546 bp, Homo sapiens
tgaggatcgtcttactcgcaccctggtgctgggcgctgaccacctcccgaagcacttggccagggggagaggatgctggacacaatcaggttctcctggggggaggagggagggaatggctgctggaagggttctaccggggactcctacagcagcttgttagatctccttcctcccaattccctgaagttggtggaacaggaagaggacgagaagtcatgtttgtatgttgtccccttggaatctctcaaaaatccgcaatatcccgatttgagaaatgagcatcacagagaaagcaaagcggtagttggaagctgccaagcttgtgagcaacgagacggaatccacgcccagggctttctaacggcggggccacgccctccacactccacctcggccctctgccctgcgatggtgcagagacagggtgtggtcaaggggcctagggtgagggtcctgccagtactttacaggaaactccccctcttttagcctcatttgtcaaagaaagggcttagacactaaaatcttttaagtttccttcta

SEQ ID NO: 240868 - DNA, 590 bp, Homo sapiens
tacagaggtagtgctgaaatgctattgctattagttataatgaaatttcgtactaaagagtttccttaggtctgttctctgaccagcttttctagggcgagttaagcagcgacatggactgttcgtacatcctttctcattttcattctctcagaagaaatattcaaattattttagtcatctgaatagtagaagaaacactattctaaaaagttttctgaagtaaaagaaaaatgtcacaaaaacatttgagttacttaacttgctttgtcctaaagctattgaattaagaaagtttctcatcttttagaagtaaattatttcagaattataaaggtactgatcaggaaattatgctactcccaacacatgacaccaggtaaactcattctcaatgagaagggttaaaccatcagtcacagaagattcatacgcagtaaaatcaatctgcacattaatcccaactcttctaaaaccctccaatttaaaccagttttccctggtgaatagcaaagagagtctctttcagacacataagttgggcccacaaagtgttcacttgttgaaagtgctggggcttttttattatt

SEQ ID NO: 240869 - DNA, 482 bp, Homo sapiens
tgctcttttctttaggaacactaattatatgtatttgattatctttctttagttactggttttctctgtaatcacatttgtattcatttcattttttattatttctccaggcctcattgtgaccttgtagtgattatttttgttgttccttatgtgaatttcatctacataatgctttttatttgcccttccatttctttcctcagcattgtcaaatcacttctcactactttttattgttttctaatctaatttgtttttggccaggcatggtggctcatgtctgtaatctcagcactttgggaggctgaagaatcccttgaggccaggagtttgagacctgcctgggcaacatagcaagaccttttctctacaaaaaaattatttaaactagctgggtatggtggtgtgcctatggtgtcaggctgaagtgggaggattgcttgagcccaggagtttgaggttgcagtgagctatgattg

SEQ ID NO: 240870 - DNA, 406 bp, Homo sapiens
ggtattctgtgtctgctttgttccatgccctctcctaggatgacacaccctttctattaagacagaagagcagtaacttaatttttgttatgtgatgccctggtctgaatttttgtgtttccccaaattcatagattgaaatcctaacttccaaagtgtgttagtagatggggcctttgggaggtgattaagtcatgagggtttgagccctcaagaatgggattagtgcccttataaaagaggctcaagatggctgggaacattaactcatgctggtagtctcagctactcaggaggctgaggcaggagggttgcctgagcctaggagttccaggctacagtgagctatgatcatgccactgcactccagtctgggtgacagaatgagacactgtctctaaaaaaa

SEQ ID NO: 240871 - DNA, 424 bp, Homo sapiens
gaatatagagataaatatttgtggggtgcctgggtattttgataaatatctgcttcacaaatgttcttccttcctttatggtctataagcccccgcagaaagtcttgcactcaatctgtccttttgttacattgcctttctgtccccagtttccaagctttcttcactttatcctggtatctttatacttttaatctactctaagtcctgttgctgcttttgttctaaccaactcaatggtctagttttcctcttgcaggccctacaccttcttctacaaggtagttatactgtaatcctgatacaattctctgataggcagctagtctctcttttgggccaccccatatgacactgttaggtggggaggccaggagctgccaagggtggtgtgcagagggtagcatccaaggggaacctgaag

SEQ ID NO: 240872 - DNA, 370 bp, Homo sapiens
gaatatagagataaatatttgtggggtgcctgggtattttgataaatatctgcttcacaaatgttcttcttgttacattgcctttctgtccccagtttccaagctttcttcactttatcctggtatctttatacttttaatctactctaagtcctgttgctgcttttgttctaaccaactcaatggtctagttttcctcttgcaggccctacaccttcttctacaaggtagttatactgtaatcctgatacaattctctgataggcagctagtctctcttttgggccaccccatatgacactgttaggtggggaggccaggagctgccaagggtggtgtgcagagggtagcatccaaggggaacctgaag

SEQ ID NO: 240873 - DNA, 600 bp, Homo sapiens
cccctggtgggaatatgtcactagtggtgtcttatcctcttttaagtgacactgcttcattgccaagggagcagccttatgaggaccaaaccttgcccctttccagcccttccccaactgatgggatcagtgttgggcctctgagccaaagcaggccaggctgtaggctggccagcaaagtggctggcaggaagagatgagatgtcagcttccatgttgagaatttagggaacagaaagattgaacacatagaattaaggtcatgagattgaggccagaggaatggcaatggctgtgagagagatgggagaataacagtcaggcttttctttgagtccagggagcaggccaccgtcctgaggcataagactaagccaggggctcactccatcccctggccagtggggccttggccctgagttcagcaggagcagagctgccactgaacctcagaacgtctcggcttgtctcctcatctgattacatcgagtgtcatgttcctggaagaactccactatgaaataagtgattttatgatgaatggaaataccacttgccatggcaattattaaacacaaggaacttattatctcccaaaga

SEQ ID NO: 240874 - DNA, 811 bp, Homo sapiens
acctcatgagagaacctgaaaacaatgaataaaaattaaaaatagaaaaggatttcaacagacacttctccagtgaaggtatacaaatggccaataagcacatacaaatttcttccgcatcttcatcattagggaaatgcaaatgaaaagcacagtgagctaccacttcacccccatcaacacgactaataaaatatacagcaagtgttgtcaagtatatggagaagttgagaccttcatacattcctggcaggattgtaaagtggtgcatctgctttgaatttggtagtccttcaaaatgttaaacgtagagttaccacatgacccagcaattcctctcctatgcatttatccaagagaaatgaaagcacacatccacacaaagacttggacacaaatgcacaaagcaacctcataacggttcaaaatcgtgaacaactcaaatctccatcagcaattgagaggatgaacaaattctggcatatccatagggtggaatactgctcaacaacaagagtgagttaggcggggcacagtggctcacgcctgtaatcccagcactttgggaggccgaggcaggcagatcacgaggtcaggagatcgagaccatcctggcaaacacggtgaaaccccgtctctactaaaaatacaaaaaaaattagctgggcatggtggcgggcgcctgtagtcccagctactcgggaggccgaggcagaagaatggtgtgaacccgggaggcggagcttgcagtgagccgagattgcaccactgctctccagcctgggcgacagagactctgtctcaaagaaag

SEQ ID NO: 240875 - DNA, 949 bp, Homo sapiens
gttataaagccaggatgtcccttagattttgttctcttcgcacatgttcacttcgcctttgaatttctccaccatgttttgacacaacacaaaagccctcaccagaagccagaggcatgatctttaacttctcagcctgcagagcgatgagccagataaacctcttttctttatatatcactgagtctcaggtattcttttatagcaacacaaaatggactaagacaagtagaacttacttagaacattgagttggttaggtagacagggattttagcaatatgagaaattattaatttctgattgacagctcatgagttaaggcttgctttacgctttctcaatattaacgacctttccataaacttgtactgtgagtactagaaaggtctatctattcttgcataacagatatttctatcatgttcactaacactgtgttttggtttaacaacccctttgcctaggaacccaagacaattttagaaatgaaaccagtgtacttccaagtgatataatccattcattcaactatttattgagcaacttctcaaaaatacgccaggcaatgccaggtactgaaaatataatattgaataaaacaatcatggtgcttgctattttagaatttacattctaataaatctgtgttaactacatgtgggtttctcctaacaataatcaggctgtactgtaatccatctctcacatgtttaagctttcttctatctcaggttgatatcatagtccacctctcactttcccctaagttaaaggtattatttattcttggtgatcatttgcaactacttgcatagatctcaggatacagtgtttgtgacaggtttcttgttcttgtgaaccctctgcctcttaaaatggctcttttgaacagaatccaaaatgactgcatgtaagctctttcttctatgttgtctgtatttcagcc

SEQ ID NO: 240876 - DNA, 322 bp, Homo sapiens
gtctggaaaggtgccctgaggacaagagtgaggagaagggaggttgggacactgaggagctcaactgaacgctcagctctgtagggaagttggctgccctcctaggtgaccctcacgctggtgataggcacgggccaacccctgggacaccggggtggcatcagcaaagacctaaagagattagggtgcacagattcaaggtagtcaggcagtttggggcctcctggaagcagctgaggagatgggagtgcagtgagctgtgatcacgccactgcactccagcttgggcaacatagtgagaccctgtctcaaaaaaaaaaaa

SEQ ID NO: 240877 - DNA, 795 bp, Homo sapiens
aactctgaagttgtctaaatgaaactctgaatccaggacaattgagctcatactacattccccaacttttccaaccacatgtagaaacatggacagtcagacaactgtatcctatgtaaaaacataaaaataaaattaaaattttaaaaaatcaaagtgttcttttacaaagaaattgaatgaattatctgagattacctaaggcagagtgatcggacatcaatttttccagagcaaagacctctacatgtgggcactgggggtcttgaaacatacttggcctgctcccttttatttctgtaatgtgaagactatcagttaataagcccacctacctttccagagcagccaagtgtcatgcattactaccaactatttgaggaaatacggtaacatgaaagaaagatacagctaaaaacaaaaagaagaaaagcctctaatcacttaacttaggagaaagaatgatttaaaaaaaagaaagaaaacttaagaacagacaaaattctagttagtttctgtaaagaaacttgaagagttttcatttatataaaataaacagtggaggccatgaagaaagacaaaaaactgttggaaattaaaagtatgataaaaacaaaaagaaataaaaatgaaagaagaatgaattaaaagaaagataaaacctaagaaatatctggaaagaagaaagaagagattaaaactgagcaaaacatgaaagaaaaagaaaattaatttagaagacccagtgagataccaagaaatttcaaaaaaaaaaattgacagaaagaacttatc

SEQ ID NO: 240878 - DNA, 376 bp, Homo sapiens
gaaggataagtgtagtcacaggctcggcttcacgtgaagggcaaggcggtgtacatgttcgctgaaggctagcctcaggattcagtcaggcgttaggaaggacaatcgcgggatactaacgagaggtcctcagagcaaagttgaaggcgagccgctatcatctgctgttctctgccgcagagaggactggaggctcacagctggaggaatttgccttgggatgaatcatgccttgagtctcacctatatctgatttagatgagactttggacttcaggcttttgagttgatgctggattgaatgacggtgccatgctcttggacttaccaacctccagaactgtgagctgaataaacgtcttttctttaaacatta

SEQ ID NO: 240879 - DNA, 370 bp, Homo sapiens
gattttgttttcaggaaggcatttccctataacgcagttaattttcaagtaccagtcccaatgcagtagcattgggtaatttatcatcacagaaaatcagacagcattaatgttccttgagacaccttgcgttggtgtggtttcatggaaggagcaccgagctaggaattaggaacctggcacttatctcagattggcctgattgatgatcttgggcaagttgctagtgttctctagatttcaatttatctataaaatgaagggattggatatggtgatttctgagatctcttacagttcacggaaacatttattttgtgtgtactttctgcaggtcaagtgcaggctccagcaatgcagagaccaaaaa

SEQ ID NO: 240880 - DNA, 359 bp, Homo sapiens
gagcagaagatgagagggagatatcattttacttctttgtactgcaataataaaaagaacagatagaatggaaggaagaggccaggggcagtggctcatacctgtaatcccagcactttgggaggctgaggcaggtggatcacctgaggtcaggagttcgagaccagcctggccaacatggagaaactccgtctctattaagaatacaaaaattagccaggcgtggtggtgggcacctataatcacagctacccgggaggttgaggcaggagaatcacttgaacttgtggggcggaggtcgcagtgagccaagattgcgccacttcactccagcctgggcgagaaagtgaactctgctc

SEQ ID NO: 240881 - DNA, 336 bp, Homo sapiens
tctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatct

SEQ ID NO: 240882 - DNA, 284 bp, Homo sapiens
gaagactttttagagccactgttcttggagcctgttacctctgggagaaactgcaactgtagcagcattccttccccccaggaatgtgacaaagatgagcaccattccaacacctgttgctgaggcactttccaggggtctagctgtggaggcccctactcttctctagagcaggcacttcaatcttcaggccaaaactaaaatgtctgcatgaccacactgccaggttgcccaagattggctgactttgtatgcatcctgattaaaaatggcatcttgctctc

SEQ ID NO: 240883 - DNA, 1156 bp, Homo sapiens
gtccttgaacatttcttaaccagctctggcaactctgggctggagtccaagccttataccatgtttggccagcctgaaagtgcctgtttattctgtcttacccttctctagtatgtgccaactggctcgtgctgagggaggtcaatctagccaaacttgggatgggggaggtatgcatcataatttgctatcttgccagcagtgaggttgccttcttagactcattgccttagtcccaggctccaagagattagatgtctgtggccagatggcactgtaggcagatgtcaaacttattgtatcatgaatgtcttaatcacgacatgggcaatgtggggaaagagaccattgtgtaaatgatctacaatgcactagatagtttcctcctgttacaaagctgtagggagtcatggatctttagttacatatatggcagtggctcctggatactatcccaggatttatctttgtatgatcctgctaagttaagaccaagatatagttgttctcgttttgattaggaatattcctttggtgagaaagataaagaaggagaagcagaaacaacagtctgtaaaactatgattacagctaataagtcttaaattcaccaggcttctgaggaagctttatctttaccctgctctctgtttttagtttgtgttttgtgtgtgttttatgtcatggaggggaaggtatacatccataaaaatcacttagaactggatacagaggaggatgctcacatgctccctgtgattattgagtatagtgaatcaaatttggctccactgcttcacagccaccttattaacaaaagttctttattaaaaacaaaaaactataacactatggctcagccatttttcttttccactcacaagatagggataacaggtgctccccataaacagtgggtcctatgggtactacatatttagtagtaaactctgggggagtcccggccaaagcagggagagcggggtgtctgtgatttggtaacacagctaaggaagataccccttggggaatttccacttgactccagaaacacaaatccagaaacaaattcagtgagagtggggcatctgtgatttggtaacacagttaaagaagatactccttggggaatttccacttcactccagaaacacaa

SEQ ID NO: 240884 - DNA, 990 bp, Homo sapiens
tcacttacctttcagtgctggcatcgtccaggtcataggagaaagtagtaggggtgactcaaatatttagtatttgcacacattgcaccccagcctgggcgatagagggagaccctgcttgtaaaaagcaagccaagctctttactggctgaaattgcatggagtaagggagggagtcgaaattctggggcagagaactaccttttgttgttcatatgtgtttgtctttaataatgttccccagtatcttatgttaatgaggaacattaatgctttgacatcgtttcacggtgccacttcagggaatcactcttgcttattctaaggaggatttggagctgtaccgagctaaaagtctgaatttggagatgatagtggtgaccttataggcaatatcaggtacagatggagctttaatagtgaaaaagtagactgctcagagtaagtatggaggatcatacttctgcatacactgaatgtagttgtttcttttccacacaagcactctctacaagagaggtttctttagaaagaattggacctgatggagggtcattctatcagaatgaattttttaggtttcttccttacagttaacatctctgaaaggtacggatacaagttatctacagggtaacacctgtagatatgatgcaacaggcttatgccattggagagtgaatagtcaaccttctgaaaacagtgtacaccaccggaagggcaagaaaaaaaactacaatatagaacatctttctgaccttgaggtcaggaagtcctcctcgacaagacacaaaaaagaaaaatcacaaaggaaaagaatgacaacttgactccatcaaaattaaaaacagatattgcatttttttccagattgaaggtttgtggcaaccctgcatcaagcaagtctataagcatcatttttccaacagcctccctattccctgagacacaacaatattaaattaggccaattaataatgccacaatggc

SEQ ID NO: 240885 - DNA, 418 bp, Homo sapiens
ctaaaaatacaaaaatttgctgagtgcacgcctgtaatcccagctactcagggggctaagttaagggaattgcttgaacctgggaagtggcggttgcagtgagccgagatcacaccactgcactccagcctgggcaacagagtgagactctgtctcaaaaaacaaaaaataagagagaagcagaggaagattagaccggcacatacagaaaaggccacgtgaagatggaggcagagattggaatgatgcggtcacaggccaggaaacaccagggcatggcagccaccacctgaagctgaagaggaaaggggcaggttttccccgacagtctccagagggagcgcggccttgccatcatcgtgatcttggacatctggccttcagaaccatgagagattaaatttgtttgaagccacca

SEQ ID NO: 240886 - DNA, 456 bp, Homo sapiens
aattatgaatgggttattatcaatgttgtacttagaatttcttttcctctcctagtttttatttctgcgggtatagtcggtgtatctatttatgggttacgtgagatattttgatacaggcatacaatgcataataatcacatcagggtaaatggggtatccatcacctcaagcatttattctttctttgtgttacaaacaatccagtcatagtcttttagttatttttaaatgtccaataaattattgttgactataatcactctgttgtactatcaaaaactaggtcttattcattctatctaactgtatatttgtactcactaaccattcccacttcccccttaccccactgcccttcccagcctttggtaagcatcattctactccctatctccatgagttcaattgttttaattttttcagctcccacaaataaatgagaatatgccaact

SEQ ID NO: 240887 - DNA, 249 bp, Homo sapiens
aaaaattgtgtttggctgggtagaaaaaaaaaaaaacatagcatcaattagctctgtctgcaatgggttcagtagacagagtagtagcatgcacacacacatacatacaaacataaaacatgtatatttgcacaaatattatatatatgtgtgtgtatgtatatgctatatcctgtccctttcagcttcaaaataataaagctcttttttaaaaataatttggctctttttaaaagggttaaactctta

SEQ ID NO: 240888 - DNA, 233 bp, Homo sapiens
tctaataatcatccttgccataaattctaaatctttctctgaaattagtgtgtcttttttaaggactgtgcttcttgtttaatccagtctgacaaaattcgtcttttactagaagaattttttctacatcggggtatctactcttttggcttccctgggtcatactggaagcagaagaattgtcttgggccatacataaaatacactaacacgaatgatagctgatgagctta

SEQ ID NO: 240889 - DNA, 274 bp, Homo sapiens
gtagagatagggttttgccatgttgcccaggctcttctcaaactcttgggctccagtgatccaccttcctcagcctcccaaagtgttgggattacaggcgtggctgggcccaaaataattatttaattaaatcgaataacaaggccatattcaagtttccccgtttacccctaaatatctcttgtagctggtttacttaagccaggacctaatcaaggatcacacgttgcattttattgttatttttcttaaatctattttaatctagaacaat

SEQ ID NO: 240890 - DNA, 522 bp, Homo sapiens
cacaaatcataacaagagcctgagtgtagaactaatatctatgaggagagatgggtttccccaaggggaaagagtgaagaacacatgatgaagggaaatgtgggtaaagtccatgacgttgaggagaaaaaatgcagtgttcttttaggacacctccttttcaaagacctaagacttcccactacattaaagttatcatctttatacttcccatgtacatcactgtcctttagaaagactttctgatttaaataactacatgttccctcccaataatctatttatgtgatctttaacagagtggggacacagtagatattcaggggagaagcagtaaatataccacattatgctgcaaggactctggtgtgaacagagcccaaaatggaaatatgatagattgttgaaagtggagaaaagacattaaaatgagtggagaagaaacctgaaagcgccgcagagaataagactaaaatttccaaaggcctctcagggaacagcaggtgacatatatcaagaaag

SEQ ID NO: 240891 - DNA, 381 bp, Homo sapiens
gagagtcttttgttgttgttattattagcagtgtcttactgagataacgtttccttcctctgaagcctgcatgcttgctttaatttagaaagcacagcgatggtttacattgaagagaatgattggtgttagcatgaaccactcctagatgatgtatggaagtagtgcttcctctgtgcaaaacaaaacacgtacttggaatgttttctgcattacttatatcagtcagtatttgtcatctaagttgatttatttgcatcctttttttttcttgtagaatttactaagtgacttttaatatattcaataaccattctccttgataagcactttactgctggcgcctaaaggtgcttatacttagaatctgaaagacttatt

SEQ ID NO: 240892 - DNA, 490 bp, Homo sapiens
gtattcaatctaaagaacacagagaaaaaactgaacagaaaaataaactgtgcctctgacatacatgagacatcaagtgcactagcatatgtggtgatgggagtctcaagagaacaggagagagagaaagacacaggaataagatttgaagaaataatagctgaaaatttcccaaatttgatgaaaagcattaatctacagattcaagaagatcaacaaacaccaaataagatgaacacaagaaaaatccaaacctggacacatcatagccaaactgttgaaagacaaataaaggagcaggagaaaattgattcacagtgtccagagtaacagcaatatgataaatggctgatttctcatcagaaactatggaggaaagaaggtggtggaatggcatattcaaaatatgaaaacaaaaaaaaatttgttagccaagaatgaaagcaaactaaaaacattacagatcaagagaaactgaaagaatctgggg

SEQ ID NO: 240893 - DNA, 373 bp, Homo sapiens
gcaactgaagtatgtagtacttacataggacaggggtggttattgtcatgtaagatctcttgggaaaggtaatacttcagctgtgtcctgaacaatgaagaaccatagatgtcaagatctggggtaatgagattatggggagaaggaacaacaaattcacacaattagtgaacagtagtgttacttagtaaatgacaaactgtgaccaataggtaacacagcacccatgaagtcaaattaaggctatcataacattctttttttttattattatactttaagttttagggtacatgtgcacaatgtgcaggttagttacgtatgtatacatgtgccatgctactgtgctgcacccattaactcgtcatttagc

SEQ ID NO: 240894 - DNA, 585 bp, Homo sapiens
catgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgct

SEQ ID NO: 240895 - DNA, 406 bp, Homo sapiens
actgaaaaggaaaaacatttggtaggtaacagatcagtggttgccaggggttagggtacggggagcataagggagattttaggggtgatgaggctcttctacatcttgcttgtgattatagttatttgaatctataaatgtgttaaaatgaggacaccaaaaatgtcaattttaccatatgccaatttgtttaaaataaaacaaaataaaagaaacaaatgtcaatgggaagcataagtactttttatagtaaataaggcaaaaggggaaaatgttggccgggcacggtggctcatgtctgtaatcccagcaccttgggagactgaggcgggtggatcacctgaggtcaggagttcgagaccagcctggccaacatgttgaaaccgcatccctactaaaaatacaa

SEQ ID NO: 240896 - DNA, 650 bp, Homo sapiens
tttccaaggaaaagagtatgattggtagcagttgattcactcaggtggtagaaatcacagggtttatttagaatgaaaaacacaaatgcttgtgttgtttcttaagatggaaagccacactaggtactgtacataccagcatgctgtttttcttcacttcaaggcagatttgtattctcaaacaaattaagaaaacttcctgacagtccacaacagagggcccaaatgagagaagggggtctttcttgaagacaggagaaggatcgcctactaacttagaagggagaggaggcaactgctggacccagagcaccttaacaggagggaggaaacctccagggcactacctgactgcggaggaatgacaagaatatgataatgacactacttactaaaggcagaagtctatgagtacatcaggaaaaaagcagttttttggtactcatttaataagacaatgaagaatcctagccagagaaacattaagaactgagtagtggctcatgcctgtaaccccagcactttgggaggctaaggtgggaagatcacttgaggctagaagctcaagaccagccttagcaaaataacaagaaaccccctctctaaaataataaaaaaattagctgggcatgatggcatgcccatagtcc

SEQ ID NO: 240897 - DNA, 303 bp, Homo sapiens
atttataaattttgatggagaagaaaaggataatctgatatgagttggactgatgacagaagtacaagataaattttcaacggattttagaattacagttaatgcagttcaattaaattcagcaaatatttatttagcacctgctatgggtaaagagttgtatctttgctataatgattcattaactgaatgtacatttattaattttctattacatgtcaggaactgcactgggaatacagcaatacaatatgatatggactcatttcttaaggagctggtaaaggaatgttgctgagcttt

SEQ ID NO: 240898 - DNA, 791 bp, Homo sapiens
accaaggtacagaataactaagtggggtatgcagggtctggccagaaatacaatcttttgattgctagcccagctgctttccttgttatcactttgtggagcaggctggacattgacaatgagttctgagactgagtggaatgggagacccctcccagctggtggtcgagctgcctagagcatggtccatctgtttgggactagggttgagctccaagatggaccaatcaaccccaccaagaaagaaaccccttctatcaccgcggagtgtaccatagctcctgtcagccgctctggaagtttttgccaccagaagagagatgcagagcatcttttcttaccacagctgaactgagaacatatgtttcatccatatatggcaccttacttattaagcttgtgtccttgtcctttctaatactctggcaccttgcccatcagatggctgcccctttttataagataagtgcctgtatggctggctgttctgattttaagtcatgagctttgacttttatcagaaatttacagcttggttttcaaaggacttagttgagtgcaactgcatgaaatggtagtgttaaattttatactgtagaaatgttgaaatggaactctataaaatgtgcgttttcagtgtcttttttgaatggttttatttgtgtgttttatcagtcttagacatttttattactcaagtaatctgttcattgtagaatgattagaaaatacagataagcaaagagagagaggaaaagaaaagaaaaaaatataggtctactgtaaataat

SEQ ID NO: 240899 - DNA, 504 bp, Homo sapiens
tgccagagaattcaggcccttcagagccagctgagatgtgctgaatgctaagtgattcctcatctgattccttgctccagaatacagggacttgaagacagactacatttttcctgagcgagacaatttggtctcaagggaaaccaaactgtagcacagaatgtgagagagagcaacaataggatggaatgcataaaatccttccccagagcaagcttctcccacttcttgaaaggctttatttttatatagcctctggaagccagacaaagtatcacttagaaagcgagcctcacagggcggctctggagagatctgaaggctgcgttcataagttcagaaagaacaaagtttatgctttaggccgctagaccgtaagctctttgagttcagtttttatcttcattgtatttcaagaactgtgcaagtatctggtacctggaatatgctcaataaatgtttgaataaagattaaaaaccctgaatggattgaaaagatctgaa

SEQ ID NO: 240900 - DNA, 275 bp, Homo sapiens
aactaatcctaaaaatgcttggtttgaatatgaaaacttagggagattttgtcaaaatagtactcaacataatgtcaacaactgataatttatgactttgcaagaaataatatcataacattgtatttgtatcaaattaacagaaagttgtatttaatttaaactatctttaatgtaattttacaccttcttagattatttcttttgaagcatggtcatcaaatgttacgaagaaggtcacatgctgttaagatcagagcaatagcatctagata

SEQ ID NO: 240901 - DNA, 520 bp, Homo sapiens
gagcctcagacttccacataacttttcaattttctcatttgtcaaaatgagaattgcagtcttttctctaattgtgaagccatatgttcagggaggggctttgaaagcaccaatattgtacacatataaggcatagttactgctattactatttattactgcagtttccaatagtatttgacagtgcttcttaagtttttacatgcacatgaatctcctggggatcttgttaaaatgtagattgtgattcggtaggtctgcattggagacaagagtctgcatttcttacaagcttgagaatgataccaatgatcctagtttatttgatgtttattttaaagtagaggttgacatggcagtgtggagtcaggggttttcagggactcactaggaagtaagggagacaggacaaaagtctagggtcttccatttcaggttggattgatgaagccaacagtgaagattaaggggcaagggctgtgccagtgggtcctagccagaattctttcccatccccctg

SEQ ID NO: 240902 - DNA, 424 bp, Homo sapiens
atcaaagattgatcaagtgagatggaacatagcaagttttctgctttaaccactttagttaagatcccaaattattaatttctgtttttttctctgccatctctagctcatcattggcaaagggtaagttaatgctaaacaggtatagacgtgcattttatctaagcatttcaaaatagcacgctaaactttaattttgaaaagtttatacaataaaaatatgtaaaagtagaccaaatattgtaatgaatccacatatactctgtgctctatttttaactcatggccaatctaggtttttttgtttgtttgtttgtttgtttaactgcctctcttcccatataatttgaaacacatccaagacatcacatcattttactcatatgtactttagtaggaatccctaaaagctaaggactcttta

SEQ ID NO: 240903 - DNA, 390 bp, Homo sapiens
ttaaaggaaaatttgtataattctaccatcgtaatttttttttgcttttccatgttctcctttctttatccatatggatatatgttttttaaatatagatataataggctgggcatggtggctcacacctgtagtcccagcactttgggagggaggctgaggcggacggatcacaaggtcaggggattgagaccattctggccaacatggtgaaaccccatctctactaaaaatacaaaaattagctgggtgtggtggcgcatgcctgtaatcccagctaccagggcggctgaggcacaaggaattgctggaacccaggaggcggaatttgcagtgagctgagatcccgccactgcactccagcctggtgacagagtgagactctgtcta

SEQ ID NO: 240904 - DNA, 567 bp, Homo sapiens
gttaaattgcatcaaatgatatttatcattattggtcttctatactgtaacagaattggtaaccaataatgatatatatgttaaattgcatcaaatgatatttatcccagtgtgctgagattattttttttttttactatctttaaatctttttttttcttttgcctcaaaaagtgacatttattcaaagaaaaaaaaatgacaagatgtccatcccttggctcccttccctcccctctcctgctgttcctcggacccctgagattgagccctggctggggttgggtggcaggacagcccctcagatgaggtcggcaacattgaggggcatttcctcaatggaggtgttgtagagggtcttgatgtctcaaagagtccttttgtcttcttctgtcaccatgttaatagccacacctttatggccaaactgtccacctcaaccgattctgtggatataattttccctattggtgggaaggtcatagctgatgactaaagaaacttgctgcatatcaatgcctctgacctacgtcaagaaagacaactcttcagcatgtgcacaacagg

SEQ ID NO: 240905 - DNA, 417 bp, Homo sapiens
gctcttaaaggaaagtgaacgtttggggctactgatgaaagtatgaaaaacggtggccaaactctgctttgagacttgaggcaaaataacttattaagaaaattcttttcaaaatattctatagtttgggctgggtgcagtgggctcactataatcacaacactatgggaggcaggggtgggaggactgcttgagcccaggggttcgagaccagcttgggcaacatggcaaaactccgtctctacaaaaaattaaaaaattagcccaatgtggtggcacatcgactatggtcccagctattcaggaggctaaggtgggaggattgcttaagcccaggttgaggctgcagggagcagctgtgtttgcaccactgtactccatccagcctgagtgccagagcaacactgtctcatttaa

SEQ ID NO: 240906 - DNA, 405 bp, Homo sapiens
ttttcaggagttttggggaaaagcattactcactaataaaatgtgaagaggaaagaccttcctaattttgctctgccctctatctttctgcttcaaattctgtcattggaaaacttgccaagtagagctacagcatccatcttgcaaccctgaagcaccaagatggagaatgaacatcaatgtgttgaggatagtggaaggatgggaaaagcctttctctatgatgtcattgttgagccactgagccaattaaagacatccaaattgtggacatttagttaaatttacaaaagttattatagcctaaaccaggcattggcaaactatggcttgtgggccaaatctggctgtttttttgtttgtttgtttgtttgttaaataaaattttattgcaacacagccatg

SEQ ID NO: 240907 - DNA, 910 bp, Homo sapiens
cgattccattctttatctcagttcaaatgcctcatctctcccaaagaagctaaggaagaaatgttttgtttcacctcgaaagccatttatatcaggctcagggctctctccatgtcctacagcatcattctttcgaccatgagccttgcatactcctgcctggccatataagtggcattcttaaaggttcatttggttcctcaaacgtattccacattaaataatatccacatgttggcttgttgagagaagaaggtaaacagttgggggcatcaacaaaaaatcaggtgaggggagaaaggagagatagtgagtgtggccccttaggcatgctgagttcagttacaacagtcacacttggactgtatcaaagttgcccactcatccaccacagctactcaaagacatttaactcgctagccattatccaaccgcatttaccagacgctcagtcttgagggaggagggtaacgcagtaggggatgcggagtattggtgtcatcctacaggttaaggacaaacatgcccactacaaggacagggatacatcaccaacttcaattcagcccagggttcatgtagtaaggggtgggtgattcactcctgtgggctagaatggagaagagaggaaaagggaggcacacatttcattcactaggacccaagatgacctgccgcctctctcctgcccttctcggagccccccaccctcccttagccccagtggggctggaggcacgaacagacaaggcaaggggagcgcagtccgtcaaggtccacagctgcacacaaagcccttcaccttctccttgccttccaagctcctccctgggcttggtttctccgagggtctctgatgcccccttcggtggtcggcgggacggtcctattccctcttgcatcgctgtct

SEQ ID NO: 240908 - DNA, 460 bp, Homo sapiens
cgattccattctttatctcagttcaaatgcctcatctctcccaaagaagctaaggaagaaatgttttgtttcacctcgaaagccatttatatcaggctcagggctctctccatgtcctacagcatcattctttcgaccatgagccttgcatactcctgcctggccatataagtggcattcttaaaggttcatttggttcctcaaacgtattccacattaaataatatccacatgttggcttgttgagagaagaaggtaaacagttgggggcatcaacaaaaaatcaggtgaggggagaaaggagagatagtgagtgtgtgtgtgtgtgtgtgtgtgtgtgtgtgtgtgtgttggaagtgggggttgttgtaaagggaaagttgatgtcaaaagttcagccatgcccaagagagaataagatggcctcctattgaacgagatcataaatatgaagtcaggc

SEQ ID NO: 240909 - DNA, 524 bp, Homo sapiens
gatgttggcaccaatgtttgttaccattctgaaaatcctagagtccttaagaattattctaaatctattcagtctgtgctctgcaaatggaataacaaagcccagataacagcacatctgtttacagcatgggcttactgaatattttaagcccattgttgagatatatctcagaaaaaagatttatttcaaaatattattgctcattgacaatgcacccagtcacccaagagctctaattgagatgtacaagaagattaatgttattttcatatctactaacatagcactcattctgcaacccttggataaaggaatactttgaactttcacgtcttgattatttaagaaatacatatcataaggctgtgactgccatagatggatctgagcaaagtacattgaaaaccttctggaaagaattcaccattctaaatgccattcatagaaagaggtcaaaatatctacactggctgggcatggtggctcatgcctgtaatcccagcacattgggaggccgaggc

SEQ ID NO: 240910 - DNA, 424 bp, Homo sapiens
agacggggtttcaccctgttagccaggatggtctcgatctcctggcctcttgatccgcccgcctcggcctcccaaagtgctgggattacaggcgtgagcctccgcgcccggcctactgcggctcttctatcctggtgttctttgaatgcctatcttccttttgtgccacagaacctctcacgcccgccacaggttgctcatttccttggttgttctgaactttaaataagttaatgtatgtaagagtgccataaatgctcagtaattgacatctgttattttcatcagtaacatcatctgaatcatctgtattgtctatttttaacaactgcatttttcattgtccaaataaagtcacatacatttgaacattatataatgattgaataataaaattattctgctattttacaataaaaattaa

SEQ ID NO: 240911 - DNA, 533 bp, Homo sapiens
cctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggg

SEQ ID NO: 240912 - DNA, 991 bp, Homo sapiens
cctgtgaagtagacactttcatttttacagacaaggattatgaggcttagagaaatgaggtagtttcccgcaacatcacactgctggacagagatgtacacacagctcctgggactcaagtaggtgggttttcccagggacacatggcttcatgtgttcttctgggaatggcaggtgacgcttggcagacgagacaacaaagcaaggctcatgtaagaaagctgggatgtgctcccctatagtccagaataatagacctgggtcctcacctcaggaaacgggcctccacttcctcactgccaaaggccacactggcacctcccaagggagctggggagctggtgaaggatgagtgcgaggaactcagccaccaccagagccacagggagagcacacctgggtccactgtgcttattgctgagctggctgtcatgtccaggctgtcccctgccccgagtcctgtgtatacatctgtgggtgtgcacatgtttgcatgaaggaattcaggccttattaaatattctcagaggggggcatttggctctaaatgtatcatcaatttatcatggaatcttgggggctgctgacacccctggactctccaggcactgaaccatgaggccctcctggaagcacagcttcttctatcatctacttttaaacaggaatttcctaatttattctgtgcatgggtttgcagtttcttgtgctgtgtgtgtgctgtccaagtggtaccataataaaagagaaatgactcccgagaggagtcttttcagaaactgtaatctggggctggccaggaggggcccggagaaggctgacccacccaaagaaggggaaccagagaagccatcagagctgctgccgggctaccctgggtcccagtgtaccttctaccaaagttccatttgaacagattcttctgtgttctccctaagaagcctcttatcccagaaacactccctcaatggacataggaaaccctggagac

SEQ ID NO: 240913 - DNA, 444 bp, Homo sapiens
atgaattcaatgacgtatggaaggataatactgaattcactgtcttctacttcttgccactaaacaacatatcagcttgcttttctactgaaattgcataaaacagataggacagctaatttaaacagttgtttgcacattcaatatttataacccaaatcttgcatgactgactgcaagcagtgagttagaaggtttagctcagctgctgcctagagtgatggatggccttgaagaatttatagatcactgaccagatcaatcacataacaaaatgggaaaaaaagatcgaccttaaactagatttccaacatttccatctgtatgcaaaactgttgcaggaagaaatgtatcataaaacataatgtgaagctacttaaaaataataaaaatccaccagaaatgatgtagaatgcaaataaaaaagataaggtggctggataa

SEQ ID NO: 240914 - DNA, 427 bp, Homo sapiens
aaagaaagaaagaaattagaagcagatggggcagttcagcctcttctcgcggagcggggctagacggagtcaggggcggaccgccacagcctgcaccaatcaggacccggttgataggcagagcctggcgacttcgaagactcgcccccagtcaaagagccccggggattcgtttccgtacgcagcctggaaaccagcctgggcctatcctgcgcgccgctgcgggctactattggctgccaagaaaccccgcccatcttcctgctcattggccggtgcggtttacgtaagaggagcctgttgctgagcgaaaagtctgttctgcaattttcgctaaggagttgttaacgctgaaaccgcactgggcgtcctggggtcaaaaaaacaatactagccacagtttattaaactgcaactaaatgccagg

SEQ ID NO: 240915 - DNA, 639 bp, Homo sapiens
ggcgtgagccactgcacacagcccgtttgtcttaggatataaatccacctgcccaggaaggtctaggatacataattctatttgaatcaagccaaaaatcttaaggggagtattgtccacttaaagacactcagtgaatgtgaattgtatgactactgattctgcttataatacctgttcaaatatacatgtaactatcttaaaatcttaacaactgtaccagaattttagaaaaataacttcacatttataagctggagcctgtcagagttcactttgaccaatgtgtcctataggatctattactcttatatttaatgttttgacaaatgtactataataatatcaaaactcacatagcaaataagaataattttttagtatgtgtaatattttccccaaaggggaaaagcccagatagaatgaaaaaagttcagtgacttttaagtgcaaataataaaatataatccataaaatggaaattgagtttcataaaaggaccaacacaatagtgagaactttaacaggaattttaggaagaatttagaccctcaagataaatttaaaatcatacggttttctgacgttctaagcaaatagagctgtgcttattctatatttgcccagcccaacatattc

SEQ ID NO: 240916 - DNA, 511 bp, Homo sapiens
agtttcatagacccatcctgtaagggctcattgcaatgctcaccttttttctgggttgtgggctcaacaaataatgtgtaatttagagttctctcgaattccacttttgctcagtttttctttgtcagcacttattgtcagaagagtttaagtgctgtacctgcctgtcatgcaaggaattaagttttgacctactcgtcaagtgtgcagtgtgcaagtgaccgcaggagtactaaaagccaaccattgacaagggaggccaaattttcaaggaatggaaagagcacaggccttccagtgaactcctggctttaaattctgttccatttagtcactagctccatagccttatgtaacctctcttcagttttcttttctttaaagaaagggataatctcacctttttgtgaagaataaatgagatgagattatccctttctttaaagaaagggataatttcccctttttgtgaagaataaatgagatgatgagtaaattgcctcacttggca

SEQ ID NO: 240917 - DNA, 395 bp, Homo sapiens
caccgccaggctccagccccgggctgggtcaaggaattcgagggatgcaggctgaacgcaccggttgaaactctgggcgccgcatcggcactttgcgccttggtgggctttgcgctcggaagacgcgtccacgcaccattttcccaggcgttgtgcgggtttcttaaacctctcagctggtgcctcggaagagtttctggaagctccatctctactgcctcccctcccccccttttgattttacccccgccaggagcttctccagccccacagcgtccgccctgtgaggggtacaggtgccgctgtcccgccggctgccgccccgtccgcccacgcagcgcctcctccgggctagcctgggggattgacccagcgccgctgcttctcgaatggtc

SEQ ID NO: 240918 - DNA, 399 bp, Homo sapiens
cctttaaagggtattgaatttttttcttgtaggcagttagattagtaaggaatactcttgatcctgtcagactttgttttatgctttgttaggatgggtttattttgcttttgtccttagtcctagagcatggtccttactctaggacatgacccttatttccaaagcatggcctttttagggttgtaagtggttgaccaaggtaagcaatgaagtattcccactatagttggattggaactccaatgtctccaaaactatgcaacctttattatcttcttcattaacagcagctactctctgttagaccttacagagcctcactctacacatgtgcagcccaggccttgccaagacccaagggaaacccccacacagactcttggagcatccctccac

SEQ ID NO: 240919 - DNA, 505 bp, Homo sapiens
aaaaataatctctgccttcaggagcctcaagtctaatgagggagatgacatccactttataaagcctagagatatgagtgcagtaatctctcaaagtggcagaagtgcatgggggactccgagttgggtggaacttgagctggcctcacagggcagggtaggatttgggttggtggagggcagagagaacggctgtgtggagcaggggtgtgttgtaggagaggcactctttggagctctttgtatggagatcattgagggtaggggctgtttgtgttcatttttgtattccctgaactcatagagcctggcactttgggagtattctataattgactgttgaatggaatgatcgtttcgtaacctgttaactgggcctgatgtgttagaaaatatgtaaaagtgcagcctgtgtattagaaaatgtgtgaaagtacagcctatgagcagaaagaaaatcttactgaaaagcgatcccacgtacacatggagcctggtgcggccg

SEQ ID NO: 240920 - DNA, 350 bp, Homo sapiens
cctaattcatggattcactgaattccatttttaatatctcatgaaaatttaactttccaaagtcccatgaattatattattttaaatggaaccagcttttaaagattagaagctatttcaagtgttaatttttgaaacatctttatagtttaggatgtaacaatgctgtttaaatccattaaaccaccgaagagctatttcttccaaattaataagaaaatttttgtagatcatgcctggaagaaataattttttttcttcatagttttgtactcaccaggctggagttgcagtgagccgagattgcgccattgcactccagtctgggtgacagggcaagactccatctc

SEQ ID NO: 240921 - DNA, 626 bp, Homo sapiens
ataacttacaaatgtagttaatacgacagacagaccacagtttggaaaatgagtaaaaaacaatattttgaagcagtaatataaataaatgtgtaaagtattgatctgagaaatctgaaatatgcattaaaaaggttttgaaatcttcttaccatcaacattcctacatcttttgaaataacagttcttctgtctctctgccataaataatttacttagttctttctcctaaatttctaaattctaataacaaaattcttaattatatctaaaagcaaaactatctctttgcattactgaaatgtcatggccaatggtcagttgggaataaaagaattaacagctggtctgtaacttgttttcttctctgaagcacctgggaataaatagtctaatcaaattgccctcaaaacatactagttgaatctcttgatagcatttattagaagaatgttttattatttatggaattttttagcaagatatacctggtctgtctaggttacttatgacaaacacacctgaaatttatggatgtttgtggtatgatactctggaaaaatgtttcagttagagatggaattatcagagaaataaatattggtatttcatggttgtgctgatta

SEQ ID NO: 240922 - DNA, 451 bp, Homo sapiens
gtagcaggaaagaaaaataaatgagtagagcccttatcaagtgggttttgcagaggatccattctttgcaacttataataggaaaatcttatattggaagaaatgcatttatactacaaagcttgaaaaagtagttaaatgtatcttctcaaaaaattttgttcactgaattaggtctgaaacaaaatggttgcatataggtaaagagtgcaacaggcccatccatgtcttctcaacatctggggggtttgtttttattattttatttagaatttaaaagaaaaaaaattgatttttttttcaatttttagtccaaaatctctaatggttttaataataaggctattttaaacattcttaataaatctgtctattaataaatctgtctaaaatgctcatctatgttattttattatccagaaacaacataaataaagccactagaaaagtc

SEQ ID NO: 240923 - DNA, 358 bp, Homo sapiens
gcaaggctgaatttttgtgaaaaaaaatttttccctttcaaggttactttgcatgttcatttaaccttgctgtggggagtaagaaagtttggacacagaaataaatttgttcccaagtctatagcatcctgagtgcagccccagttatccttccccgagccctttgcattttaatattaaatctaggacccaatgaagtgaataaataatggttgaatttctcatgataggaatcagttaagaactcaaataggagaacagaggcaaggtgttttcaaatcataccacgctgtgatccaccttttgtattcagtaaaactaaccctatttgggaatgtagtatcaaaaaatcagtaag

SEQ ID NO: 240924 - DNA, 964 bp, Homo sapiens
agcacccttcaagaactagaatgcctgggaaacatggctgtcccagttaagttgaggttttatctgaaacccattttgttttcaaacatgttggaaatgttcctaaaaatgcctgagtgtgctttgggggtgtgcttggtgagtatgctttcctacccttgagtgtttgagacttgttttcattatgttaggggcttatgataaagtcttcattttcagatctttatgtagaagatatatataattgagcagattttgaagtttcgctcaaatcttgtttgtatttaagaatactttttcttattcattattctgattaatttttcttttaaaactggcaacattttgcaggtagtttatggttttgcaaattagaatatgggtcattcctctaaatagaaacagtgtttttggtcttgatgggtctgtgaattaggtgaaactagttttatctttctccttctacttctaggggaaagtctttacctttccccccctgcacactcctcccaccccacccttccaagcttgatctcagcaaattcattgacttccaaaattcatttatatgactttaatcttaagtcatctttatgaaaatggcttatctttaacttactacctgtttcaggaatagttgcaggcagagcttttttcttatttttcttggtatgaaaggctttgtatcctgctaaaggaatttcaggatttatagttataagtagctatatttttagtcatgagctttgctatggtttgaaagtgtccgccaaatttcatgtgttggaaacttaatccccaaatccatatgttggttgcatttggaggtggggcctgtgggatgtaataagggttaaataaggtcatcaggggggttcccattgatgttacaggtggctttataagaagagagacctgagctagcatgctcttgctctctcaccgtatgatgctctctactatg

SEQ ID NO: 240925 - DNA, 660 bp, Homo sapiens
tattacagttttagacagaggttctgtccctcatcaaaaaacactggtcaaatcctacactaagtcctattttaaagaggaaaaaaaaaagtgtatgccaagctaatgaaattccagtatggtctttttttttttttttaagagatgggtctctttatattgcccagtctggtctggaattcctaactcaagtggtcctcctacctcagcctcctgagtagctgggattacagacttgagctaccacttccacctatttatgtgtctgcaattctgtgacttgcattgtgccaatttcaatttcctggttttgataatgcagtatagctaagtaagatgtcaccactggggaaagctgggtggtgggtacccaggacctctctattatctttcaacttcttgtaagtaagtccacaattatttaaaaataaagtttaaaaaaacactcatgacatttatcattttgcagagctctaccaatatccaacagctccctgttcctcctagatcctaatattttgatattggcccttaaaacttgcagatacaggccaggcatagtgggcatgcctgtaatctcagcactttgggaggccgaggcaggaggaatgcttgagcccaggagtttgagaccaacctgggcgagagagtgagaccccc

SEQ ID NO: 240926 - DNA, 511 bp, Homo sapiens
gtatcccaggtagctgggattacaggcgcatgccgccacgcccggctaattttttgtgctttagtggagacaggagtttcactgtgttagccaggatggtctcaacctcctgagctcaggcaatccgccctcctcggcctcccaaagtgctgggattacaggcgtgagccaccgcgcccggcccaaaagaacttactttttgagggagctgttgttcaaagaagggagcacatgcaagctatcctagaacatatgacaagaaactcaatgactttatagaatagacaaactaacaaagaaagctgaattctgaagcagggaaaggaaataatttaaacagtctattagattggaataatagaaaaattttaaaatgcaatctaaagatctttgtttttcttcttatgtttgctttacttttctgtacgtggaactaaatttcactgacaacaaaaatagttgtgactattgtaaatgacagtcattatattaaataatatataaaaatgtc

SEQ ID NO: 240927 - DNA, 419 bp, Homo sapiens
ttcccatattcttcctctgagattttcttaatgaatatattgatctagttgatggtatccaatcacttttacattccatgttttaattttgttttggaagtttatatttttatgttatatattttagggtatgctaccacacatccattaattgtgttttgattttttagtatatattataattgtgcatgccaatattttaactttatataatttaagacattgtggagcaaaatcatatatgaattagccatatgtctttttctgatagaattatctgtatgtttgtttgcctgtataaatgttatccttgtatttttttaataacgtgtatatttgttgtgtaagtttgttgtgaatggttttctaatcctgtgtagatgtgaagtcataaaattattgtaatttcaacatcctat

SEQ ID NO: 240928 - DNA, 209 bp, Homo sapiens
caggagataaatacgcagtttataaaagttttttctaaatgctcttaaaaaaagataaaaacccagagaatattaattagttcagtaataatagaccggtaattctgtttgtttcaaggagtattaggggaacagatttgaattaaccaagcgtttactatgaacagctgtgaagaactgcagtactggcaaaacttttaaaaaggagg

SEQ ID NO: 240929 - DNA, 426 bp, Homo sapiens
agtaataattacgtacttcactttaaaaagttgatgcatgatgttagctctttaggtattcgctaaaagaagagtaaaaatatatttaacatactaaatagcatatggggagatatcaatagcaaatgtatatatattcttagagatgggatcttgcactgttgcccaggctggagttcattggtgctgtcacagctcacggcaacctccaactcctgggctcaagcaatcctcccgcctgtctctacaaaaagtacaaaaattagctggttgtggtgacatgtccctttgtcccagctactcaggtggctgaggcaggaggaccacttgagctcagaaggtggaggctgcagtgaaccaggattgtgccactgcactccagcctgggcaacagagaccctgtcttgcaaaaaataaaataaaatt

SEQ ID NO: 240930 - DNA, 414 bp, Homo sapiens
tgcaaacttcgcctcccgagttcgagcgattctcctgcctcagcctcccgagcaactgggactacaggctaccgccaccacccccagctaattcttgtatttttagtagagacggggtttcaccatattggccaggctggttttgagctcctgacctcgtgatccacccgccttggcctcccaaagtgctggggttacaggcgtgagccaccacgcccggctgctttttttttttttcttttttattaagagcatacctctcctgtgagaatatgttcatgttcattttctacatggctctgctctttatgaaagttttctatcatttgacatacaccgacatgggcattctatcattccacatgcactcacatgcagaccacagatttggtggtcacagtactgcctaggctg

SEQ ID NO: 240931 - DNA, 3882 bp, Homo sapiens
  misc_feature (487)..(487): n is a, c, g, or t
  misc_feature (506)..(506): n is a, c, g, or t
  misc_feature (972)..(972): n is a, c, g, or t
  misc_feature (1428)..(1428): n is a, c, g, or t
  misc_feature (1437)..(1437): n is a, c, g, or t
  misc_feature (1545)..(1545): n is a, c, g, or t
  misc_feature (1632)..(1632): n is a, c, g, or t
  misc_feature (1654)..(1654): n is a, c, g, or t
  misc_feature (1699)..(1699): n is a, c, g, or t
  misc_feature (1949)..(1949): n is a, c, g, or t
  misc_feature (1963)..(1963): n is a, c, g, or t
  misc_feature (3404)..(3404): n is a, c, g, or t
  misc_feature (3407)..(3407): n is a, c, g, or t
  misc_feature (3622)..(3622): n is a, c, g, or t
  misc_feature (3650)..(3650): n is a, c, g, or t
ttgatggtgacatgtggaaggaaatagacctgtggctaagttggggaataactaagaccgtggtccaaagtcagagaaggcctcctggaagagtaacatttgagcaaatgcctgaataaagctagacgttcattgaccagcagagtcttttataactaccccagttccgtggaaaacttgggctggtctaagtactgtccaggcacagtacacagggggcttttgatcttctgaactaccagccccttcagtgtgttcagaaccctaccctctatctctagggcttatgagtatcctggaatgatgaaaggagaggttgttccgatgggaaggtcacactgggagctggcaaatctcagggcctctgcaggctgaacatccaataggtagcatgctgattatgatggacaagagaccctggccagatgctaccaggaaagacagcaagtgtgatccccagaactttctggagcagaagctgggcaanctaatgctgctcagatccnacctagttcctgaaaaattcaccttcaggtggaggttgatccagcctcttgtgtctgtccacctgtttaggtcagatcctttcccctggttcctttatctattttccctctcaaattctatctatctttccccctcccttccagcctagatatcctttttctggctcagggactgatacccacccttattcattataaataccaaatgtattttctgtgacctgagatcctcattaaagggcatagaattttgaatttcaaaagctggagggagattctattttcctttgttttctgatgtctcaacttttccctgaaacaaggagtacaaaagaaacaaacacatatttggaatggaggtagagagtgacaaaatgggctggggggtggggggtgactggtacaatgcaaagaataacagtagccaggctgtggcacaagctattctggaggccaggattggtgncacacacctgtagtcccagctagtctagaggctgtggcaggcagatcgctagaggccagatgttcagggctgcagtgagctatgattgcatcactgctccagcctgggcaacagagcaagaccctatctaaaaaaaaattaaaaagtgcttagcagtgagtgtttaactaaaggaagtccataatatgggaggatcccttgagcccaggagttgcaggctgctgtgagctatgatcacaacgcagcactccagcctaggtgacaaagtgagaccctatctcaaaaaagcaaacaaaacccagtaaatattaaaatatcccaagaaaaattgcttaatgttttcaaattattacctcactacaaatatcgagtgagcatctactgggtacagagttagggactgggaaaaccacaggaatctagacgggccccatcctcaggaggctagtgaaaagnaaagcgggnacatgggatgagcagggagagcctccaactgccacggagatgaagagcagcacctcggtccacacagcagggagctttggagcagagatcaccaggaaaaactacccnggcccatacctcggtcaagtgcagtcatcagccaggaaagaacctggctttagccagaagccaaggtgactctggaaggctctgcanctagatctgtgggctcctgcantgctcacagctgggcagagggttctttcttgaaaggagatctggnatggggcagggctgtgactctttcacaccctaaggagggcaatgaaatgggctgaagaggtgagcagaggactcaataacccggctcttagggctgtctgagagagcgtccatgaccaggaaaatcgacagagagacctgaaggtgcagggagagtcagaggagggtgtagagtaggggtaagtgtgtgaaagttgaagccaggccgccctgggatgtgggtttaacccacactctgccacccaccaccngagaggtgagaacnggttgtatcatctatttgtgcttcagcttcctctttaatagaactaggatgatgagagtactaatcctacagctttattggaaagattgcagaaacagtactaatcctatagctacattggaagaataagagaaatagtactaaccctatagctttattggaaggattgcagaaatagcactaaccctaccactttactggaaggattacagaagttaatgttctagaaagcacttagaaaatgcctggacaagaaacagcattcataagtgttaaattcccaggttaaaaaaaaaaatgaaaaacagtacttctaggcagagagcacagcctaagtaataacccggaggatgggaacagaacaggaaagaaggtaacccacatcggtggtacaaatccagccaaatgcccaggtaatctaattcaactcaagtaatatttaatttatttttcaggcacctattttaaggaaaatacattctttggtcttgtctaacagcccaccaagatgtactctgtcattttctccaaaatccattcagatcttgcccagattgactcaaagctgaaaaacaatgaatgttggtgccctttccacagtcccacatccctttctggttaaagctgctatttagttcaaaacgacagatgttgacacaaattcttgctgccacccacaagaaaaattgagtgaactcctgaaagcccctcctccttgtctcagactcagatcttctctctcctctctcctctctctcctctctctctttctctctccgttccctcctggtgcctccagggtggagaccggtcagcccctcccaggccagccggtcatccatcagcctcgagctgccctgccctgcacgttgcggactccaccagctccttcctgcccctctcgccagcccatatggaatgagttgctccatttttactccttatcagaaatggaaatatttcccctgcatctttgtgaagattttctgcatctgtgagctggatggatacttaacccttctcattccaaggtgctgctgggccttggaatcccaatgtggaatccctggatgcggaatcctcagatcacagaagtggggggttcagcacttgggaggaatccagttacaccactccatgactttagaaacaggtccttgaggtagctccttctccattttattaatcttgaacttgcacctctaggatagaaatgacagcaaccagcacattttgggtgcttgctataggcacatttaattcttccagcaaccacggagatagatgttggtatcatcatccccattttacagatgaagctcagagaggttaagtaactcgcccaagtcacacagccagtaagtgacaaagctgagctatctaagccacagctggagtctttccattcactgtaagactgtagagagacataaatgatagngcnctgtgacctaggacagtctttccatcctaacctaccaaattttacagatactgtgagatgggaggaagcagtgagccagcaactttcccaagggtatgcagctagtaaatgagaaagccgatgtggatgcaggcccaggagctctgcagcacacccgtttattctcattttcttctttaagaaatgcaaggtaggctgggcatggtgactcatgnccataatcctagcactttgggagactgnggtgggtggatcgcttgagcccaggagtttgagactagcttaagcaacatagtgaaactctgtctctgcagaaaatttaaaaattagccaggtgtagtggagtgcacctgtagtcccaggtactcaggaggctgaggcaggagaatcacctgagcccaggaagtagaggtttcagtgagccatgatcgtgccaatgcactgcagcctgggtgacagagctagaccctgtctc

SEQ ID NO: 240932 - DNA, 452 bp, Homo sapiens
gagatgcctagaattgggtagaatagggtcactattttattaaagtcagatattccatgagaaaatggggcaccctaggcctcaaaaatcagtttgtatattagttctttggctgtaagcaacagatgtcaactgtggttaatttaaaacataaaaacagggtccaagagcagtggctcatgcctgtaattccagcacttggggaggccaaagcaggcagatcacttgaggccgggagttcgagaccagcctggccaacatggtgaaaccccatctctactaaaaatacaaaaattacctgggtgtggtggcatttgcctgtagtcccagctacttgggaggctgaggtacgagaatcgcttgagcccagggaggcagaggttgcagtgagccaagaccatgccactacacttcagcctgggtgagagagcaacaccttgtctcaagaaata

SEQ ID NO: 240933 - DNA, 430 bp, Homo sapiens
cagtgagaaaagtggcccctgtcatctatttacttatgtgttcaattgcaacacatgtatggcagtttcagacttgttaccctgcacccccatgataaattcatctttaccaagtacggtgcagtgtttatggacattgtatttttacatcagtcttgcagtttccagtcaaaatattctttcccaaagttacttaggtcagccctttgttctctcactcccttcagtgaagttttctcatacatttataagacaattgagattctttcatcatcacagtctgcattctaccctgggataccttaactttttgggcgattctaaaagtttaatttctgtacattaaagtttaccttgtgggtttttttttggggggtgggggatggagtttcactcttgtcacccaggctggagtgcagtggcatgatct

SEQ ID NO: 240934 - DNA, 328 bp, Homo sapiens
tagattttattttttaaatttttgttaagaatttttgcatctctcgttatggaggatattgccttttagttttctatccctgaagtatctttagttttggcatcagtgttatcttcatcacaaagaagttgtgattgtgatgtactctttactccaatgaatttgcagttttctttgagataaagttttttattaaaaatttaatttatcagcatgatgtgatggctcatgcctgtaagcccaatgctttgggaggccaaggcaggaggatcacttgaggccagaagcttgagaccagcttgggcaacataacaagaccctctctaca

SEQ ID NO: 240935 - DNA, 401 bp, Homo sapiens
tggtagtttcataaggggcttttccccttttgctccttctcctttctgctatcacatttgcttgcccttcagccatgaagttttctgaggcctccccagccctgcagaactgtgagtcaattaaaactctttcctttatgaattatccagtctcgggcagttctttatagcagcaagggaatagactaatacatttggttttctcatacttttgtgtgaaaaataaggaacgggtgcatttaataactggaaagggactgtggagagtgctagtttgtgtagggagctcaggaattctgaaacttctgggtggccctatcattcatccttgcatctagtgagcactgaaagcgcatatactgtttgcaaaaagatctgctagacctccaggaataattaaa

SEQ ID NO: 240936 - DNA, 1637 bp, Homo sapiens
  misc_feature (1050)..(1050): n is a, c, g, or t
  misc_feature (1078)..(1078): n is a, c, g, or t
  misc_feature (1091)..(1091): n is a, c, g, or t
  misc_feature (1304)..(1304): n is a, c, g, or t
  misc_feature (1376)..(1376): n is a, c, g, or t
  misc_feature (1526)..(1526): n is a, c, g, or t
ggttatgaagaataacatagaatatcatacatttgagatttttgtacttgcttaaaggaaaccaacaggaagactttttttttttccaaaattgacttacactgaaaagtttatctttgcctccataccccctaaaaatcaaatgatgtatatttttccatgaaatgccttttggtgtggtttatgtgcatgactgattcttagaaagccaataagataggggtggagccaagatggccgaataggaacagctccagtctaaagctcccagcgtgagcgacgcagaagacgaaagatttctgcatttccagctgaggtaccgggttcatctcactgcggattgtcagacagtgggtgcagtgcaccaagtgtgagccgaagcagggcgaggcatcacctcacccaggaagcgcaaggggtcagggaattccctttcctagccaaggaaaggggtgacagatggcacctggaaagtcaggtcactcccaacctaatactgtgcttttccaacggtcttagcaaacggcacaccaggagattgtatcctgcacctggcttggagggtcctatgcccatggagcctagctcattgctagcacagcagtctgagatcaaactgcaaggcagcaggaggctgggggaggggcgcccgccattgcccaggcttgagtaggtaaacaaagtggccgggaagctcgaactgggtggagtccaccgcagctcaaggagggctgcctgcctctgtagactccacctctgcgggcagggcatagccaaacaaaaggcagcagaaatgtcctctgcggacttaaatgtccctgtctgacagctttgaagagagtagtggttctcccagcacggagtttgagatctgagaacagacagactgcctcctcaagtgggtccctgacccccgagtagcctaactgggaggcacccccagtaggggcacaatgacacctcacacggctgggtacccctctgagacaaagcttccagaggaaggatcaggcagcaacatttgctgttcagcaatattggctgttctanagcctctgctgctgatacccaggcaaanagggtctggagcngacctccagcaaactctaacagacctgcagctgagggtctttactgttagaaggaaaactaacaaacagaagggacatccacaccaaaaccccatctgtacatcaccatcatcaaagaccaaaggtagataaaatcacaaagatggggaaaaaacagagcagaaaagctgaaaattctaaaaatcagagcgcctcttcccttccaaaggaacncagctccttaccagcaacagaacaaagctggacagagaatgactttgacgagttgagagaagtaggcttcanacaatcaaacttctccgagctaaaggaggaagtctgaacccatcgcaaagaagctaaaaaccttgaaaaaagattagatgaatggctaactaaaataaccagtgtagagaagtccttaaatgacctcatggagctgaaaaccagggcatnagaactacgtgatgaatgcacaagcttcagtagccaattcaatcaactggaagaaaggatatcagtgattgaagatcaaaagaatgaaatgaagcgagaagagaagtttag

SEQ ID NO: 240937 - DNA, 202 bp, Homo sapiens
gaggttagaagcaagatggactcaactatgtcagatttcccttactgtcatcattttgcaaaggtggttacaaaaatcccacttaaacgtctctgcatgtcactgaacacattaaatatagaatccacaggacattttctcattcgttcccccttccttccagtgtcatcccccccacccccatacataggagaagagcagc

SEQ ID NO: 240938 - DNA, 282 bp, Homo sapiens
caagggagatctagggagttctataacagggtatcaagaccatcatttcagggaagtattgctgatggctcctctctcctgcacaggcttgctgtgactgagctcctaactaccacattctctgttgtgtgccctatgtcaaactccacattgtgatgtaattatccaatcccacatttcctccaggagtaagccactgctgtctatgccatttttctcaagatgactgctacccatagaactgaatccagagatttggtaccctctctccactgtcgaata

SEQ ID NO: 240939 - DNA, 446 bp, Homo sapiens
tgcagagatggaagtataaaggaagaagggaagttcccacagttatagtgtggaaaagagtgagtgatacttgggagttgactactgcctgtggttggggaagatggctacaataaaaaggcaacttcaattttaaaacaggcacaggacttgaaaagacatttctccagctgggcgtggtggctcatgtctataatcccagcactttgggaggctgaggcaggcggatcatgaggtcaggagaccagcttggccaacatggtgaaaccctgtctctactaacaatgcaaaaataattagccaggcatggtggtgcgcttctgtagtcccaggtactcgggaggctgagtcaggagaatctcttaaacccaggaggcggaggttacagtgagccgagattgtgccactgcactccagcttgggcaacagagtgagactctgtctca

SEQ ID NO: 240940 - DNA, 391 bp, Homo sapiens
ctcaggtacatttggggaaacctctatagtaaatgtatatgtgcatacttgggatatttttctagtatgtaaattgaattcaaataattgtttatgtatgtgtaaagaagagacagaactgaaagcattcctgtagattttagagaacattgaactccaccttcattttatagttaaggaaacggagatcatctgatttgctgtaagtctcacagttactcactggatggaatcacagagtgtggtgtgagcggatagaggcctcagttacctgacaaagtttattctgccaaggttgaggatgcacccgtgacccagcatcaggagatcctggcaacatgtgcccaaggtggtcagggcacagcttgcttttatacattttagggagaca

SEQ ID NO: 240941 - DNA, 515 bp, Homo sapiens
tcctctgaaatctaagctgaggttcccaaacctcaattcttgactcctgtacacccacaggtccaagaccacgtgtaagccaccaaggcttggggcttgcaccctctgaagcaacagcctgagctctatgttggccccttgagccacagctggaactcactatcaccaaatccctatactacacaaagcagcaaggccctaggcctagcccgtgaaacccttttttcctcctaggcctctgggcctgtgatgggagggactgctgtgaagaactctgacatgccctggagacagtttccccattgtcttggtgattaacatttggcttttcgttactgatgcaaatttatctagctggcttgaatttcttctccaaaaatgggtttttcttttctatcgcatcatcaggctgcaaattttcctaagttttatgttctggttcccttttaaacataagttttaattccaaaccatatatttgtgagtacataaaactgaatgcttttaacagcacc

SEQ ID NO: 240942 - DNA, 445 bp, Homo sapiens
tattcaaaggaaatgtctactggtttcacagcatcttgactcatttaccaatggtcccttctcatgttgaacagtttttttgttttttgtttttccactttggctgatgagtccattttaagagcacttctccatgaagacatgttttctggattagagtgaaatagagattgaatctttttattcccctttaattagaaaattgctcttggcagcttgtttctttcagagctcatttaaacatcttcccatccaagtccacattctcacatgcaattatttcttttattcagctccttaattgctttcattccacacagtaaacctcctaggggaatcctgtagtccttggataatctcaaggacaaaatgggtcagaggccaagaaggtcttttgtctctagctggggaattggtgaagcaagggcagtcgtgagactccaac

SEQ ID NO: 240943 - DNA, 224 bp, Homo sapiens
gctccatgtctgtcatagacagttttccacagctctgagctctgatgctgagataagcttgtgtcatgcacctgccaagggccggtgcctgggtggattttagaggtcacatctgggtcacaaaggatgtccatccaaatggaccaggagggggaagtcaagctgactgctgagggtcagttcctattgtgtcaagtggtaatagtcaggctggagacaagggt

SEQ ID NO: 240944 - DNA, 529 bp, Homo sapiens
gaatgcttattaaaggagatttattaagcatcaaactgtttttcattgtaaattgcagctccttggatctttacatataaggattttgaatccatttattagaaaagaagttaccacaggtaataacctgcattataataagtgtaggaagttagtgcaataaatactgacttaattctgttattaatccagtgaagtaaccctgattgtatttagagcttttaaggaatcttcataaaagataagctgtccatcttttattgtacattttaaattagagaaaattatcaaactgatcttaaatttgcagtgctttatcaaaaaactcatttactctaaaatgcttccaaaagcttataaggcaagacaagtaacaaagtcgtcatttacaaataaggatactgacatttaagaagtgaagtgcttttgatgggtggcaggctactgcaatgcttaagtatttgtttcccactctctacgctctaaaccttcccagatacaattaaagagcaatctaatcaaatataaa

SEQ ID NO: 240945 - DNA, 443 bp, Homo sapiens
caaaagttttcgaaaagtttttcttgtggcttctaaatgcaaaatgaggcagaacttagcttgtcacataggtgtattcttcctggaaccgatgcggggtcagaaaactgatggcttttaagcaagctggacgggtcctctcagcgcattcccccacccgcctggcgccaatggagctggcctggcccgcccagcccctccccgccccgtccgcgctcggaccggactttcaggactgcaggggaaagggtggacacccagcctcccgccaggtcagagcagaggctaaaaatggcccaggggagactgctggagttgcatggagttcgggagcctaggaggggtctgaaaataactgtcaaaaagtttgaagggtgtgtgttggcttggggaaaaaagagggtggagtgcattacataaaacttttgcagcttgtatttcct

SEQ ID NO: 240946 - DNA, 678 bp, Homo sapiens
ctgaaaactttctatgcaccaacactttcatagaattttttttttctcagttgtcaccacagtcggcctcacttcaacaacagcaggcagtgttggctggtgtctctgatgaggaaagtgaagcctagaaataaggaattcacttcaaaggcaccttgtacgaatttcatacttgaaatccagtttggctgaaataaaagcctgtgatttttttcataacaactaagtataatggataaaatttggttaattaaagatttttttaggccaggcgtggtggctcacttctgtaatcccaacactttgggaggccaagtgatctgcccacctcggccctgcaaagtgctgggattacaggcatgagccatcatgcccagtcttcaatcatctctttaaagaccctagttccaaataaagttacattctcatttaccaggggctaggacttcaacatatgaatttgggggaggcacacttcagcccatgacagacacaactggatattagatgatgttatggaattcttggtacttttttcaggtatcataatggcttgtggttctgtaggaagatgtcatggggggatgcatgatgaaatatgttgggatgaggagtgatagagaattgcacattaatttcaaaggttccataccagcagaagtgtttgtgggggtgatg

SEQ ID NO: 240947 - DNA, 501 bp, Homo sapiens
ctgaaaactttctatgcaccaacactttcatagaattttttttttctcagttgtcaccacagtcggcctcacttcaacaacagcaggcagtgttggctggtgtctctgatgaggaaagtgaagcctagaaataaggaattcacttcaaaggcaccttgtacgaatttcatacttgaaatccagtttggctgaaataaaagcctgtgatttttttcataacaactaagtataatggataaaatttggttaattaaagatttttttaggccaggcgtggtggctcacttctgtaatcccaacactttgggaggccaaggcaggcagatcacttgaggtcagaagtttgagatcagcctggccaacatggcaaaaccccgtctctattaaaaatatgaaaattagccagactaaaattgcctgaacccaggaggcggaggttgcagtgagccaagatcgtgccactgcactccagcctgagctacagagtgagactccatctca

SEQ ID NO: 240948 - DNA, 676 bp, Homo sapiens
atgaaagccaagaaatattgatagattataccattgcttactgttcaacaaggccttatgaaagggattttgctatccctgttcaagaatggttttaatttggccattggaaagcctggttctaggatagatttattaggatggtttatttgttctccgaatggaggaattaaaaacaatactgccaataatggtggtaaaactgcagctaaccctactcacagtgggcagggcccaagacccagtctaagcagcactacttgccaccagcctcctctctggctttgtctctatttctccccattacctgctgtcctgggtgtttatatgtttccctcttacaggttacaataataaaaagcggggattgttctcggaggctcagaccagagcccttcaaaggaaacgttaatgcacttttctggaagttaatttgaaccatctatcataagagaaattgttaacatgcatgttaccactgcctacacataatttgatattttttaaggcactcttaaatttccagtgttcatgtgttttgcatagctttggaattatataaggaggggatcataacataattagaaggagtttatagattgtttttttttttattttttgaatatatatcgcgttatgcgctctattccatatcgagaatatgtgcacatgtagt

SEQ ID NO: 240949 - DNA, 396 bp, Homo sapiens
aatttcctttcctaggacacgtcttaaggacgaatgcattttttgacagttttcaggcaaaggggaggcctgaaatatatgtatatgaaatttagtaaggtcaggcacagcagcacacgcctatattggctgggcacagtggctcacaccggtaatcccaacactttgggaggctgaggctggaggatcacctgaggtcaggagtttgagaccagcctggccaacatggcaaaacttcgtctctactaaaaatacaaaaattagctgggcatggtggtgcgcgtctgtaatcccagccattcggggaggctgaggcaagagaatcgcttgaacctgggaggcagaggttgcagtgagctgagattgcaccattgcactccagcctgggcgacaggg

SEQ ID NO: 240950 - DNA, 411 bp, Homo sapiens
agcttattaatattttcagatgctatggattgtcatacttaaaaattaagacaatcaactaaaaaatcaacaaaacactaagaagagaattgcataaggtagcccagtacaagttaaatatacaatatggaaatacttcctatgacatcaattagagaaaacatctgtcgacaatactcagaacactataaaatagctagtaataaacctaacaaaaaaatgtgtaaaatctgcatgaagaaaacgtgatgggaatacttactacaaagatttcagttcttcccaatctaacctataaattcaatacattcctaagcaaaatcctcatgaaattttattaagaaccttggtgagctgattataaagtttattagtaacatgagtgtataagaatagctataagaaaatttt

SEQ ID NO: 240951 - DNA, 229 bp, Homo sapiens
tgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttg

SEQ ID NO: 240952 - DNA, 481 bp, Homo sapiens
gtttgcgggcgttcggggggttgtgggtggatgttttattagctgagaaaaaatcagttaaagaagcgagagagaatgacaacagatatcagacaaaggcgaactcttattcactcttgtagtagattgaaaacccctggagtgcagaatcgatcactaaaagatgttagtgtttttacgccactgcgggtcttgcaagctcttggagggcgggaactagtctcagtctcatttggctcacaactgtactgcggcaggcatggatccgcgatcgaacacacctcagaaataccgcactggctgaatggatgaatgattgcagaaagtaaaattaaaaaaaaaaaaaattgggttgggctcgatggctcatgcctgtaatcccagcactttgggaggccaaggcaggcggatcacttgaggtcaggagttcgagaccagcctggccaacatggtgaaaccctgtctccactaaaaatacaaa

SEQ ID NO: 240953 - DNA, 378 bp, Homo sapiens
cagcagccctggcaggacagcctgtgggttacagaccgccctcctgtcaatgaagtcaagtcctctgcttcctgaaaaccgcctcttttttctaacaatgttctttcccccaaactaggaagacaggctgatggtaaacacaaagttctctgaaccaaagccttatatgtatgtttctgaggaggttctttataacctagttgcaagcaatctgaacacagcccagcgaatttccagcttttgaaactcagatttccttttgcgacccaggttctgctgagaaagttatctttggctcctctctctctcacaccccacatcccatctgttcggaagtcctgttggcatttcgatctatcaaaataaaagttgcacgta

SEQ ID NO: 240954 - DNA, 459 bp, Homo sapiens
ctgaggagtagggactgttaggggacaagggtaggaaaggagggaccatatgggaggttactgtaatagtccaggtaagagagggtggggactagggtggtggacataggagtgtttggaagtggtcagatgggagatgtatttgtaaggctgatccaataggatttagctggcatcatggatgtgggatgtggctcatgcctgtaatcctagcactttgggaggccaaggcagtcggattgcctgaggtcaggagtctgagcagcctgggcaacatggtgaaaccccgtttctactaaaatacgaaaaattagccaggcatggcggtgtgcacctgtaatcccagctactcaggaggctgagagaggagaatcacttgaacccaggaggtgcaggttgcagtgagccgagatctcgccactgcactccagcctgggtgacagagcgagactccatctc

SEQ ID NO: 240955 - DNA, 523 bp, Homo sapiens
agaggaagagagaggagacttcggaaggagtggagtcattctgggaagagggaatgttgagaagggcacagctttgagaagcctgtgcaaggggacaagagataggggtgtgctgacggcagctcctgggtttctggctgtgctgagcagagaaaatatgaaggagacgcaggcttgggagaagatggacacttcagttgttgatgtgttaagtgggaggtgctgtttataccactgaatggacttctcaagggagcaagtaggtaaacagttggccctccgtatccacaggttccatatctatgaattcagccaacctcagatcacacaaataaaaaacaatacaatgaaacaactatttatatagtagcatttacattgtattaagtattgtaggtaatctagagatgatttaaagtatatgggaggatgtatacagcttgtatgcaaataccatcgagggaagagagagaccctctcatattgttttatattgttttatactcagtacctgttctaaaaa

SEQ ID NO: 240956 - DNA, 207 bp, Homo sapiens
ggcttctgaggctaggaatggtgagagatgatgtattgtcaaagctttaaaaatccttcaaatctaggaaagatgctatgcattgctttaggtttaacatccaggtcagctggatgtggatccatcatcacattatgactaggtcaagttctattatggacctactctgaaaagagcccttcttggtaaattatctcagctgagaca

SEQ ID NO: 240957 - DNA, 335 bp, Homo sapiens
caggtagatggggaatggactattggcagagaaccagaagagatcctaggccagatgtggtggctcgtgcctgtaatctctgcactttgggaggccgaagcaggcggatcaccccaggtaaggattttgagaccagcccagccaacatggtgaaaccccatctctactaaaaatgcaaaaattagccaggtgtggtggcatgcacctgtaatcccagctactctggaggctgaggcaggagaatctcttgaacctgggaggcggaggttgcaatgagccgagattgcaccactgcactccagcctgggtgacagagtgagactctgtctcaaaaa

SEQ ID NO: 240958 - DNA, 202 bp, Homo sapiens
attttgggaatagcactattgaatgaattatgaaaatggtcagtgagctagagtgactatttgacctctgagaaaggacttggatggacacatgtatagaaagtactttagtattattagctacttaaaactgatttcaattgacttgaaataagcttacagtttttattcacttattcactcaataaatgtctattatgta

SEQ ID NO: 240959 - DNA, 362 bp, Homo sapiens
tatgtgctgtctctatactcccagcagagtccccatcctttctctctcttacctggacaaaaagtcccactactagattgatttctctaatcctctggatttcaattcagaaagctacccgttaaaatactgtactcctacgtgacttttggaggtcttcagtgattacaatccttttgcattagcatctaaactggaatgtggtacagcaaattcacaatagtgccctgggtttaattttttaaaggaaacacagcaatagtcaatgtgacactaagtgaacacaagatagttaattttcaacttaagatcatggaccgggcacgatggctcacacctgtaatcccagcactgtgggagac

SEQ ID NO: 240960 - DNA, 657 bp, Homo sapiens
gtcccagctaagtatgtacttaggagcctgaggtgagaggattgcttgagcccaggcatttgagctgcagtgagccatgattgcactgctgcactccagcctgggtaacagagtgagactttgcttcaaaaaaaatgcatgtatcggctggtgtggtggcgcacgcttgtaatctcagcactttgggaggccggagtgggaggatcacttgaggtcaggagttgcagaccagcctggccaatgtggtaaaacctcatctctactaaaaatacaaaaattagctgggcgtggtggtgtgcacctggaatcccaggtatttgggtggctgaggcaggagaatcgcttgaacccagaaggaggagattgtagtgagccaagattgcgccactgtattccagcctgggcaacagtgaagactctgtctcaaaaaaagaaaagtgtgcataaattctcctgattggcagagctattgggttttggctatatagtagtatcagtatcactttttcctaaaatatattcaagtagcatccatactttttcctttgttgaaggtgataagtacaagattgtctcaggtaagccttgttgagaaaaaatgggcttccaaagacagatgggacagaggagcgctgtccttttggagatagctgtttt

SEQ ID NO: 240961 - DNA, 381 bp, Homo sapiens
tgcgattaaatatttcatgtgagagaatacattctaagactggaaaagcattttttaacaagtgagggagactgatctatttagatgctgatgacgcccaaaattatagtttcagccagaacctcacccctcacatcagactcacttgtgcaactgaccacagatgtctccactggcgtctaagcgggatctcaaactcaacaggtccacacctgttggctcatttagtaagaggctcatttaataagtggggctggaataagttaatttccacctgggggcgggagacgcttgactcttgccttacagcttatactaaaatatattccataaggactataggttgtctagtaaaaaataaataataaacattgcaacaaa

SEQ ID NO: 240962 - DNA, 376 bp, Homo sapiens
caaacaaaaatagccttagggaaaaaaaggaaaaaaatgaatagggctgggatcctgccgtcaactttctagtttcttaagagttaagtttttggccaggcgcagtggctcacgcctgtaatcctggcactttgggaggccgaggcgggcagatcacttgaggtcaggagttcaagaccagcctgaccaatatggtgaaacctcatctctaccaaaaatacaaaaattagccgggtatggtggtgcacgtctgtagtcccagctactcgggaggctgaggcagaagaatcgcttgaacccaggaggtagaggttgcggtgagccgagatggcgccactgtactccaacctaggtgacagagcgagacttcatctca

SEQ ID NO: 240963 - DNA, 388 bp, Homo sapiens
ttaagcctcatgagggataaaggttcaattttacacaaggaattgtttacagcctaaatcattatgtcaccaatgatctaaatcaagaatgcctttccttttgtacagtttcttcttttgagccatttttggcttttaagaggaagacaagctaaaagtataaggagttcacatgtacttacttagctgaagatattgttagatttaactcctatctgtggaaaacctaatgagttaatatttatacatctcttggtttctgaatatttaggtataatactttgttccatgttccattgttttcttttgacccaaccttcaaacccatgacttctgaagcagaggaagaaatagaatacagtggaaaaaagtcttctttgaagaaaaa

SEQ ID NO: 240964 - DNA, 446 bp, Homo sapiens
tggtcctcagaccacattttgtatgtagcaaggctccagagtccacatcccgcatcattctaactgtatttaacataccctcattggaaatggggggctcctcccaggcctaccacatgtaactggtaggaaaatgttcattacagcctagtggctcttaggggctgctggtgggtcattagtcatgaatgtaggtgtagaaactggattgggacccagctgatgacagtgagcagggagagaaggagggagggagaggaagacagagaaagtgagaacacaagtaagcaagtgctaaaaaaaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttg

SEQ ID NO: 240965 - DNA, 573 bp, Homo sapiens
attttgatggttttgaatgcttttcaaaatagtatttagtatttgccttaaatccagtgaccctcctaaattcaattattacttttaattgtttacatttttcttttggattttttcagtatttcaaataactaactgttaactttatcttctaaagtgtattttttattttctatttaatttctgttcttatccttatttaactttcagtgttcactggctgttctttttctgatttcttcagttcaatacttgcataatttattttgacaatttttttcttctttagtgtttttattcagtgtatcaatttccctctaagcattggtttaaggtttatctaaatccacagattttggcacattgtttttactatgttttactgcaaacgtttcctaatttccattatgatgtattcttttatgtgtgcgtttttttcagaggtgcattctttaatttttagacatgaaatgatattacttagcgactgctgtgttaacaatattatcacaacttagccttaaagaaacatacatttgttatctcaatttttcttggtcaggaatcctaggc

SEQ ID NO: 240966 - DNA, 656 bp, Homo sapiens
ggccagcaggagcatatcactgtgacttacaacccttctctagtctgctacaatggaatcttaaacaagaaaattttatattttgacttgcatcattgagaaaaacactgccaacctgatcgtggttcctttgaagctgtgtcatgcagtctgtgcactgcatagaggctcctgaagggaagaatagatgctgaaatctggcctgcactcaactgaccaagctgtgtatcctggcgaggggctgtgtgaattcagaagaagtggtgcctttgtgtatgttcattgcagcactattcacaatagcaaagacatgtaatcaacctaaatgcccatcagtgataaactggataaagaaaatgtggtacatatacaccatggaatactatgcagccataaaaaggagcaagatcacgtcctttgtagggacatggatggagttggaagccgttatcctcaacaaactaatgcaggaacagaaaaccaaacactgcctgttctcacttataattgggagctgaatgatgagaacacatggacacacagaggggaacaacacacactggggcccattggggactggggggagggagagcatcaggaagaatagctaatggttgcttggcttaaatacctaggtgatgggatgatctgtgcag

SEQ ID NO: 240967 - DNA, 399 bp, Homo sapiens
aaggtctccctgccagatttgagtttactccacggttttggattccggagcaggtcggagagagtcccctgagaccggcacagcaccctctgcgcaaagatcgcctgggggatactgtagcgcttcagctccgctgtgatgcgctgggccacctctttggtgttgatttcttccagctggcccgacgtggccacctgcgagcccgatgaggacgagggtggccgctcgcgactgggtgccagcaccggcccgtgagactgagtgtggcccgggtggtgcaggccgttcaggtgcgacatcatggccgcaggtggggtgcccaggccgcgggacaggtgttgctcaccgcgggtcagcatggcagtgtggtgcgcgtcgaagttggggctgagcattttg

SEQ ID NO: 240968 - DNA, 344 bp, Homo sapiens
gaggcccaggcaggaggattgcttgagcccaggaatttgagaccagcttgggcaacacagggagatcctgtcgctacaaaaaaaaaaaaaaaaaataggcatggtgacacacacgcctgtggttccagttacttgggaggctgaggtgggagcattgcttgggcttgggaagtcaaggctgcagtgagctgtggctgtgccactgcactccagcctggatgacacagcaagaccctatctgaggggaaaaataaaaggaagcaaacaaagcagaagagagaggatgagagaccagaacaaacaaataaatagcagaaatacaaaagacagatttctccccctcc

SEQ ID NO: 240969 - DNA, 315 bp, Homo sapiens
ttgttttgttcctttaaggttgaatcctttttcttggttattttctgatttttcccttctcctgtgatttgcctgtttatagatttggcccatttgttttctcagtcgcggtgttcgtgttgactttaaggaaatttcatgttttatggatgtgaattttttggcatatggaatgcaaaagttttttacagcttgcaatttatgtatttgccttctttgctctgccttaacacttttatacacccaattctttcttttttatggtctggattaaaacttctaaataaaaaaggactttccttataaaaacaataa

SEQ ID NO: 240970 - DNA, 360 bp, Homo sapiens
aaggaaagtaattttgggctacattagagcaggccttgaatttcagagtagttaggacatttatccaataaaccagtgaagatctgtgaccaaggaaatagcataattagctataatggtgcacacaggagtaatatgattaggaaagatgcttttggccctgggaagcagaattcagaagcgatggaaactgtagatgtttgcagttatgcaactgagagaacattagggctaaaacaagggccaagtgtggtggggctcatgcctgtaatcccaacactttgggaggccgaggcaggtacactgcttgagcccaggaatttgagaccaacctgggcaatacagtgagaccctatctct

SEQ ID NO: 240971 - DNA, 742 bp, Homo sapiens
ggaaaaaaagacaagttaatgagtctgaaagagtgtgtaaaaataggttatttcagcatctttaatggcttgagatacaaagtacatagttttaaaatattgagtacatcctatagggagataaggatataaagatgaataaactaatttcatatttatgatacactagtatcagttcagaatatgattctttatatataaatatttaaaagattgttcatcaaaacaaatgtcataaaatatttggtggtacagttttaataaagtagaatcagattcttctgtgaaatgaagtataaagctgatatcgtaactaataacctgtataataccttgcattattcctgtttccaatgaagtcagtgtagtctttacatctggggctagagacagaacagaggttctctttcagacacatctctgaggttgtgcttttgtagatttttttcctcaaacctatccttacctttctttttaatttgattttgctttaattgagggacaagcagggatagcattgttatattagccaatggacagataagattctatcatacatgttctataaacttaatggtacttccccagagtctgtagcctatatatcttttatcacttctctaatctcattctagctgggtagggagagactaatttttgaatcaatgagaaattcagtttggggattccaagtaaagtaagcagtcgttactattccttaaattttatgcacaattctatt

SEQ ID NO: 240972 - DNA, 458 bp, Homo sapiens
ctgtaatcccagcactttgggaagccaagacaggtggatcacctgaggtgaggagttcaagaacagcctggccaacatggtgaaacaccatctctactaaaaatacaaaaaaaattagctgggtgtgataatgggtgcttgtaatctcaactacttggaaggctgaggcaggagaatcacttgaacccaggaggcggaggttgcagtgagccaagattgcatccctgcactccagcctgggcaacaagagcaaaactctgtctcaaaaaaaaaaaagaaaagaaaaaaatgcatgggtatttttgcttgtagaactgagtcaaaatcccttttctctagtggtggctcacacctgtaatcccagcactttgggaggccaaggccagaggatgggccaggagatcgagctcaggtgattgagatcagtccgggcagcataaggagaccctatctctacg

SEQ ID NO: 240973 - DNA, 371 bp, Homo sapiens
gcatctatgtctatgtttataatttatatttttccaaatagtagatttgtaattgctgttagccaacagaaaataaaatacataaaatataaagcatagcaaactgaagtctaaatgacattagagtcatgtcaaatgaaggttgtagcagtaaaactaaaagaaacaattggaagaactgagtaatcacaacctttgctgaagtgactggaaggattgggaggagcagattagttgtggcaaaatatcacattaaatcaacatttgtattagaattgattggtctttaagtacaacaagtgaatttgcacctagctttatgtttgcatataaaacacattaataatatataataaagacagttaacaata

SEQ ID NO: 240974 - DNA, 406 bp, Homo sapiens
aatgtttccaaatcattgggcatatcaaatagtatttcatcttctattgacagaattttaaaaacaaaatatatattgcaatttgcaataaaacttaccctttatagataattaataacaaaatgttctcagagtagattttaatgtttagactattagtaagatttcagatgattgaaacaaagcatgtttattcttttcttttgtggagcttggattgttaaacattagttctgggagagaccagggaagataaaggtctatcataaacataactaatgagataactcctcaaggataaatttggtctagaattattgttatgaggttatattcttttatagaattttctaaatcaaatcttgtacttaattaaaaacaatagggtaatctgacttaaacttta

SEQ ID NO: 240975 - DNA, 309 bp, Homo sapiens
tgaagtataaacaatgttgtaataaggaaattgaatttaaatttggtgagaagtatttacagacttcaataagaggagctttccttctctttctcatccttttcttttctcggttccaagtctttgctattgtgaatagtgccgcaataaacatacgtgtgcatgtgtctttacagcaacatgatttataatcctttgggtatatacccagtaatgggatggctgggtcaaatggtatttctagttctagatccttgagaccttgagaaagtctcctaacttctctgaggcttaattttcttttttttc

SEQ ID NO: 240976 - DNA, 503 bp, Homo sapiens
tctagaatttatatttattgaaaaattataaatcaaaaattgcatttgttatatgcattggtaatgacaaaaataagccaaatgtttaaataatatacttaattatctatgggagagaaaaatactccaaagtggaattttaaaagtattcgatagttactttttgggaaataatattattcaaacagatacttaaaaactattttagatgatttaggccaggtccggtggctcacacctgtaatcccagcactttgggaggccgaggtgggtggatcatttgaggtcaggagttcaagaccagccatggacaacacggtgaaacttcatctctactaaaaatacaaaactcagcccaggcagtagtggtgcgcacctgtaatccagctattcaggagactgatgcaggagaattgcttgagcctgggaggcgaaggttgcagtgagccaagatcacagcattgcactcccatctgggtaacagagtgaggccttgtctcaaa

SEQ ID NO: 240977 - DNA, 208 bp, Homo sapiens
atgctgagaagccaagcagtacagagaagcaacccagggattagcaacatcaagaaaagtagcttcaatcccactggctggatccgagtcccaaagctgggaaaggaagactgaggaatgcaaccacagctggatggattttttcacaagataatgtttgtggattccagcatttcattcaaattccaaagagaatcatttacaagtt

SEQ ID NO: 240978 - DNA, 635 bp, Homo sapiens
gaagggtctagctgtgggaagtggagcatgaactggaaataacttcctgcctctagcgattcatttttcttttcagcaccatttcagcgatagaggttttactgaaatttaaagagagaaaggtgttgccgaattaatgtggttggtatttactgacagatcccttagatagcccacttcttttgtctttttttttttgttttcttttcccttctaagacttctgtggcatctatcttcaatttgtcttcaattttggggaaatgctctttcttttttaatttctaagtttttagaaattgatgctctcagatatgtctgaattgacacagtatgatggggatctaagacctgcttttgtgcctgggagccatgaacgttacactaagcagtcgaaatttctgtgctgtagttttcttctctgtaatatgaaggtgctgggataaataatctgacatcttgcttattcagctcaacaattctgtgcatatattgcatttacacatctatcttggatttttaaaagatgtggcataggtgatgggttgataggtgcagcaaaccaccatggcatacgtcgtttacttacgtaacaaacctgcacatcctgcacatgtacccctgaacttaaaaaca

SEQ ID NO: 240979 - DNA, 688 bp, Homo sapiens
gaagggtctagctgtgggaagtggagcatgaactggaaataacttcctgcctctagcgattcatttttcttttcagcaccatttcagcgatagaggttttactgaaatttaaagagagaaaggctaaaagcttagtatttcaatgtgccagctattgctgacttgcagtaaagaactgttgccgaattaatgtggttggtatttactgacagatcccttagatagcccacttcttttgtctttttttttttgttttcttttcccttctaagacttctgtggcatctatcttcaatttgtcttcaattttggggaaatgctctttcttttttaatttctaagtttttagaaattgatgctctcagatatgtctgaattgacacagtatgatggggatctaagacctgcttttgtgcctgggagccatgaacgttacactaagcagtcgaaatttctgtgctgtagttttcttctctgtaatatgaaggtgctgggataaataatctgacatcttgcttattcagctcaacaattctgtgcatatattgcatttacacatctatcttggatttttaaaagatgtggcataggtgatgggttgataggtgcagcaaaccaccatggcatacgtcgtttacttacgtaacaaacctgcacatcctgcacatgtacccctgaacttaaaaaca

SEQ ID NO: 240980 - DNA, 245 bp, Homo sapiens
ttaaaaaagaaatcctaaaatgactgaatttggatgtatggagatggtcaggaatttctaagtatatgtatacgtacatacatcttaatgatataatgtttgtaagtgctaaattacgactcatggccaggggctgtgacgtacaagcctgtaatcccagggctttggggagccaaagcaggaggatcacttgaggtcaggagtttgagatcagtctgggcaagatagcaagactgtctctacca

SEQ ID NO: 240981 - DNA, 412 bp, Homo sapiens
atgtaaacattttgattgaatttaaatgttttattcatctccattagcaactgtttacagaaatctcttaaagttgaacttctgcagatagctaaactcacctatttgatattgtttttgttttgttttgtttggttactaatttatctctcctcctggggataggagtaacttaatctccaaattaaggtggcagctcaattacttgctttataaactagcttcattgtgcatgatcccatgagaagaaaaaaaataatatcagatataagaataaaactagcagccgggcacggtggctcatgcctgtaatcccagcactttgggaggccgaggagggctaatcacaaagtcaggagattgagaccatcctggctaacacggtgaaaccccgtctctactaaaaaataca

SEQ ID NO: 240982 - DNA, 857 bp, Homo sapiens
ctcatgctttagagaagcctacactggccctactccagccttgtctcccttcatggagcacacaacccagggtgccaaggaagcatgtctcttgagacctccacccctgccccataccgcacacaggacattgcaattccctgactaaatgggaagggcatgggctcatccttcctcctaatagggattttgccacttgtgtgttcactcctaagcctaggggcagctgtttgcagcatatgggcagagcttggacttgcagactggagtgtccgtaagcatgtgtatgaggccccttgtggttcaaagaaggagttggaaatgtgaagagaagtggggcctgttatatttaacacctggcatgggttatttttatcagaaaagtttctctgaaaccatgaaaaattaacttctctgacctctattgaactattacatttgttctcattggaaaaccaatgagaacaggttacagggaagttctttccattgtacatagctgataggtaaaaatcatgacatgtgaagttatataatgtctctggcaaaagtgtttcaagaatatacacctgttcggtacaatgactgttgtgactagctgaaactatatttagagtcactctgaagtcaacatttctaagtccttctcatgtgaaatgtagtgcatggtgcaacttatttttgtgaagataagggaaaaagagaccagccactcagccagcaatttcagtcctacctcactgtgcacccgggtctgacatgtcttagagcagagccaggaacatcatcagcagccctggtgagggctctgacagtcatgaagcactgtgaccagcaagctcaggaagggagcagtc

SEQ ID NO: 240983 - DNA, 380 bp, Homo sapiens
aatgcaaactatatatatacgctacgctacaataaatatgctctttgaatataatcttcaaaatacaatacctaagcacaccaacaaaactggagattatcttattaaacgaaaaaatatggctgggcgtggtggcacacgcctgtaatcccagcactttgggaggccaaggcaggcagatcatttgaggacaggagtttgagaccatcctggccaacatggtgaaactccgtctctactaaaaatacaaaatattagctgggtgttgtggcacacgcctgtaatcccagctactcgggaggctgaggcaggagaatcgcttatcgcttgaacctgggaggagaaggttgcagtgagccgagatcacaccccagcctggg

SEQ ID NO: 240984 - DNA, 937 bp, Homo sapiens
atcaagacttttacgaatagttttagcattggactgtagttagcttactttgtaaaatgtcattatcttcctagatttctatgtagaatttactcactaatttccataatagtagttctgagtgtccctttgaatcttcctggccccataaggaaggaatgtaaattatgttacactttctcattttgtattttcaaatgttatgctgcttccatgtctgtagaacatccttactaatagagtgccaagggagtattattacaaaacctaactttgttttgtttttttcttttctttattaattgtttttatttttactttaaatttttaaatatataaagctatggagaataatataacaaatatccatgcactcacacccagaattattaataataaagattaacattttgacattttgcttcatatttatatatatatgtatatagttacatctttgaaatagaaaatttcaataaagttgaggtcctcttttcctccgtagtcctgttttacccccctccctccacagagacaagcagagtgtaaaattcccctataccctcgcaatccacattttaatttttacctcatgtttatatccatctggttagtgtactctgtatccatttgcttagtgcgcttagtgtggtttttaaattttaataagtattctctttctgtatgtgttattccccaatttgcttttcaaccaacattctttttaagatttaggctgggtggctaatctaatggctcatgcctgtaatcccaaaactttgggaggccaacgcaggagaatcactggaggctgagagttcagtatcagcctgggcaacacagtgaaatcctgtctcataaaataatttaaaaattagccgggtgtaatggcatgctcctgtagtcccagccacttgggaggccccatctctaaaaa

SEQ ID NO: 240985 - DNA, 484 bp, Homo sapiens
gctgaggctggagtatgacttgagcccaggagtttgaggctgtagcaagctatgatagggccactgcactccagcttgggtgtcagtgtaagaccctgtctataaaaaagaaagagaaaatagtacagattgagtatcctttatccaaaatgcttaggaccagaaatgttttggagttttttttgactttgtaatgttggtatgcatataatgagataccctggagatagggcccaagtctaaacttgaaattcatttgtgtttcatatacatcttacaacctggatgcagttttatacaatattttaaataattttgtgcaggaaacaaagttttgattccattctgactgcaacatgtcacctgaggtcaggtgtggaattttccacttgtggcatcatgtcaacactcagaaagtttcagattttggagcatttcagattttaaacttttggattaggaatgcttaaccatatcaggagtg

SEQ ID NO: 240986 - DNA, 337 bp, Homo sapiens
ctgctgtggatgcttggggaatcttagggatattgccaatctggggtggtggtgtataaagatacgttggtgcccctcctcctaccagggtgaaaagtggtttctgacttttgaaaccagattttgaaactgcacaaggcctttccaaggaaaaaggagtattccattttctctgctataaccatttgagatgaatagtttgtgatggggtctttattccaactgatgttcccaaataaccatctgtattcgtctttcctaggagtatattaaagcaccttttggtttatgttaattgtgatgcatttagtattaataaagaggtatttaaaaatgt

SEQ ID NO: 240987 - DNA, 372 bp, Homo sapiens
ggattacaggtgtgagccaccacgcccagctactttacctttcatatttgtcattattttgtggataataatgaagaatacatttgtatttcatgagaaacaagtactttcaggaaaaacacatatccagtgataaatggcagctaggtctaagtagtttataaagtatacttttatttttcttggatctgaattattcaagttttgatgtaaatttcctgattctttaaataattacattactgttctgtttttctgttttatttgaaagaatgagtttgccaaagctataaagtagtaagtttttcattgggtgattatctgaatgggtctagtgcatacttactaaatattagacttaatgtgtaatta

SEQ ID NO: 240988 - DNA, 421 bp, Homo sapiens
ttgcctagggagagaaaacacggagaggagtcccagggctgagcccagacctctgaacagaagaaggagtcatggagaaacccagaagaatgaggtgtcacaggcaaagaaaaattggatgctccggaaggagagaggtctgtctcacgaagagagataaaagcagctgggaccacatagagattttgtgaagctgtcccattcaaagccacccccagaggcccggaggagaccacaaagctgcgaacacagccgggacctgcccactgacacactgaagagtcaacacgattcaggaaagcactttcaaagagtgttttatcttggacagataatattccgttttgtttctgagaggcaatgacaatctctagttcgattgtaaaactatttccttcaaatatacatttttatctatgga

SEQ ID NO: 240989 - DNA, 302 bp, Homo sapiens
cctctttaacggctccccatgaaataatcattcattatgtcaccaggagggaagaaagggagtattttgtgaagctgtcccattcaaagccacccccagaggcccggaggagaccacaaagctgcgaacacagccgggacctgcccactgacacactgaagagtcaacacgattcaggaaagcactttcaaagagtgttttatcttggacagataatattccgttttgtttctgagaggcaatgacaatctctagttcgattgtaaaactatttccttcaaatatacatttttatctatgga

SEQ ID NO: 240990 - DNA, 524 bp, Homo sapiens
tcatatatatatatatatggaatttatgttaatcaggataagcatatattaaggtatgtttattaagtcacaagaagatctcttacttggccagtttgtggggtggggatggtttgggattgctctgtaatagactaccactagcttagcagcatgaaacaacactgtttactagctgtaggttgagaaacccagcaagcctgcctggtaaagagtatcagataggaaacagatagcaaacagcacaaggctggaatcagggtgtcagcccctgtgtatttctttctggaggctctggcaagaacccacttccaggctctgtcatgtcgttagcagaatgcacttccttttggctgtaggactgaggtccctgttttcttgctggctgttggccagggcacattctcagaccacatgcccgcctccatctcaagtgagcaactctctctcatgttgactcctccttacctttctgatctctctgacatacgcttctgccaccagccagagaataccactgcttt

SEQ ID NO: 240991 - DNA, 403 bp, Homo sapiens
attcagactgaccatgtgattggctttagttaacagacaacagcaatttgccaaatggtgagacttgaaaagtgtttgcgcactgggacttctcctttgctgctcttggaaccctacaatcaccacctgattgcaccagagctagcctactggaggatgagacgacatgcgggagagaactcaggtaccctaacctaaagttagttgagtcccagccaacaggctgccaattgccatccctgtgagtgaagccatcctggattgtccagtcttctgctaattttccagttgatcatggacacttgagcgagcaccacagctttcagtcaacctggtccccacagaagttatactcagccaacacatattgccagaaactaaataaagtgattgttgttttaac

SEQ ID NO: 240992 - DNA, 668 bp, Homo sapiens
cccccatccctacaaaaaataaagaattagctgggtgcccaggggatgctctggcgagggcagaccccaggagaaagcaaaaggcgtctcagggaacccccacattctctcactgaagtttcccaccaggatgaccccacagccagagtcccttggcagcccctcaccccagagcccccttctaaggaaaaaagagaagttcagggcattggaccttcattaacagtggcctggctggcgtggcaggccccaaggcccactcactgccatcccctttctgtgtgtccctgtcccctagttctaaggcccagggcctgagctctcttccccagcatcgcccccccacccccgaaaaaccccgcctttggagagttaattttctgtgtgaggtgcttaacctatcaggcctgagaacacaaagcagtaatctttgttactgagatgcggctgttcgtgttttgggttttttttttttaatgtttcctaatgagtccagagacacttagcttccctgtcccccatacccggacccttccaccccactggacccaaccatgggctcagaaccctggaattccgtttgctgatttgtttgggttttttttttttttttttttaagatgttacatggtatttcgaagccagcaagttaccaccctccggtgtct

SEQ ID NO: 240993 - DNA, 461 bp, Homo sapiens
caattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccgtgttgcagattttcaggtttagactgtgtaacagtttaatggaagattgttatgttctaacctaagtattttctcgttatttaaaaacaatttttatttcatttcctgtgttattaaaaactatttttattttgaatgacttgatacta

SEQ ID NO: 240994 - DNA, 353 bp, Homo sapiens
gggctgaagtgagaggcctgcaggctcattcccgtggcgcaaaaccgctcctggcccaccagccggcctggacctgccgccacattgctggccaggccccgagatagacggggggggggcagtgagggctgggtgcggggtctagtctcagctgagcagcagcccgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatctcagtaaaggaagagagagaaa

SEQ ID NO: 240995 - DNA, 567 bp, Homo sapiens
agagactgcagtgaaccatgattgtacagctgcactccagcctgggtgacagaatgagaccctctcaaaacaacaacaacaacaacaaagaagcggagcaagaaagaaaggggctttgtctatgcctgtcagaaaatagaacataaaaaccaattcccaggcaaccacaactagatttctgttactgatttactcagccctacttcgtcttccaattttagtagcagtctaccttcatgaagccatctgcctctaggctaaaatagttctggaaatcctgagtcttaggtgcactggagcagtctgtcagttttatgcacctggtagcagtatcagcttacactgagaagcctgtttctagtatagtccttcctcctgaggttctgagactattctttgtcattctttccagaagactgactctctggcccagggctgctgcacaggattttccacaatgatgattgaacatttgaaatgtggccagtaggattgaggaaccaaatgtaacattttaattttaattaatttaaacctagatttaaatagccatgtgtgtggctagtg

SEQ ID NO: 240996 - DNA, 465 bp, Homo sapiens
gccagccctgccagccagggagcactgacggggtctgagggaggagggcgacaggtggacaggcccacagccccacactgcacaggaagggtcacgggacacttggacaggcaccctctctgttgaatcgttttggtttttgactgtttgccagtcaccctcccgttcactttcagacctaacccaaagttggctttgtgtcttgtgcgtggcagaactagactgactgagtctatgtctctagcacatctttccctcctgcctcagtttcctcacctgaccacttgggttcacataattcctgccccagcaacatcattggactgttttgaggaccagttctagaagcgaaattggaagtaatgagactaatgtgtgctgaccattaactgtgccaagcactgcagtaagtacttatcttgtataaactcctttaatcttcataacagtcctattttagagatt

SEQ ID NO: 240997 - DNA, 925 bp, Homo sapiens
ggggctggggcctctcgggacttatcagggaaaggctgctgccaaaagtggaggacttaaagctggaggccgccccaaagacggggaaatgaagaaaacgccgtttctggagctccctgaggacaaggggagcagcttctgttctcagaatccctgagctgcgctcctctggagtgtcacccccaggctggaggagatggctgtgtcagtttcccattgctgctctaacaaagcgtgcagattctgcaactcagaaccagagacgtccattgccccacagctccagagactggaagtatgggatcaaggtgctggttgggcccccttccctcaggcaatgctagggaaggatctctcctggcttcgggcggttccttggggtgtgtggcatacctgccccttgccctcccccaacacctgtcttcacaagaccctctccctgtgaagctcattgtccacatttcccctttttatttggcaaccagtcatatgggattacggcataccctaattacctcattttaacttgattaacctctgcaaagaccctatctccaatgaaagtcacgtttctgggtactgggtgttagggcttaaacatatctttttggaggaagacgcaattcaacccataaccacagtccatccctgaactacatgctgcagagggagagacctggttgattggcttaggtcatctgagagggatgcatgtggggcagtggttcgcagggcccacactctcctcgcaggtactgggagagtgacaggagcccagcacctggcatagagaaggctctcagagtctggactagagactacatattagctgtgtaacttggaggagcgtacttactctccctaaacttcagccgcaaaatggagatgacgctacatgcctggaagggtggctgtaccaacccag

SEQ ID NO: 240998 - DNA, 343 bp, Homo sapiens
caggtaaagctgaatgactccaaaacacccagagggctgtcagttgttccacatgcagttgattggtggtgctggtggctatgtgtgtccagacaaatgcacctcgaagctgcagagccaacctggcttcatggccaaggaagcacagcggtgacacgtttccctggctgtttccatacaggcagaggccagtgtcatctccagcacctgggggacataagagaaagagccagtggcctccaagacaatctcaggtgaatacgcttgacccagacgagggaaggatcacacaaactctccgttgatgtatgtggcagttaataaatcattttcaagaagctaa

SEQ ID NO: 240999 - DNA, 597 bp, Homo sapiens
ggggctggggcctctcgggacttatcagggaaaggctgctgccaaaagtggaggacttaaagctggaggccgccccaaagacggggaaatgaagaaaacgccgtttctggagctccctgagggaagcatgaggaatttcactgccttccagcaattaaattgcattcaagaattctacagtagccttggtggtctgcaacgacatttcagggattagatgctctatctcctgtctgcagacacatgagcagaacccaggatggaagaatgtaatcaccagcgtgactccagtgatggagatgaactagatgtggagactggggagcagcagagtcaactcagttatcatcttggcggccgggctgccgtccagctcacagaagccacctgatccggaaaagatttccaaagcctgctggagctgtttccatacaggcagaggccagtgtcatctccagcacctgggggacataagagaaagagccagtggcctccaagacaatctcaggtgaatacgcttgacccagacgagggaaggatcacacaaactctccgttgatgtatgtggcagttaataaatcattttcaagaagctaa

SEQ ID NO: 241000 - DNA, 773 bp, Homo sapiens
ggggctggggcctctcgggacttatcagggaaaggctgctgccaaaagtggaggacttaaagctggaggccgccccaaagacggggaaatgaagaaaacgccgtttctggagctccctgagggaagcatgaggaatttcactgccttccagcaattaaattgcattcaagaattctacagtagccttggtggtctgcaacgacatttcagggattagatgctctatctcctgtctgcagacacatgagcagaacccaggatggaagaatgtaatcaccagcgtgactccagtgatggagatgaactagatgtggagactggggagcagcagagtcaactcagttatcatcttggcggccgggctgccgtccagctcacagaagccacctgatccggaaaagatttccaaagcctgctggaattactatgaaaggcatcaccatttctggaggaggctcttgtgtttaatatgctttctagcacgttcttctagttcctgtaccattgagctgaccacaaaaattggatcaatacatctgcttaacaagatatgaaatccagcatgtagaaaggcctgtcaaaggtcaatcaaaaaggctgtttccatacaggcagaggccagtgtcatctccagcacctgggggacataagagaaagagccagtggcctccaagacaatctcaggtgaatacgcttgacccagacgagggaaggatcacacaaactctccgttgatgtatgtggcagttaataaatcattttcaagaagctaa

SEQ ID NO: 241001 - DNA, 527 bp, Homo sapiens
ggggctggggcctctcgggacttatcagggaaaggctgctgccaaaagtggaggacttaaagctggaggccgccccaaagacggggaaatgaagaaaacgccgtttctggagctccctgagggaagcatgaggaatttcactgccttccagcaattaaattgcattcaagaattctacagtagccttggtggtctgcaacgacatttcagggattagatgctctatctcctgtctgcagacacatgagcagaacccaggatggaagaatgtaatcaccagcgtgactccagtgatggagatgaactagatgtggagactggggagcagcagagtcaactcagttatcatcttggcggccgggctgccgtccagctcacagaagccacctgatccggaaaagatttccaaagcctgctggaagcagccctcccagtcaggagagcaaagtcacattccatctggggacatctgagaggagatgcagaagccaatagctgattttcctcccctgctccttcccttgaat

SEQ ID NO: 241002 - DNA, 1892 bp, Homo sapiens
gtaaaacctttagtcgaagcttctctcttaaacttcatcagaacattcatacgggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaatccatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtc

SEQ ID NO: 241003 - DNA, 1720 bp, Homo sapiens
gtaaaacctttagtcgaagcttctctcttaaacttcatcagaacattcatacgggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaatccatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggcgtgagctctaattatatggccacattcagttcttatcaaagaaataacccagacttaatcttgaatgatacgattatgcacaatataagtaaa

SEQ ID NO: 241004 - DNA, 646 bp, Homo sapiens
ttaaaggcatgtgccacctcacccggtcccattcatactttcagtacaaatttcaaagtacagttcactactgtggtcaacaaataagaaattggcttatacagttgtcaccgaaaaggtatatttgctacggtatataaatgtgaggatgtttacatatgagcacttctcatgaaaatatcgtctgtcttcattccattagaaactaactcaggatttggtttgtaacaatgtaatcagggctggccctttatttgcctttattatcaataaagaaaggattaaattttaaaagttaataatacttagtgaaataatacttagtaaataatacttatttacttagtagacagtagtgcctttcagctttatgtactgcttcaaagtaattgctttcgtttgtataacaccagttattactatcaaatgcatcttactcttttaatttatgctgtgatgtggttcagaagtgtcatcaccataacaatgaatcccatagtggcttctgaatccagggttattggaggagaaatgtttcaagaatgaagttaaggacagcccttcctcattatcctggataaactgagataaggaaattcaatatccttgactgcatcagtttctaggcacagtagcttgttgtccc

SEQ ID NO: 241005 - DNA, 463 bp, Homo sapiens
agaggcacaaggaagaggggtaggaacttccttcaaatgtgattttaataactagtcaagtgtgtccaactgtagaaaatcaccaagtgacaatctgtctacctgacagtgatcacaatgaattacaagacttttgaatagctatacagattagaataaagcaggaccaaataaaatatcttttgttggtaaaacttttgacttagagctaagaaactttaaaaaaaattctcttttgctttgatgtagaaagtttaaattacagaatgtgtaaagtgttttataagctttttgtgaaagaagcattattctaaaagctttatttgaacatctgttgaagaatgggtggtggtttgtaaatcagtttgctatatattattatatagtttccatatatgtaagatgactgtatcttaattaatagtcctatcattaaaatcagaacttcagtgatcttgaaaat

SEQ ID NO: 241006 - DNA, 278 bp, Homo sapiens
cactttgggaggctgaggcaggaggattggttgagtccaggagttcaagcctagacaacatagggagaacccatatcttaaaaaaaaaattctttatggttttcaataggctgttttcatctacaatgcaatgatgagttaaagttttccattaaaaatttttttaccaataactctccaaaagaattgaaatagaataacgtataactccaagtcagtggggatgaggggtggaaataaagagaaattgatcactccagtataaggcagggaagaag

SEQ ID NO: 241007 - DNA, 754 bp, Homo sapiens
gaaagatctgtgggtacgtatgggtgtcctgccatctgaatgaataattcaggaacatggcccaatttcaccttccatgtctggtctggcaaacgtggagatgcttgggcagggaatttaactgggtttttctgacttctcgtggagtgccaaagattgagctgagggaaatcagggatgccagaatgctatgaaagctcaaatccactcaatcctgcaggattcaaagacatgaagtagcagcactgtatgcaagggaggctacttatctgctgccacattataggggagctgaggataacaagccgggtgggcagattatccatttatttttgtctttcgaaagactagcatagggggcatcatttagtgttcaatttcctgtgtcctcaggagagcacactggtacatacccccagccaggctggggggtcatcccagggggtttctggttgtgagaaagaatccatcctggttgcccacaaacaaacatgtgaaatacaaaccatgtgacctggataaacagaacatggtgaggaagtaggcagtgctcatctgaacaacaaaaccgcacccttctggaatacaaagacaccagatggtggttttctctggccaggatattcttcacaccatggacagacctgaagcgctgcttctccaaggaatgagaagataagagaatccatctttcaaagaaaacaatgaatttctctctctctctctcttttttttttttgagacagagccttgc

SEQ ID NO: 241008 - DNA, 441 bp, Homo sapiens
agaagctgaggacacacagggtaagtgatagcccaagctgggaggaacctggacactgggtctgagagcctccttcagagaagctatttgtggcatcttggtgatttaaagattctcccaaatcttattaaaaatgaatggatcagctgggtgctgtggctcacacctgtggtttcagcacttcaggaggctgaggcaggtggatcacttgaggtcaggagttcgagaccagcctggccatcagggtgaaacccccgtcttgaaaaaaaaaaaaattagctggttgtggtgatgcacgcctgtaatcccagctacttgggaggctgagtgaggagaatctctgggacccaggaggtggaggttgtagtgaaccgagattgtgccactgcactccagcctgggcaacagagcaatactctgtctcaaaataaatacataaat

SEQ ID NO: 241009 - DNA, 314 bp, Homo sapiens
ccttgtggtcgtcggatctccctgtgatctctcccgccctggggagaatagcccaaaactttgttcttaaaaaaaaaaaaaaaagaaaagcaaaaaaagaaaaaaaaaaaaagattttagtattttatatatatattttttcttatttaaatgatacagtcattgtagggaaaaaaaaacaactttgagaaactacagagaattgaagttaaaaacaaaaacatgccaccattcagagcgacagcttacaacttcttttgtatatccatggtgtgagactgagaacagtacagtgatcgaccaacgggatctcg

SEQ ID NO: 241010 - DNA, 359 bp, Homo sapiens
gcattccagcctggaatagagtgagactccatcttaaaaaaaaaaaagtatgttaacaagaatttaatatttataagcattataaagattttaggcccagggtaatggctcatgcctgtaatcccagcactttgggaggcccagggaggtggatcacttgagttcaggagtttgagaccagcctggtcaacacggtgaaaccctgtctctactaaaaatacaaaaattagccaggcgtggggtgctcatgtgtaaccccagctactcgggagcctgaggaaggagaatcatttgaacccgggaggcagaggttgcagtgagctgagatcacgccactgtactccagcctggggatagag

SEQ ID NO: 241011 - DNA, 316 bp, Homo sapiens
cttttgtatatccatggtgtgagactgagaacagtacagttttaaattttacaaaaattatacttcatggtctgatttctcaggtacagttaactatggtcagtctctgtgtgatcaagtattatctgtgtcatcatttttaagtgctgtttaacagtcatatagctgtcacaactttggctgtaagattacggaggtcctgcagccaattaagctgactgaattcctttccttatgggggtccagtgtgcaatggctgtaaacagcagcttccttggtagtgtatgcggcctgtttgttgtataggttgctctaa

SEQ ID NO: 241012 - DNA, 4884 bp, Homo sapiens
  misc_feature (4368)..(4368): n is a, c, g, or t
gatattttgctacaggagatcaagacagagacaacagaggcattactaagcgttgaaagctcatagtgaggcccaatacatttttgttcaatggacaaacggattcatactgtccaagagtccaagaacctgcatgtagggaggagtcatattccttatgaagttggtcactgactctcctgcaatgtcatataactaagaattctcttccacatccttgcttaatgactggaaatggccatttcactgtggccctccaatcaaccctttcccatgagctatgtaatattttaccaccttctaagattgaaactgcccactaataacttcagcctgaagctatttcataattaaaaactgttaagtatttggtattggtgacagtgcctttatctttttccctcttccatattcctagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaacgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcggccatgtggtttgtgcattttaatggtggagaggtcctgggagaaggaggggagacaactatctggactgatagataaaaatgcaaaagtggtataaattttgtgcaaggaggctcacagcatttttggcactcgggtaaaacacagttctctgttaaatcttcagtttctaccatcaaactttcagatttgtaccattttactgagttttcctataatttaaccctgatattgaaaaggctgggatgttagtatgtatcaactgcctatatctaaacaacacaaaatgttaataagttttaataagttatgaaatcttctacaactgcaaaataatctttctggtttcctgcttaaaacagagtttaaattctgcttaactatcgcaagacagtttgcagaagtaagttcccttaatcttcanatttacttttcttgttggcaatattatatacatgctttagtgaaatacctaaatttccaataattatgccctttaagggatctaaaatagccagatattaagagtattggtattagagtcccttgttcactactcaagacttcaactataggtaacagatttcataaatgaatatttttaaagtgatgctgttttactagagtatacaatgttcactctttataaagttgttttccaataatatgcctaatctaaaaaactgtcaataattattgcacttttttgatgtggcacctggacatctgctaaagctaatttcctaggacattaatcattcatttcaaatacagagtaaaatatcagattctagaatgacgactagcagtagcctctacatcttgggttaatgtttttcaaaatgtttaagaatgtgtcctgtgctcaaatagtatttaataaagttggagagtgagctctgactacttgggaatgagacatatcttaaaatggtttaat

SEQ ID NO: 241013 - DNA, 4341 bp, Homo sapiens
  misc_feature (3825)..(3825): n is a, c, g, or t
atttttctttttttttttaataaacagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcggccatgtggtttgtgcattttaatggtggagaggtcctgggagaaggaggggagacaactatctggactgatagataaaaatgcaaaagtggtataaattttgtgcaaggaggctcacagcatttttggcactcgggtaaaacacagttctctgttaaatcttcagtttctaccatcaaactttcagatttgtaccattttactgagttttcctataatttaaccctgatattgaaaaggctgggatgttagtatgtatcaactgcctatatctaaacaacacaaaatgttaataagttttaataagttatgaaatcttctacaactgcaaaataatctttctggtttcctgcttaaaacagagtttaaattctgcttaactatcgcaagacagtttgcagaagtaagttcccttaatcttcanatttacttttcttgttggcaatattatatacatgctttagtgaaatacctaaatttccaataattatgccctttaagggatctaaaatagccagatattaagagtattggtattagagtcccttgttcactactcaagacttcaactataggtaacagatttcataaatgaatatttttaaagtgatgctgttttactagagtatacaatgttcactctttataaagttgttttccaataatatgcctaatctaaaaaactgtcaataattattgcacttttttgatgtggcacctggacatctgctaaagctaatttcctaggacattaatcattcatttcaaatacagagtaaaatatcagattctagaatgacgactagcagtagcctctacatcttgggttaatgtttttcaaaatgtttaagaatgtgtcctgtgctcaaatagtatttaataaagttggagagtgagctctgactacttgggaatgagacatatcttaaaatggtttaat

SEQ ID NO: 241014 - DNA, 1495 bp, Homo sapiens
  misc_feature (297)..(297): n is a, c, g, or t
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttncatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaagcc

SEQ ID NO: 241015 - DNA, 5862 bp, Homo sapiens
  misc_feature (297)..(297): n is a, c, g, or t
  misc_feature (5346)..(5346): n is a, c, g, or t
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttncatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaagcgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcggccatgtggtttgtgcattttaatggtggagaggtcctgggagaaggaggggagacaactatctggactgatagataaaaatgcaaaagtggtataaattttgtgcaaggaggctcacagcatttttggcactcgggtaaaacacagttctctgttaaatcttcagtttctaccatcaaactttcagatttgtaccattttactgagttttcctataatttaaccctgatattgaaaaggctgggatgttagtatgtatcaactgcctatatctaaacaacacaaaatgttaataagttttaataagttatgaaatcttctacaactgcaaaataatctttctggtttcctgcttaaaacagagtttaaattctgcttaactatcgcaagacagtttgcagaagtaagttcccttaatcttcanatttacttttcttgttggcaatattatatacatgctttagtgaaatacctaaatttccaataattatgccctttaagggatctaaaatagccagatattaagagtattggtattagagtcccttgttcactactcaagacttcaactataggtaacagatttcataaatgaatatttttaaagtgatgctgttttactagagtatacaatgttcactctttataaagttgttttccaataatatgcctaatctaaaaaactgtcaataattattgcacttttttgatgtggcacctggacatctgctaaagctaatttcctaggacattaatcattcatttcaaatacagagtaaaatatcagattctagaatgacgactagcagtagcctctacatcttgggttaatgtttttcaaaatgtttaagaatgtgtcctgtgctcaaatagtatttaataaagttggagagtgagctctgactacttgggaatgagacatatcttaaaatggtttaat

SEQ ID NO: 241016 - DNA, 5837 bp, Homo sapiens
  misc_feature (5321)..(5321): n is a, c, g, or t
taggctagtacgaggctggtttaaatcggccgagggttcctggttctccaagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagatggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaacgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcggccatgtggtttgtgcattttaatggtggagaggtcctgggagaaggaggggagacaactatctggactgatagataaaaatgcaaaagtggtataaattttgtgcaaggaggctcacagcatttttggcactcgggtaaaacacagttctctgttaaatcttcagtttctaccatcaaactttcagatttgtaccattttactgagttttcctataatttaaccctgatattgaaaaggctgggatgttagtatgtatcaactgcctatatctaaacaacacaaaatgttaataagttttaataagttatgaaatcttctacaactgcaaaataatctttctggtttcctgcttaaaacagagtttaaattctgcttaactatcgcaagacagtttgcagaagtaagttcccttaatcttcanatttacttttcttgttggcaatattatatacatgctttagtgaaatacctaaatttccaataattatgccctttaagggatctaaaatagccagatattaagagtattggtattagagtcccttgttcactactcaagacttcaactataggtaacagatttcataaatgaatatttttaaagtgatgctgttttactagagtatacaatgttcactctttataaagttgttttccaataatatgcctaatctaaaaaactgtcaataattattgcacttttttgatgtggcacctggacatctgctaaagctaatttcctaggacattaatcattcatttcaaatacagagtaaaatatcagattctagaatgacgactagcagtagcctctacatcttgggttaatgtttttcaaaatgtttaagaatgtgtcctgtgctcaaatagtatttaataaagttggagagtgagctctgactacttgggaatgagacatatcttaaaatggtttaat

SEQ ID NO: 241017 - DNA, 6226 bp, Homo sapiens
  misc_feature (5710)..(5710): n is a, c, g, or t
tgagagcgcttctctccctgaaaacacagcacaggttgagtcaaatgaggtcatgggtgcaccagatgacaggaccagaactccccttgagccatccaactgttggagtgacttagatggtgggagccacacagagaatgtgggagaggcagcggtgactcaggttggagagcaggcagacacagtggcctcatgtcctttagggcatagtgatgacacagtttatcatgatgacagatgtatggtagaggtcccccaacagttagagacaagcatagggcatagtttagagaaagaattcaccaaccaggaagcagctgagcccaaggaggttccagtgcagagtacagaagcaggtagggatcacaacgaagaagagggtgaagaaaaaggattaagggatgagaaaccaatcaagacagaagttcctggttctccaagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagatggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaacgtgatgttacagactgcagagttaaagaaaagcagacattgacagtttctgatgagcataaacagtaagtgcagtcacaggccaaacttcttgctaggaacagcaagactgggaagaggtcttaaatttagtgatactgttattattctatattctcaatatagtaacacatgcatcttgctgtgtcaaatgctttctgggccatcattaaaaggacattaaaaacgtttttcttctaatgaatgcagtataccacaggacttcaattcactgaatgacaaaatatagagaaataaacttgctacaattaatggggccaaaagggtggttcgaatttcttgataaagcttccaggtgaacatctgacgtgttagtagtcttcttttggtagtgccacattccccaaggtattaaaatgttatgctccaaaagggtatattcttttagattttattcaacccaattaggtctgaggactgaatcacactgaaaccattaacttcatttgaaactcaaaacatttttgaaatcagatgaaggccaagttctccaacctctcttaggaacataagttaaattgaacaagggacttttaaaaatgaaataaaaacaaaattaaataaaaatgaaataaatagataatgattttggaaattcatactagaattaagtttagtctaattatattttaatatgaaacaatgaaggttttctgcctccttgccaacctagaaaaattgacaaaaataagaatacctaaaagtatacatggttcttagcataaccacaaaattattatagtgacagattaaataaggttgcagatagattcatagactttaactggctaaaaaaatacatttaaaaaccttttctgtacttacctacatgaggaatggagtatactgttggtagaaaaatcatttacctaactactgtatacgcacaagggactaatttttttcctccactaaaactcttatatgtagttgtgtacaaattaagtcagaaaatttcctcatggctcacacctgtcactttatgctaactagcaaggctggaatattaacatacctaaaatcaagcagaagaaatggcactgcactaataaaaaggaggtgcaaaaccttaagtggaataggtgcatgaagtttatttaaagactaacatcccaacttgggaaactcctaataaattctaaactcttccgaattttagaaccttgatatttctttacaccttttataaaagatgcctcttgactagggctaagcaagcagtgtgtacacaaacagaattgtgtgcaagtatacacacaccaaatgcactaataatgaagaagagagaacaaaatgaatttcaaatgccgaattcgggaacctcctcaaactattgcctttttcaaatggctggaccaacgattaaacttcagccaagtttttttcttaaggtcttccatatcattaaaaacaaggcatgccaactctgactttataaatctaaaattcagtgatctgcacagtttctgagcttgaagtattgaattgtgactcatctatttttttttcccattttccttctgaggtagagttaccaatccaattttatcaggaccacagatattttgagctaaaccccatgatcttttcatacagtaaaaataatttttatgaaaaaagaaagcaggcttcccaggccatggcacatagatatatttacaatttttaatgtaataattaaaaatggtattgtttatattttaaaaaacagcccagctgtattattctgtcaccaagaattattaattgaggatgctgtcaatgctgaattttatagttcagccttcacaatcccatccatgatgaagagttgattctcttacggtatacaatatactctcacaactttcagccttctcttaaagacatgccccaaatgagcaggatggatataaagaatgtaattcattcaaacaactcctccctgttctgccccctcccctcacattcccctcttctcaaaaacatctgaagtatgaaagttgtctttaaatagtaaaagcaccacaatctattaacaccacatattatctttaaacttaaatattttagtgatgtcttggacatcaaaataatttcttaaggtggactcttgagtatgtgggtccagcccaggtctgcagtttgtgcagacatagaaaaaagaggaactttaaatattcagaaaaagttaacaggctagctttaaaatactgctggaaattaaatttcttcagagttggcaagcatgggctattgatcaaagtatgaattaaacggatttacatcattaagaaaaaacaaatccgtgttattgtgctgtgaaatttccatgatgcctttcaaataggctgctcacaatttttttataattccaaatcactcgatttttgatggaaaaaagaatacagatggactgtgttttacctatgtgaaagtcaccaatccatttaaaataaaatccaagagggcatatacagtctaatcaagtcatcattttcctgattaataagaactacactttacacaaaatactttatcagcagctgttttcatcaaaaaatcaagtcagtttcacagttgaaaaagttacacattaaaatattttacaattcattatatattcaccaggttcccattttctaatgggcttttaatataaagcagaatagaagggaaaatctcaaagttgattactttgacactaagttttacataggacactaagaaccacaaaaagcttaggttctattgtaaaatagcaaccaaattccattcttcttttaaaaatccaattagaaacatcttttttaaaaaaacaaattccacaataagagtaacagatttcaaattaacagtagtctaaaaatcttcaaaataaatggttttgtatagctgagaatatggtagaaagtgaaagcataattttccaacagtcatttcttactacagtgtgtttaaaattatttttattacttttagactttttctcaaaataattattcaaggaaatatttcttaagtggcccaataaaactgtagagccaatagtcagttacaccatattcaaggacaaggatagtcagctatagataggaactgtctaaaccacgagaactgatctctgatactgaagtacccagaagtggctatattatcactgacttgaaacagatcttagtcacccatgtagcatttaattcaatgtttggttctttgcctcatttctttcttaggtcacaatctatagtctttatagaatttgtctacatttcttctaatagaattaatttggttgtagtaacttttgaaaataaatgtaaatggtgaaatcggccatgtggtttgtgcattttaatggtggagaggtcctgggagaaggaggggagacaactatctggactgatagataaaaatgcaaaagtggtataaattttgtgcaaggaggctcacagcatttttggcactcgggtaaaacacagttctctgttaaatcttcagtttctaccatcaaactttcagatttgtaccattttactgagttttcctataatttaaccctgatattgaaaaggctgggatgttagtatgtatcaactgcctatatctaaacaacacaaaatgttaataagttttaataagttatgaaatcttctacaactgcaaaataatctttctggtttcctgcttaaaacagagtttaaattctgcttaactatcgcaagacagtttgcagaagtaagttcccttaatcttcanatttacttttcttgttggcaatattatatacatgctttagtgaaatacctaaatttccaataattatgccctttaagggatctaaaatagccagatattaagagtattggtattagagtcccttgttcactactcaagacttcaactataggtaacagatttcataaatgaatatttttaaagtgatgctgttttactagagtatacaatgttcactctttataaagttgttttccaataatatgcctaatctaaaaaactgtcaataattattgcacttttttgatgtggcacctggacatctgctaaagctaatttcctaggacattaatcattcatttcaaatacagagtaaaatatcagattctagaatgacgactagcagtagcctctacatcttgggttaatgtttttcaaaatgtttaagaatgtgtcctgtgctcaaatagtatttaataaagttggagagtgagctctgactacttgggaatgagacatatcttaaaatggtttaat

SEQ ID NO: 241018 - DNA, 1596 bp, Homo sapiens
  misc_feature (297)..(297): n is a, c, g, or t
tgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttncatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaagcc

SEQ ID NO: 241019 - DNA, 1895 bp, Homo sapiens
taggctagtacgaggctggtttaaatcggccgagggttcctggttctccaagcaggaactgagagcaagggtcaggaggcgacaggtccaagtacagtagacactcaaagtgaaccctcagatatgaaagagccagatgaagaaaagaatgaccaacagggagaggcattggactcattgcagaagagaaagaacaagaaaaagaaaaagaagaggaaaaaatccccagtacccatagaaacccttaaagatgtttaaaaagagttaacttatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccagagaatcctaaaatgaagttggatggaaaacttgaccaagaaggcaatgatgtaaaaacagcagctgaggaggtactagctggtagagacacattagattttgaggatgtcacagttcaatcatcaggcccgagggctggtggtgaagaattagatgaaggtgttgcaaaagataatgctaaaatagatggtgccacttaaagcaatcctgaagaaccagagagcgaagatgcagatcactgcaccgtacccaaaaatgaaagtccctcacaggacattagtgatgcctgtgaagcagaaagtacagagaggtgtgggatgtcagaacatccaagtcagaccatcaggaaagctttagacagcaatagcctaaaaaaccatgacttgttggcaccaggaggagagccgggggacttcaatccagaaagcagagaagataccagaggagggaacgagaagggcaaaagcaaagaagaccgtaccatgtcctaagctgaggcaggcggcaggcgtggtgcacaggaagtctgagtgtgaggggctcttttctctccactgccaatgacagcctttcctgcctcagggaagaagagagagacagactacagtgatggagacccactagatgtgcacaagaggctgccatccagtactggagaggaccgagccgtgatgctggggtttgccatgatgggcttctcagtcctaatgttcttcttgctcggaacaaccattctaaagccttttatgctcagcattcagagagaagaatcgacctgcactgccatccacacagatatcatggacgactggctggactgtgccttcacctgtggtgtgcactgccacggtcaggggaagtacccatgtcttcaggtgtttgtgaacctcagccatccaggtcagaaagctctcctacattataatgaagaggctgtccagataaatcccaagtgcttttacacacctaagtgccaccaagatagaaatgatttgctcaacagtgctctggacataaaagaattcttcgatcacaaaaatggaactcccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagtgctggccttcagatgtctgtgatttctgcaactgaggacctaattatgcctgtctgcaaactaataatgtaaaaggtaataattaaagtatcatattttcatgtgggaaaaaatttaaaagcc

SEQ ID NO: 241020 - DNA, 462 bp, Homo sapiens
tgagggtggcctaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgctttaaaaaacactgtgagagatggctgggcgtggtggcttacttgaggtcaggagtttgagaacagcccggccaatatggtgagaccccagtctctatgaaaaatataaaaattgagccagatgtggtggcatgcacttgtagtccacgctacttgggaggctgaggtaggagtatcac

SEQ ID NO: 241021 - DNA, 477 bp, Homo sapiens
tgagggtggcctaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgctttaaaaaacactgtgagagatggctgggcgtggtggcttacttgaggtcaggagtttgagaacagcccggccaatatggtgagaccccagtctctcaagtagctaggattacaggtgcccaacaccatgcccgtttaatttttgcatttttagtagagatggggtttcacatcttggccggctggtcttgctg

SEQ ID NO: 241022 - DNA, 521 bp, Homo sapiens
cgctagtataatcctatattgtagcccacaggggtgcagttagagaataggagactgtcagtatagactccatccagtcacacataaaaataaggcctcgccaatcaagcaggaaatagagggaggcgctcacatcacaacctgaacagatggccactttaaaaaaacctactcatcttgagtaattttaagggaaataggctatttaaaacaataacttataaagtcagcccttaattatagatacatttggaagtaagtggtagcatgaataatgtagttttcttcttatgaatatatctgatattttgggaatttttagcatttcaaataaagtagttacactataaagagttgttcttaattattgagtgggattgtacttaatcttttatgctgaatttccttctcacaagatgtcactcctcctgctagaagacagatttcttccttggctgacaggctgaattaagcaaaagtattttctatttcaagatcaaataaagttgatgctggtttac

SEQ ID NO: 241023 - DNA, 677 bp, Homo sapiens
agattatatctgtaccaaaataattagggtctttttatattttttcttttaactagtatctttaaaaaatcaataccaactcagttttctatgtagactcagttaataccggtattatggaaaagctgaatcaagtgtgcaaatgagctttttcaaggtgatatccatgttttcagtattgtactcctgggaagaagatcaaagcctataggaaggtcagtgctggaagcttctctgaagcattgttgctggagtggagtagtggttcctggactggacttctgagactctacatgtctttggaggcagtcattgggatcatgagctattttcggtggctgtagtagtaacgcattctttccgtaaggctctgatggatattttataaggttttaattttaaaatgagaagatgaatcattttgaattaatgcatcttagtagataagagctttcaatacctggagtccacggggacagagccataaaagattcatagtagtacgatgtcgtgacatgtacccatatctttcctcgtactcagattcagcactcacttcctaactctcagttctagcaaagaaacctggaggttagaaactggagatatgcttgaagagaaagtttgagaaatcctagtgctttcatatgataatgaaatttcctatttggaaagca

SEQ ID NO: 241024 - DNA, 363 bp, Homo sapiens
taatttgttacagctgtgataggaaacaaaagcacaatgccttgagagctctacatggcctatccctttcctaattctccaactttactttattctcatgtcttcaggcttttaaccatgctattcactattcactacattgatctcatcttggacacacattatatttttctgggaatccaccttaacctccccgtgtaatttagttttctatatacatattcttatagcatcttgttctcatatttcattgaattaattattcactcatcatttatctattcatcaaatatatattaatttcctattattggctaagcatgggagttataatggtgttcaaaacaaaacaaaacaaaaaac

SEQ ID NO: 241025 - DNA, 379 bp, Homo sapiens
tcatttcttttttaatcaagtaaacttttttcttcttcacttcgtttttttacctttactagttcggaagatatacactctatttttactcttttattgctgtcaaatacaaattttcacattagtttaagaaaacggaagttaaataatcttactttcttctcaaacaatacacatatctcggaacacatagacagaaagtccccccaggagtggggagggatagcactgggagatatacctaatgctagatgacgagttagtgggtgcagcacaccagcatggcacatgtatacatatgtaactaacctgcacaatgtgcacatgtaccctaaaacttaaagtataataaaaaataaataaataaataaataaaaat

SEQ ID NO: 241026 - DNA, 296 bp, Homo sapiens
cagggattaaggttctacctaccagtttcccattgtctagttaacgcctaaataattccagcatgtttccacccaactacaagtctcgattctccttctgggtactcctgaaagagtaaacgttcccacccaaactgaagaccaaggaacccactgttgcaggaatcatgtgaccctgagtacacacagctccccagggagaaggccacagggcaagctctcaactctggacagaaatgaggacacccaggaactccatgcttaagcgtttctatgcccagcctggatctgggagt

SEQ ID NO: 241027 - DNA, 284 bp, Homo sapiens
ccttcaaatttttcttcagtagctttacttttgcttttctttaagttttactttcccttggagtttatatgaaggaaatggaatgaggtctgggatttgcttcagaaccgcccagtggggcgagctagtaggggatgcaggtaagggtctaggtgagaccggcttgggtgtgagctaactgttattgaagctacgtgttgggcacagggaggtttattagattactctgttttgccatatgtttgaaaatttccattaaaatgtcttcctcaattctctccaga

SEQ ID NO: 241028 - DNA, 485 bp, Homo sapiens
tacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaa

SEQ ID NO: 241029 - DNA, 425 bp, Homo sapiens
aataaaacttgctgctgctcactttttgggtccatgctgcgtttgtaagatgtaacgctcattgtgaaggtctgcggcttcactcccaaagccggtgagaccataaacccactggaaggaacgagcaacttcagatgcaccacctgtaagagctgtaacactcacagcgagggtctgcaacttcactcctgaagtcagtgagtccacgaacccaccactaggagtttcttctactggtggaagaaactccggacgggtccgaacatcagaaggaacaaacttcagatacaccgtcttcaagaactgtaacacacaccgtcagggtccacagctttagtcttgaaatcagtgagaccaagaacctgcaaagtctggacacaatttcattgtagaggattttaatttaaaataaaaaataacttaca

SEQ ID NO: 241030 - DNA, 495 bp, Homo sapiens
gtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactgctgtgttataaatatacatttgttggtctctctcttggattattttgtttctttgtcctgtaactaccactgaaagggtgcaatacagctttcttgaaatgtgtattgaacggatgaatgtataaatctataatctcagaactttgggaggccaaggaggatggatcacatgaggataggaacttgagaacagcctgggcaacatagtaagaccctgtctctactaaaaataaaaaagaaa

SEQ ID NO: 241031 - DNA, 365 bp, Homo sapiens
aacatctaagggcctccctttattttaattttttattaaaatttcagattattatgtttaatttcaaacaaagaataatacaatggaccaggcacagtggctcatgactgtcatcccagcactttgggaggccaaggtggaaggatcgcttgaggccagggattcaagaccagcttggacagaatggtgagatctcatctctacttaaaaaaaaaaatgctggtcatggttgtgtgcacctgttgtcccagttacttacgaggctgaggcaggaggatggcttgagcccagaggttgagggtgcagtgagctatgattgcgccaccgcactccagcctcggtgagagagcgggacactgtctcca

SEQ ID NO: 241032 - DNA, 2214 bp, Homo sapiens
  misc_feature (483)..(483): n is a, c, g, or t
  misc_feature (1719)..(1719): n is a, c, g, or t
ttgtggtgcttataggcatgttgttgtttctcaggtagattgaaagctttgttccattataggatctttgaggatcgtacctctttttcacctttgcctactgaaaaactgtggcaaacttttcaagtgtccaaatcaatggctctgtgtcttctaagttttctagctcatcatcatctgtagtggatttcagcagactttgaagttcctagctggtaagggtttctctttgcttttcggtgtgttccttaacgtcatcctcagtcatttcagacagcgttccccaccaactttttttgcaacatttcacatattcttaataactgcattaatagtagggaagtccttgaaatcattgactcccttaccccatgatggcttgtaacatgtattggctgtcctgggctttagggcatctgtagccttcccaataagcacaattgtatttgtaattgtgaagctcttcaataaaaccactgtggnacattcaaggttagcatcaagactccatgaattcacccaaggatgtaagtcacttgaatgcacttgatgccttgatctagtgacgcagcagtgatgtagttttaggaggcagaaatatcacttgcatgttcttttaggcaaaacagagattggagagatggcctggagtgttgtcaattctgaggaagaccttgagtggcagtcccttctctttgaggtattccatcacatcaggagtgaagcattgctagaagaaagccttcttatgttcttgccaggacacaggccagcaagttttgcttttgtcctaaagaacctggtgattgctcagtagacgaagcctcgcttgttctcatgaactaatgcatggcctgacagcaccagaaaaaggtggtctttccaggccttgaaccccagtacctgcactcatgtatgaaggtaccattgggcatcttctagaacatgcctgattcatgacaatagaagatttactctggaaggtagtgtcttttttctgttttatgagctcttctaggaatgctgttgtttccctggcatcagccgatgccaattctcctgtggtcttcaagttcttgggctgcactgtgttgcatagttagcctagccagaacttactggcttcaaactccttcctcttgctctcctcagccccctcacagtgatgcttacagaggctaagtgttttttgttttcttttctttctttccttcttttttttttttcttttttttgagacggagtgttgctctgtcgcccaggctggagtacagtggcgtgatcttggctcactgcaacccccacctcccgggttcaagtgattctcctgcctcagccttctgagtagctgggattacatgtgcgcgccaccacacccagctgtcttttgagtagagactgggtttcaccatgttggtcaggctgatctcgaactcctgaccttgtgatccacccgccttggcctcccaaagtgctgggattacaggagtgagccactgcgcttggcctggctaagtgttttttcaagtatgatgttaccatcagtagggctgtggttctgtgacgtgtcctctagccacacacttaatgcttatccttagtttatcatgaactagagggatcatttttgccactgtaggggcagctctaacactttgaggaacttcagcttctctctgctttagtgtgtgatttcttggtttgttcttaccttatgangaactttccaaggtgatacaccacttttcaaaacatcttaggtttgtattttcttattgagagataccactttttgtcccctgctagccttttagggataggtttgaccacttgattccttcttaggagccattttttaacattttttatttttttatatatgacatctcaagggtctctgaatgaacaaaacagtcttcaaaagccagaacaatggccagatgtggtggctcacatctgtaatcccaccgctttgggaggctgaggcaggtggatcatgaggtcaggagttggagactagcctgaccaacatggtgaaatcgcatctctactaaaaatacaaaaattagtcgggcatggtggcgcgtacctgtaatcccagctactcaggaggctgaggcaggggaatcacttgagcctgagaggtggaggttgcagtgagctgagatcatgccactgcactccagcctgggcaacagggcgagactctgtctc

SEQ ID NO: 241033 - DNA, 297 bp, Homo sapiens
attcagaggggtacatgtatgggtttggtacataggtatattgcgtaatgggagggtttgggcttctggtgaacccatcacccaaatagtgaacatactcaatagtttttcaacccttgcccgcctttgcctctacccccttttggagtccccagtggccattgttcatttttatgtgtacccattgatcagctcccacttataagtgagaacatgaggtatttgattttctgcttctgagttattttaatttcagtaactattaggataatgatctccagttgcaggcatgttgtt

SEQ ID NO: 241034 - DNA, 541 bp, Homo sapiens
aaatattctaccattcacaaaatctcgtttaagtgttgtgaaatacaaacaccagggaatcaagtcccatttgttgtggttcctgcattcgatgactccagatgtgccaccaccgagctagtcttatgacaacctagaaggcaaattgggatggccctatatttgtcactgagagcagaagggttgagaacttagatcctgacaggaggcccacctttattggagaaatggctctgcaacttaacccaacatgtcctccatgacgaaggacaccagcttctcctagagagtacctgaccattgaagttggcagcttgaaagcagtaggatatgaatgcagattccagtccgtcctcgtgggttccagtttgcctgtttccccaacttcacagacatctctctttcccaaatgccttctctgaggatttcaggcttcagcaccaaacacagatgcgatggcctcacacagaagtggctttcaagtcgttagaaacaaatattgttggttaacctggcgaagccatcttggacagaagaaatt

SEQ ID NO: 241035 - DNA, 3938 bp, Homo sapiens
accgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacaccctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctgtatccttagtccccacccagccttgggccagccctcatccagccgagagtatccaagtctgacaggtcaggaattaggcccccagctcaggtaagggctgagactctcaggtgaggatggaggtgcttcttcttctggtggcgtctttggattgtccagtttgcctcagcccttagtatgatactcctaccccaattgccatgctccaaatctttcccaggccagccggacccatggcctgcccatatcttactctgcttccatctctctcccctctcttctctcatgatgcagtgagtctcctgccatctaagctatgcaagtccacaggctggatgaccatccccagggttgctgaggaagagcttgatgatcttgactccttctaaccctgaacatacaaaaacatatgttctcttttcatcttttgtctaacctatcctctcccactttctcttccctctactcactatttccccttctacttacttttctcacccttgttccctctccttctatgccctcctcctccctcctcacctgtcctgtgcttctctttccttacttctttttccccctcctcccctcctttctgtcctctctctcatcccatcctccttttctttctctcctctttgcctgtcttctgtcttccttgtctttcccctctcatcctctgtgcatctttctctctgcctttgcatttcctttgacaaattccttttcctcttagtttcttcataaaatttctctgaaaactccaaagccttccatgatgaaattagaagttattttctagtttgcctaattttttaaggattaggtagtaactctagtttcccgagtgttgattttaatatcaaggtcactgcatcagagctgtaacagatcgtggcagattctgctttccttgatcctttgttttcgggttgatctatgtctcctttcctaacacttagttttctcagagaagtggagggaggaggaaggaactttagatgaaatgaactctgtatttctgcaaattccccctccctggaggtagaagtgctcttttagcattttttcaacccttggtgagtgtttatggaattcctctgtgcagggaaacatcttttctgaacgtggcatgacttagggctagtcccaccagccaactgcaacttagtggctctgtttgtatgtgtgtttgggagggttgggggtatggtgtccaggtaccttgccaggaacatcggaagtagggcaatggccctagaaggaggggctgtcagggggtaggccaggtgttagagcaatgttccacatcctgttggacacagagatattatgattggaactgagagttccctatgtacagtcatcaagactgagggtcatcttgcagtctgctttaatacccacctgactcagcaaggccaagggagtaggctctgctctgaggaagagggtctgtgggttccaaagtcctggccacctgttatgtgccacattgcccctcttcatgccccatacacaccttagatgatgcatatggcctatgccttctccagaatctgctaactcctataacacatgcatatgcttcattccacattgtacttgctttgctctcccataatattatggcaaagggacagagagctgcctggaataagagtttgagcttgtgcactaaaggggattctgcaacccttattcatagtgagatgagggtccctccagaggaggcctgcccttagtttgttgttttttgctgtccaatctgacaggctctcctaccttttcttagcacttctgacatgcttctgtcttagaagaaaatgtgtttcttagtagaaagcccacccttggttcaggcccaaggtttccacccctcaacagccaacactcatttatcaaaagtaaacacagcattagtacataccaggaatcataaaaggcacctagggtaaaatactgaataaaaaggcatgattcctgactcacagaactttcagtctacttggggagacagaaaagggaagagataattacaatgtatgtgataaattctggtggaggaattccagaaggctctgggacattttcatttgacaagtatatattgagtgcctgtcataggtcaggtaaagttctaggcacagggaatgtaacagagaacatactaaagacaagaatgtctttacatgggggaaagagggaactcacacgcagtcctaggagtcagggaagatttcccaggaaaagagacatctaaactgagattttttgtttgtttgtttttgagatggagtctcactctgttacccaggctagagtgtagtggcatgatctcagctcactgcaacttctgcctcctgggttcaagcgattcccctgcctcagcctcctgagtagctgggattacaggtgtgcgccaccatgtccggctaatttttgtatttttagcagagatggggttttaccatgttggtcaggctggtctcaaacttctgacctcgtgatccacctgcttcggcctcccaaagtgctgagattacaggtgtaagccactgagcccggcctaaactgagtttttaatatgaactagtcaaactgggtgagggtgttgttgaagggaggatgtggtagacagaggggggagtacagaaggtatgggcagaagctgtaagtggtcccttagggctgaaggacttcagactcaatgataagtctgaagtggaaagatgtaagaagtttgatcttgaatgtagacaatggaaggacagattcgagggggccagtattgtagacagggacatgcattaggaggctgttataaaaatccaggtgagaaataatccaggccaagaccagagtggtggctgtagaatacttagaatgtggaactgagaagacttggtaattgactatttgggagtggcgacagggaatgggagctcgtgattggaaggggttaaggtgagtagagaggctatgcacaagctgagcaggtcgtgatactgatggacctaccctgccttgttctgtcctctagaggatgagaagaggaaacaaactgcaccagggaagctcaggccgattcaatgcatgcaagggtgatttaacctgggttctgtttgaaatactt

SEQ ID NO: 241036 - DNA, 381 bp, Homo sapiens
tcttcgcgctccgcgtcaaatctctccagctctgttctcgcatcccgggtttagatcccgcagagttaagtatcccgcgtgtgaagggatgaactgagactcccagagggcataactgatggaggcacgaagatgtctgctcttcagctttgccaagtatggtgtaaggggctttggggaatccagacagacctggacttcacacgcccgtcatttatttcactactagtgaaatgctggcgtagttacgcctaagttctctgagactgtccctcatctctaaaaccacccctcctctggtgaactaaggatggcgataacactttatgtaaagtgcctggccagatactcaataaatgttaattttccaagcttaaaaat

SEQ ID NO: 241037 - DNA, 393 bp, Homo sapiens
cccccccccccgatactcaaaataatcttgaaaaagaacaaagttggaagtcttcacttactgatctcaaaatttaacacaaaactacagtaaccaacagtatggtactggcataaaaattagcatataaaccaatggaatagaataaagagcctagaagtaaatctttacacatatagtcagatttttgacaggggtgccaagaccattcagtggagaaaatagggtcctttcaacaaatggtgttgggaaaactggatatctacatacaaaaaaaagttggacccttacaccatatacaaatattaacttaaaatccatcaagaactagctccatccactaaggttggaagaaaaaagagagctagaatcattaaactctttaaaaaagaa

SEQ ID NO: 241038 - DNA, 310 bp, Homo sapiens
ggcaatccttgagcatcttttcatatttaaaagtgaggctttatggccaggcatggtggtttactcctataatcctagcactttgggaggacaaggcagggggatcccttgatcctaggagtttgtgaccagccccatctctacaactctaccaaaaaacaaaaacaaaaaaaacaaaaaggtagccaggggatggagtgcacttgcagtcccaactacttgggaggccaaggcaggaggatcacttgagcccagaattttcaataccagcctggccaacacagtaagaccctgtctctacaaaaaatta

SEQ ID NO: 241039 - DNA, 943 bp, Homo sapiens
ctataccacggctaactgaaaccacagaaagttaaaaccatagataagggggaactattgtgtgcttcagtcactcctgagggcttcactgtggaaacacagtgtaagataataccatttttcaacaactacagaattaatggatttaagcattgatcatcaaaggatgcaaatactataaaaagagacaaatatgtgcctcataatggaagaatacaacctcacctatgaattatttttgctaccccctaaaaaaaattaaatctgaatctgatcaagcttccagaaaagccaatttataggaaatacaaaagacagaggaacatgtttgtagttgacaaaattcagaccctgaataactctgcagacacaatgccccatttcttcaacaagtaagttgcaagaaatagtgaggaagtggaggggaatctacagaataaaacattttttaaagctaaattaattgcaatgtgtggatcctatttggatcccaatttagacaaaaagactataaagaaaatcctaggacatcctaaacaattgtaaattggaacattgacacactatttgatgaaataaaagagttgttattcattttaaaactaaaatagtaataagtagtcataacaaggaccctgattgttcaaaacaaatattaaactgtggtcagtaggtatgtttaggaaggtagaaatatgtgttactcctctcagagaggtttccatacccggtaattaaaatgtaataactgttgaaaggaatctgtatgatatagtacaaaaagcacttggaattagaccaaattgttaaacagtgcagtgggaagttgcttgacatccacttaaaatcctattaagtaaaatgtctagcataggcagggaggaagcgtgatgcatgtccattaaatgtctgtgttcatcctctttcctctctgtaaaaaaaa

SEQ ID NO: 241040 - DNA, 541 bp, Homo sapiens
tgagccctagttgtttcatttattaaattcttgagaaggttcagtgccattaatacctaaacccaggcacatgttctctcgtcacctcacccttaatagcagaactgtttgttaacaacatgattaggcatcggagatggatgttggtgaatcatattttcctgaccgttgccacactccatccagtgtttgtcagggcccagactggaaggacctccatttagcccgttcagaggataccgaaaatgttcctgcgctccagagcccttccaggcgaacgtcatgtggcctcctgggacaatcactagattagcagaggtcctaggtttgccatcttactcccatcactcgctagctgtgtaacggggcaaatcatttaatttctgactctcagtgttttcatctgtaaaatagggataatgcataccttttctactatacgaagttgttaccaaatgagattttggcggggaaggtgatttgtgaattataataatacatcaagagtattttccaaataaatgaccaaatccccagggta

SEQ ID NO: 241041 - DNA, 2299 bp, Homo sapiens
  misc_feature (227)..(227): n is a, c, g, or t
  misc_feature (292)..(292): n is a, c, g, or t
  misc_feature (429)..(429): n is a, c, g, or t
  misc_feature (670)..(670): n is a, c, g, or t
  misc_feature (1315)..(1315): n is a, c, g, or t
  misc_feature (1420)..(1420): n is a, c, g, or t
aatttattacctcacagtttctgcacatcagaagcctggacataacataattgagttccctgctcagagttttacaaggctgaagtcaaaatgttggccagggcttcagtctgatttgagactgtggtcctcttgcaagttcactggttgttggcagaatacggttccttgcagttgccggactgaactcccatttgcttcccagccatcagttagggatcactctnaattactagagtctgcccctcttcctagggagtgagtagcatagctatttctttctttcaaaacnagctagagaaaactctacatttaaagggttccctgaatatgcctggcccatctaggaaaatcttgattaccccaaaataaactgattggagtccttaattacatatgcagaatccttttgtcattgccatgtaacanaatataaccgtggaagtgatatccagtcattttcacaggttctgcccttattcagaatagggaattaagtaagatgtgttcatcaggaggcagaaatattataattctacctaccacacatagaaatgcttttaaaagaccaaaaagagccttcaaacttaacacccagataatatcacaagagagaatttatgtgacttagttccaaagtgattcaccaaatagacatgaatacataatngaaatcaatagatgaagattaagttgcagactgaacaagttttttgggctttgggggtttttggtggtttgggtttgtttatggtttttcgttttttatatgcaagctttttctcatggatttcacactctggaaatttggaaagaaaacataatcactccaatgtcatacctttttgcatataaaacagttgtttttcaatgttaggaaaatccttgcctgaatgttgctttggaaaaaaaaaatctgtcttttaaaatgacccttgcaatttaacaaaatgcagatgtaattagagaaggctaacttgccctttggaacctaaaacccctaggctccttcagataaaaataagtacaaaagagaattctgatgatgatcgcatgaaggtgttagaaattcctctgtgcaaaagactaagtataaaactggaaaaattatcacaagcatttcagggcgcaggaaatcatcagtggcatacaatgaattgagaaatatttatttttgaaaaactgcatgaacttcagtaaaagcaactatactgtggcctccttgcctgaggctgctctgtctacactgccctcagcttggttagtgagaacagtagttttatcactgtggaactggctgcaaaaaccagctggnttactgctattgggacagatgatttcaccgaggtgtaaagatccatggctctcctggccaaaagtgatggaggccgttgggaattaacaagcagaacctacagcnttgctagctcaaggtttgatccctgatcacagcgactggcacaggaatcatggcagctaatcagcaccctgatcagtgacaccatgttgaagagactggccaacaccatggcaccacagggggcatgattcacaggaaggcctgaatccctggcaggattttccacaaagttccagtgcttactggagcctcctggcctaggaacaactgaaaggtcaggattaagttctggtgctcacttaagtcttccccagactaggaaacaacagcaaaacagtaatatagttccagggcagcatttaatatccagtacccactagaagttttcaccagacttggaaacaacaacacggcaacagtttacttctggagcagcatttaagtttttgcatttgttgtaagtcttccccaaaccaaaaaacaatgacgaagcaattagttagttctagtgcagtgttttagtttcagagctcattataagtcctccccagagcaggaagcaacaacagacctgtgtttaagtaccaatactaagaagtgaaggtcaaccccaccaaagaatacctgcaaaaatggaaagatatgactgtatcctcaaatgtgctggcgtcaatgcaaagatgcacggattgtgaaaactcagggaaataggacaccgataaaagtaaccaagaaaactccagcaatgaaccgagaagcattgaagacctagaaaaagtctgacagataggtcagaataatgctcttaaagaagttcagacaatcataaaaagaaacaggtagaaactaaataaaatttggaaaacaattcaggaacaaagtgagacatttgacaaagaaatagaaacaagtttaaaaaactaaatagaaattctaatt

SEQ ID NO: 241042 - DNA, 419 bp, Homo sapiens
ttgggcaaaacacaaaacctccctgagcctctcagtttctcacccactagtaccacctcactaagcatgttaggaggagtcaatgtgatagcctatgcaaagtgcctggaatagtgcctggcacacaagaggtattcaatacctgccagctgttgttgtttttctgcaaatgaagtgtaaaccccttgaggacagagatgagtgtccatagctgttatctgccacagagccttccttccacataacatatgctcgagggtttgctgacctactttgaagaaaggggcaacacgaggggaatatagttttattgtgtagggtaatttcctccaggaaagaaaaaaacagtgaatctgtgaaacttggtacagattgttaaaaaaaaactcactttgtaaaataaaagtattttcaactgc

SEQ ID NO: 241043 - DNA, 4679 bp, Homo sapiens
  misc_feature (2415)..(2415): n is a, c, g, or t
gactcagtgcatcaaaggctggagaaagaatcaccctagaactgagtgccacaggcttcggaagctgcacaagactgcaacacggtgacagcttctatttctaacagcaaacctaaaaagctcaggaaccaaaataaaacggatagaaatgaaaccactcagagtatgacgacagtactcaaagcaactcacgagcatttccccacgctgtcttccaaaatgtgaaaaatgtgatttttttttaatggccacattggagaactgctatgagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgaccacatggaaacactgtgtgcagagccagccccccaagcccgtggcggtcctccttggagatgatggggtctggggagaggtcagagtcaggctcacgtgaacttcagaaagccactgcccaggatatgggtggaccgcaagtctaccatgggctgtcccagctccaaagacgtcagaaccccacagcgattgttattcccaaagccctttacgcttggctccacagcacacggcagagaaaatcgacagaaggaaggatgttcacaggtgtccacccctacctatgccccagtgacctggaaataaaatccatcaagagcaccggggtcagccagctggggtacgctggagagtatgggtggcagagggaaccccgctgtggattgatcatttgacactgtgttcagcataccttttaaaaaaatgttggtaccatgtaaaaatataacctaaataacaagtacatttttaatgctgagatggagaatttagcacctataatccttccagagatgcacaccacgcaaccacgtgagtcccctctggctctgaattccgagagcagctaccaacacaggcctccgctgcctgcactcagcacacctatcggaaagcgccagtgctggcatgggctttccctccctggcggctgctcctcctgcacccccatgcccaggcactccggccagaaacaagggaggagtctggggactgatcctccccctctcacctcccacatctacccaggtaccacaccctgccatctgtctcctgctgccctctgtcactgcaggagcccctggagagcacatcacccctcactaggctgcagccacagcccctctcagaaaaccctgctgtctgctttccagtgcagccctgtctaatcaccctccatgtatcctccccatggctcttcccccatagcctcaggttggagcacccagctttcgcctgcagaagcccctccatgcccccgacacagcaccccatgaacaactcacctggcaccgctactctctccagcctggtctctcactagccccctcaagcctggggctgtagcctttccaagccattggcagccaaaggacccccttccccagctgctgtgtgtggccctggccatgctccttgtctgtaaggccattctaacacctcgcctcctgccagcccctacgcccagtttattccatgtcaggaggtatggcctccatcccctgatggcccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccancaccagctctggagaaaacacggacagaaagacgtatgcccaccattcactcattcgcaagccgggagaacttacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagaccacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctactt

SEQ ID NO: 241044 - DNA, 2799 bp, Homo sapiens
  misc_feature (535)..(535): n is a, c, g, or t
tctgacgctctcacccaccccacccaagatcagacacagccaggaaaggacccaagagaaaatccttcaaggtggcctgaggtcccatccctccctcagacccatgtggtcccaggccaggctgcctgggacacagtaaataccactgtgtgcaaaaatcgaagtacaaaaccacaagactaaacaaaacaaacccagagagcggccgctctccacccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccancaccagctctggagaaaacacggacagaaagacgtatgcccaccattcactcattcgcaagccgggagaacttacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagaccacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctactt

SEQ ID NO: 241045 - DNA, 335 bp, Homo sapiens
gtaatctaacaagtgagtaattcgagatagtgatgagttatgaagaacatataatggagcattgggatagaaagtacactgagaatggggctgctttacataagttgttcttaagagatgatgcttgagctgagccatgaataatgacagttgcaagaaaatttagtggaagaccatgtcagacaaaggaaaagcaagtttaaaggccgaacaatggaaatgagcttggtttatatggggacatggcatcctttcaacccattagatatttgctgattcacaatgaccagtcaaaaaactgaaaagataattggagtttttagccttctgaaata

SEQ ID NO: 241046 - DNA, 325 bp, Homo sapiens
gtatgtgtctgaaagtgaattaatatctaggaagggatgaaggcaggtactgctctctgcagagacttcccgcctgaaatgccatagccccagacattggagctgtccaaaaccttggcttgtggagaatttccagaagggggcactgtggacacggttcagcatctgcctcccaaggctggggctccatgtcaaaagaaggtgagacgaccaggcacagcggtcactcctgtaatcctagcactttgggaagccacaaaaggatcacttgaggccaggggttcaagaccacctgggcaacatagcaagagcttctctctacaaa

SEQ ID NO: 241047 - DNA, 467 bp, Homo sapiens
tgcaacaaatatttattgatggccaactgagagtgggcagtatcctcagttccaaaactacaaaggctgaatgcagttgcacataggcaatgggtactgaaaccatcaattacacaaagttataaagtacgtatgggaactcacaaacaggatatttaggagaaggaggtggtgggaagctttcaagacagagaattgaatgttcataagtgtgacatattcagaaattaatttttaaagtaaatttcctcaaatctaatctaaattttaattctgaattcttcaagctgacccttgccaccattgataatagtgtgataaccataaatcccatatttctgatcattcccagttttgagtattctgtctctttgtcaagtcacatgtcccaattttagggctagaaaacatggtcatcacgttgattagaaatgcaatttacagaagatttccctttccgtctgctt

SEQ ID NO: 241048 - DNA, 733 bp, Homo sapiens
agtgcaaaatgttaccaaatctttcctcctgtgttttcaaaaaaccacatttgatgctttctattttatatgcttttacagaaattctctttaaaaatcaaatatatgcttatcattattttaataaaaacctctgctgagtaaatgaattttataggattgggggaaaaagtttgcaatgaatggtggatgatactgctattcaatagggagctcttaaaaatagagcaaatgcataagacattttttacagttttcaatttgtaagaaaatgatttcattagaggggaaaaaagagagagagaaaaccatcagtcaggatgtgggagaatgcaggctcctgatgagaccagcggagaagacaaactaagtgtatggatgcagattaggcctcagaagatgagggtgtaaaagggatttaatggtggggtggattatagaaatccatgtaacaatgttaaataattatagttccagccgagatcaaagcagtgctgattgaacgccctcaagctgttaacatgaagtatcttgaagggaaaaaaacctgcctcaaagattggtcagtctgggcaaacaatgtctgtgatctgtagaagttccaactgtattgaaagcaccaattctagggaatgaaaaatggaggaggcagcctgttagggaatttcttcttctggagctctcgatcttaaaacggactttttagctatttgtagtttgtttgaaaatgcta

SEQ ID NO: 241049 - DNA, 565 bp, Homo sapiens
tgcagccataccagccgaccggcgggggacacacggcgcctcggcccgactcggaggcccttcccgtcggcgccggggcagcgcgcgcccggtgactcacccccgccgccctctccccacccctgctccccgccccgccggcccgcgcggcctcccagcccccaccccaggccacctgccccgccacccgtgcagtctcccctctcgccccgccccctcatctcaggccgctcctcccgggatttttccaccctggggtaggggtgcggtgggccaggggtcaggagatggcgggcggggagcgccgccacgtgcccgggtgcggccccgcccgagcccgccagtgactcagccgcgcggctgtcgaggaacacggactcgaggggcgtcggggactgtgggattcggcgtggacgccagggatgcgcgccgcgctcgggaggagagagaaaaccaaccccctttccgcccgggccgcgctcggtgaccccttgcccctagcccaggctccggaagccgcccagccctcggcggcgggtcggaggaggcggtttcaccgcggccg

SEQ ID NO: 241050 - DNA, 483 bp, Homo sapiens
cagcatacgttccagaagagcatctcaagttaccaaattttttgtaatccttttactagaaaaatcttttttgaagagtttttcttgtgcttgcttcggcagcatatatactgaaattagaaaaagaaaacttttcttttttattatatattttagtgtaagttaagttaaacttctaaaagttgaattatttaatgtaggacttcataaatagtatttgacaatgataaatgtgtatttttgagaatcattaaaatgtatacaatgatattcctttgcagaagtcttaatatgcataatttttaatctaattgtcttctaaatatagttttggtgtatgctggtattttagaagccaccaatttctggactatctgattattaacaaagatgtattttaatgcacaaactcaaatgtttaaaatatatatttactttgtactcaaataaaatcccctattgcaaatcctatacatatttcaa

SEQ ID NO: 241051 - DNA, 614 bp, Homo sapiens
cacagtacattacaatcctggtttttaaaaaagtgaattaaactgacaatttatagttgtgtatttatatagaatgtctttatatgtgttacacaaatacaaaacttgttatttaaatagtaactgctaacatgcacataagttactatgtctgaaaatggtgttctgtaaacaagagatgaatagtctttgtcaagaataattgtgtgcatttttgttatctgatttcctatctgcattttcagtttttaacattataaaaaagaattagtaatatgcaacaatttcttagttctctaagcattgctattattctcctctggaaagtatattcatattagaatttttgaaattgttcttcagatgacaggctatgatattttttccctttaggattaataatcacataattcaggaatttaattcactattaagtgaatattaagttcccttacgtttcatcaatatttgtcataaggtaaattaagtatcagcccccttgtctcttgatctttcacatcctcttctgtacaccacaatctacaatacctgtgttgcttttaaaatatatctatgaaacttagatacttttcccttcaaggggtgcagcttaa

SEQ ID NO: 241052 - DNA, 414 bp, Homo sapiens
ttttaatgttaatgctggtcaattgtgcctaaatttcaaagggaggagggtataaatgagacatgtccaacctcctcttcccatcatagccttaactagatattcgggtttactttgaaatgctcctctccaagaggaggggtccagttcagttgcttgaggggcttagaattacatttttggcttatagtctccaataaatgctgttgagaaaatgggatatccacgtacagaagaatgaaattagacccttatttcttaccatatacaaaaattaactcaaaatcaattaaatacttaaatatgagaactgacactatgaaactgctgaagaaaacataggtgaggcgcttcaggacattggtacgggcaaggctttttgaataagatctcaaaagcacaggcaacaaaagc

SEQ ID NO: 241053 - DNA, 671 bp, Homo sapiens
cgggtaggactggacggtcggatttgtaggcaattctgacaccgagctcccgggctcggttggtagaagatcgctttgggaatcctcctactctacgaggaccaaaaaccaaggacgccaagccatacaaattcagcacagctgactcagagaggtggaaaggaaatcaggacaaaaagccaaaatgtcttctggaggaggatattgccagccagaataactgtgagagatgcaagcatagtcctggaaacaaacagcacaattcctttaaagccctaaaggatgaagatcttcctgtagagaagtatttaatggaaaggcagcctgtaggtgagccagctgccgaccaggtagctatggatgtgatgcacagccccatcctccaactggaaaggaaacacaaagtctcaagtgacagcaaccagacagagactactgcagagaagttgccagaggactctttcctaaaaaacaagcaaaaacaggtttatatagggctacatcctaagaaacaccatttgatgcaccttagagaacagtaggagcagcaggtgttggcagcagagaacaaacctagtctgcaaggcaggaaggaagtgacccagacagtccagcctgaggtcactgcctgggattgtgatatcatgaaagagaaactcagcaagaaaagg

SEQ ID NO: 241054 - DNA, 883 bp, Homo sapiens
cgggtaggactggacggtcggatttgtaggcaattctgacaccgagctcccgggctcggttggtagaagatcgctttgggaatcctcctactctacgaggaccaaaaaccaaggacgccaagccatacaaattcagcacagctgactcagagaggtggaaaggaaatcaggacaaaaagccaaaatgtcttctggaggaggatattgccagccagaataactgtgagagatgcaagcatagtcctggaaacaaacagcacaattcctttaaagccctaaaggatgaagatcttcctgtagagaagtatttaatggaaaggcagcctgtaggtgagccagctgccgaccaggtagctatggatgtgatgcacagccccatcctccaactggaaaggaaacacaaagtctcaagtgacagcaaccagacagagactactgcagagaagttgccagaggactctttcctaaaaaacaagcaaaaacaggtttatataggccctccaccgaagaataaggttttatccaacaatgcaagcagccaaaagccgactcactcaagtgcagaaatacaccaataacagtgagaagccatctgggaagagacaatgcaaaaccaagcacttgatatctcaggacctgaggcaggggttcctgctaacagggaagtgctacgttgagaatgctgatggcaagatacctcttggcacttgttttctccttgggcttatatagaggctatttcccctcaccccaacattccccacctacctgcttttctcaaggatgtaaagcctttcttttactggactcctaacttccctgtcttagaggggaagtcttccttgatggtgataaaattggaaactattaaaatttaagttca

SEQ ID NO: 241055 - DNA, 464 bp, Homo sapiens
agcctcaaaggacgcagcgccttctccattttttttttcccatttgctgagtgagaagtgaactgtctgggcctgggctgcatcttgctaggtgttcagaaagtgcaggcaagttcgacctgaatccgaggctgggtagcagcgtgatagacagccgaggccacagccagcccagctcgcctgcttagccatccataccgtctacctcccttccaggcttgcaccagccagaggcagtgttgagtacgcagcatgggcacatcagcccaggaggatatgagaagccaatggcggagaggaggggagcactgctgatgggcagagcagggtgtgcgtgggccagaggactcttgtggtaatggtacgatccacggagagactcaccagctctccggtgggaatacatggcagtttccacggtctttttattttcattttttattaatacataataattgtacatc

SEQ ID NO: 241056 - DNA, 452 bp, Homo sapiens
gtttttgtttgcctatcataagaataagtgttaaaaataatttagaaaataaggtatttataatagtatcagcatgttcacccaaccactgttaatatttttgtgtattttttccctttacttggtggctactattttttaatgtttttatcatatttgtaattctccggtatgtaaaattatgtattctgctttttttccacttctgtaatatttagggtttttttttacttcagcctcctcctacctagatattttttcattattacacactgtcatttaactattctcctatagtggacctaaaagtttgagacacttgtggtggagaaggaatttttacttgttttttgatcttgagtaatgcagcatgcaaatagtgtgatgcgcattgctttctttcttgggattgtcactttaagagagactcctagaattacatttaggagatc

SEQ ID NO: 241057 - DNA, 394 bp, Homo sapiens
gtcaatgtctccggcagtcaaagcagttatcaagaaagaaccaagttgggcgcaccatctggagaaatcctctggagaaggtttatgttactacatatttttctgtttgcttgtttgcttaggtatttgttattttttttgttctttaaatgtagcagttctgaatttctcaactttaaaggactatgttacttagaaggacttcctttaaaactgagttaggtttcttaatattgtatacattacttaggtcatgtgattagctgctttagacatatgatttgagattctctaagttcccttcattcaaactacttcacagaggcagaagccaggaaggcaagaaggcaggaagacaggaaggtaggaaggcaaacaggcaaaagggaaagga

SEQ ID NO: 241058 - DNA, 284 bp, Homo sapiens
gtagagacaggatttcatcatgttgtccagtctggtcttgaacttctgggctcaagctatctgccctccttggcctcctgaagtgctgggattacaggcatgagccactacgcctggccccaatttttagttttacttcctaaaaatccttcttgcccatactcacttgattgtcttccactttaagttcagaatcatacttctcatctagagcagtgctatggtctgttgacttgtctccctgcctttgacatcccgcattcacctcccttccactcttacac

SEQ ID NO: 241059 - DNA, 400 bp, Homo sapiens
acaggccacacacctgctgggccagggacagggctctgtgtgcccatggccacagcagcagcccttctggacagacccaagccaagctcctgggtagagcatcatcatcactggggtcatcctgggaaagggaaagttttccagaatcacaaatgcttctcacacaaacctcagcagagccccgagcagttggacacactttgcattgtctataaggacagcaaagggcccatggccgctgaccaggatggaggagtcagtgcctcatctcaacgcaccatcctcactctacaggccatgaggtccaggagaggcaggcaatgaaatcctctcttacctttttgtaccacggtatgatgaaaaacaagagaaaataaaggctactagaagagattaagag

SEQ ID NO: 241060 - DNA, 211 bp, Homo sapiens
gtccatataccccgatatattttcaattttttttaaagtaatacattttatgtagtcagaaaagaactttaaaaatcagctaatgggccggacacgatggctcaagcctgtaatcccagcactttgggaggccgcgacgggtggatcatgaggtcaggagatcgagaccatcctggccaacatggggaaaccccgtctctactaaagatac

SEQ ID NO: 241061 - DNA, 423 bp, Homo sapiens
gtatgtggccccgtctggctagtcctgtctagcgcgcccatttcgagcccaagtttccagctcgggtttccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctactgtgagggccatttctccctttcccagtgggatcccatgattactacattacctggcttgtacctggtgtcagttggagtggtcaaacctgccatttggatctttgcatggtctgaacatgttgtctgctccattgggatgctcagatttgttaa

SEQ ID NO: 241062 - DNA, 501 bp, Homo sapiens
gacaatctcactctgttgcccaggctggagtgcagtggcgaggtaactcactgcaacctgcacctccagtttcaagtgattcttgtgcctcatccctgagtagctgaggcaggagaatcacttgaacccgggaggcagagattgcagtgagccgagatgcaccactgcactccagcttgggcaacaaaagtgaaactctctcaaaaaaaaaaaaaaagaacaaacaaaagaactagtccatatctaggtaacagtgtttgcatattggaaccaatcagtaccaatcaatcatttaaacgcttccttaacttaggcaggtcccttctgtaattaaaaaataataaaacaaaacagacataaacctttggacggctgttatttcatcctccaaagaaataaatttgtcatttggtcaatctagtaaatcagttgatatatgtgagggatgctgatcattataagttctatttaactcttctaaattgaatataaatcatagag

SEQ ID NO: 241063 - DNA, 546 bp, Homo sapiens
tgttttggtaatctggtttgaatctatcaaagatttaaaaacctttgtattcctaccatgctagattcaaaacaacacatgacactttttctctcgtgtgggtttccaggccatgatagcgacaggtctgcgggacgctggcgcccggcccgagcgtcgttgtcactccaagtccacagcctctagagccaaggcaagggacctcaccaggaagggagattcgccccctgtgcccctgggacgtccgagcggaacccatcggcccggctcccggagactcgcggggaggaagggctgtcaggccaggcgcgcatcacgtgaagctgccagttccgggatcaaagacgtaccccgcacgtgggctgggcgccagcctgggacccccgggggccgcgcgcccaccgcccaggagcccaccccagcctccactgggaaaattagcccggagccaacgtgtcgcggatcccacagccgcctggagccctcccaaagccccgcgcccaggcctccccgggcacaggcggcgcccccttcggccgcggccgc

SEQ ID NO: 241064 - DNA, 1011 bp, Homo sapiens
taatcttagaaaaatgttggaagggtaatttttaagtgtagtggtttgaagaacaaaccagaagcgcacaaacctttgtgtattttagaatatatttgtcttcattctgcggagctcttgtgttgtaaaggtgcagaactacgtaaaaatagtgttgggcagacttacatagtacatctgaaatcagatactggtttattcgaccatatttctaagggcatttttccagtaaaattgttttattttttgagtagccttcctatagtggtacatgttacatcagttgcgcatatcttgattttacagaatctgtcttaagtaccaattttggtttttcaaatcaatgtttctgaaatttttgaacactgaaagtggttttaaatgaatattctgaatctagttctttagaatcctctttgaattgtgaaatgcaaaataattgttagcagtttaacctgaaagatctttttacatgataaatgggggaggagaaagactgaaatgaaaatgttgaagaccctgatttgaaattgagtgtaaaggtctagatactgtaagttttagagtagctttagagacaaagctagtatcccacttggtgagatcaagtaacttgtggtttaaaatttaaagtaaccagtggccattttaacttcactaatttctcttggaggagctaatttttaattgctcatgattgtaaaacatacttccggatggtaagggagatgttaagatgatttgtcttgaagaatggtaaactttttctttgtttattgcctgtcataaaaagagggaaagtaaaaaaaaaaaggttcataatcttaaatcagtccaaaaatttgaattttctgtatttctgtttaattcaatgcgttaatctttagcattggtcaatacagccaaaagatgaggaaaacaaagactgatagatactaagataagaaataactgcaaccataaatgtatacaggttatgtgtccatgagccatctcttcagtttgcccata

SEQ ID NO: 241065 - DNA, 478 bp, Homo sapiens
ttttttttttactttaaagtagttactataaagtattaatagaggatagaagtaagagggaaaaggagatatatcttagaagactatttcctgaggactgagaataatcaaggttctttttctacctttaacttaacacttgatgtctcttgacttcatttttagcatgtgaaaaatgaaaagagtgaacgagatgatatgaaatgtttcttccagttcagtcattgtataattttgtaaatgctcctgatattggcctgctaatagaaaccttcccattgtaggaaataaagtactttgtagggcaaaattataaaggcataataattatttacttaaaaatttccccaaggcacttgctcatgtggtttttcttaaatgctctcgtatataatttgtaaaacaagatgttcacgtagaacactgcagttgcctttacataaaatgctctataatctgtgtcatgggattagagtca

SEQ ID NO: 241066 - DNA, 516 bp, Homo sapiens
caatatctaaaaataaattcacctgatattctcaatagaaaaaatggtaatgcagagaaaaatgtatgaaaatatggcaatttgaagaagagagaagagatcaataaaataaataagtatatccttggagacctgtggatgttttttgaaaagtgaatcatgtaagtaattgaagtcccagaagaaaagaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctgaaataaaataaatgttgattaaaaaattctatagct

SEQ ID NO: 241067 - DNA, 423 bp, Homo sapiens
gaagcagcaaatgtgtccatctgcaaactctggaaattcttcctgattcctgaatttaaaggaaatgtgaagactggtaatatgagtcccatgatcaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctgaaataaaataaatgttgattaaaaaattctatagct

SEQ ID NO: 241068 - DNA, 471 bp, Homo sapiens
ggagctgccacccagcccaggtagtaagactggcaggaagagagcaggacgccgccgcccgagtcccccagctcagccaggtgcgggcgggaggagccccgtccttgcttagccccgcgctggaagcgccgtccgagacactgcacggggcagactggtgggtgtcccggccctggcaccgcggggttgccctagccaaccggagcccagctcccccacgcgggccggacgtttccccagacgttgcgaagtccgactctggttcacagatgccgacctggtcggtctatgcggaccacccttttctccaacgtgaccgccgactattggaagttttttgtgatctgtcaggccctgatggcttaaggaacatagccagatcttcccgagtccgaggctcgttatggttgtccactgatgatctgccatttcgtttatgttacagaataaacagggaaagtgtttgtagtc

SEQ ID NO: 241069 - DNA, 411 bp, Homo sapiens
cgggcctgccacgcccgggacgcacaaatgcttctgggtctgcagaggagcaagctgctggcccacgaggcccttctccccggggcagatggatttcaggcgccccccaccccttgaggagaatatcaaggaaatggacagaagagtatattgcaactatcatctctgcccttggcctcgtgagggtcgctgggctgggacaaagtcctgcctgggcagttgacatcaaaattcgtcgtgccttgcctgctttatgtgggcaaaaggatgaaagaattgcacttctgttgcgcttccactgctagatcataagctccctgaaaacacgttgcatctgtgtctctagcaacttccacaaatgtttggagaataaattaatgtgtggcagggcgcggtccctgtgaactctaa

SEQ ID NO: 241070 - DNA, 416 bp, Homo sapiens
cccggggatgaaggttaacatcgctaacgtaggggcagccatggtcatgcgtcttctcatgtgtgcactgggaaggacaaagtgccacctctgtggcattcctgccaaaaaatacatcatgtgaatttaatcgtgaagttgaaaaatcatgtcaagggcatcctacaaagtaactggctttactctgtttttttttttaagacaaaatccatgatcaagaggcccacataaagactgtgaaagtgattaggtttaagacagaccaagaagatgcatcagtcaatggaccatgtaatcctgtattggattttagagaggggaagagaaaactttggggacaattgatgaaatctgaatatgggctgtggattacataatggcattatatcaatattaaattgtttgactctgaaaac

SEQ ID NO: 241071 - DNA, 332 bp, Homo sapiens
cgtcttaggtgctgtgcacggagctcgactatcctgaatccaccatgattcgacctcatgtcagtcctttggctgccagcccagttcaactccaagctgatgaccagtgtcgaccgccagtcattctgaacatttgaccagttgagctttcaaatgatggcagtcctggctgacattttgggtgaacaatatgagagactgactggttgagcccttcccaaatttctgacccacaacattgtgagaaaaataatcttaagcctctcagtttggggacaatttgttactcagcaatagaaatgaaaatatgatctcagtaggaccatgtgact

SEQ ID NO: 241072 - DNA, 370 bp, Homo sapiens
ggagatggagtttctctttgtcacccaggctggagtgcagtggcgagaccttggctcactgcaacctccacctcccaggttcaagcgattctcctgcctcggcctcctgaatagctgggattacaggcgcccaccaccatgcccggctaattttttgtatttttagtagagacggggttttgccatgttgggcaggctggtctcaaactcctgacctcgtgctccaccgccctttgcctcccaaagtgttggaattacaggcgtgagccaccgtgcccggccgtcacttttaaagggaggtcttttctgaactctggactctgtcagttcacctgtcacatgttcctgggtccccttccattactctctc

SEQ ID NO: 241073 - DNA, 521 bp, Homo sapiens
tcgtgtctggctcggtcgtgtctgggtggatttctttcggtgggtttcgatattgttcttttttcaaagtaagtatttgatatgtttaagagggcggaaattacgaaatggaggcagaatgagatcaaaagctattgagttggcaaagacgtgttgaataaagtgataaatgacaggtactggaataatacattcaaataacttgcagatctgcccgggcggatttcaaagcggtggtgtaacaggcacaaacacgttaagcattaacaactatctctcgcccactccccctccccccggacaagccatttgatgttctagtttgcaattactccacgcaaagtggacgtcctcctgcgcgatctttgggggtgtgtgggacgggggcgggggaggggagggcagaggggtgtgtgctcgcccactggccctgcgggtccagcgttctccgtgcccagacggcgctcccggggagggcggggaggggacagagcctccccggcacgtttctgggcggccgc

SEQ ID NO: 241074 - DNA, 417 bp, Homo sapiens
agtaggtcaaggctgcagttagccataattgtaccactgcactccagcctgggggacagagggagactctgtctctaaaataaattaataaaataaaaataattgtggttggtaaaataagaaagagcagatcaccgaagtcaagtgaagaaattgtttaagagaaaggaagccatccattgtgttaaatactgctgggaggttgtagtggcctgaataaatctctaaagtatcgggtcctaatccttagaatccataaatgttaattataaggaaaaaggatgtttgcagatgtgattaagttaaagctctggatatggaacagttattctagattatcctggggggtggggtgggggcgcctaaatccagtcctaagtatcctcataagagaggacagagggagatgacaaaagg

SEQ ID NO: 241075 - DNA, 469 bp, Homo sapiens
agagtcaggtcaggtgggtgggcgagaggaccagtgtggccaggctgcggaagccagcacaggagacaagggcgggtgctgtgcattacagaggctgctgggggcttgtccatagagcagcagggggcacggaagggcttggggacgcagacacgatcagacttgcatttcatcaggcactctttagctgcctgctgggtggctgggctgtgtgagatgaccctgctttgaccaggttaggaattatgactggtttccagagagaacattggttagtaattggctatggggaagagggggcgttgagccaaccaactggggtccccctgaagtgccagcaaagtgtctggttttctccaggatctgtttcctcagtccctggcaggattggctcccctgcacgccatgtccttgtggtcccttccagacagaaaccaggcatgaataaagtgaataatgacaagcaaaa

SEQ ID NO: 241076 - DNA, 280 bp, Homo sapiens
ttgataaagtgggctaatttaactgtatctgagagaaagaggggacaactggtccaggggactgtcacccaaggattggtgggaaggggagagcaaactgcaaggaagggctccacataaggattcactgtggtcccagaagaaggaaatgaagacttagttggaaaagggcaagttataccttagcctattgaacaggtgtcttgactatttttagacaaacatttgctattattataacttaccttttaaataaacagttgtattattgctaaactag

SEQ ID NO: 241077 - DNA, 512 bp, Homo sapiens
ttttttttttaattagccagccatgatagtgaatgcctgtagtcctagctactcatgaggctgaggcaggaggattgcttgagcgcaggagtttgaggctgcggtgctatgattgtaccaggagtttgaagctggagtactatgattgtaccactgcactccagcccggatgacagcaaaattctgtctcttaaaaaaaaatcaatactggccgggcgcggtggctcccgcctgtagtctcagcactttgggtggccgaggtgggtggatcacgaggtcaggagattgagaccatcctggctaacacagacaaaccccatctctactaaaaatacaaaaaattagccagacgtggtggtgggcgcctgtagtcccagctactcgggaggctgaggcaggagtatggcgtgaacccagaaggcagaggttgcagtgagctgggatcatgcccctgcactccagcctgggtgacagagcgagactccatctcgaaaaaaaaataataataaaac

SEQ ID NO: 241078 - DNA, 320 bp, Homo sapiens
aggtggcatccttgattagctaagtttttgtggatcttgttttgaaaccgggacacttctccctccttcactcagttttatttccttcctagcagttactccttccagaattatcttgtcattattttgcttgtggttggagggaccatccctcactctgcttcatcctggcagagatttttacctgatttgtacccagcacctccttgaaccatgcctggcatctatagaagctcaataaatggggtctccctctgttaccgagcctggagtacagtggtgaaatcctagcttactgcagcctggaacttctgggatca

SEQ ID NO: 241079 - DNA, 319 bp, Homo sapiens
tctctgtgcctcattttttttcatccataaaatggagttggctaattgagggatctcaggcctgtaatcccagcactttgggaggccaaggcgggaggactgcttgaagccaagagttcgaggccagcctaggcaatgtagtgagacccagtctctacaaaaagtagccaggcatgatggtgcatgcctgtggtcccagctactcaggaggcagaggcaggaggattgcttgagcccaggagttccagagtgcagtgagttatgattgtgctactgcattccatcctggaggacagggtgagaccttggctctttaaaa

SEQ ID NO: 241080 - DNA, 295 bp, Homo sapiens
gtcaccagagctcataaaagatgtgtgtgctgtcgcatctatgtgaagtatttccatgacccgagcattgaccacaggactgtgctggaggaaactggatcaaggtaccaagacagatacaggagggtctccagaaaccctagagctgaatggaacccgtctggaaaacatacactggaaactaggccgaggattatccaaagggtggttgaaatcaagggttaaagtttggctcaagataaggaagaatcttctaataattaaaactgaccatccaaaaggtaatgggatgctc

SEQ ID NO: 241081 - DNA, 476 bp, Homo sapiens
taatgaaatcattatctattcaacacttgctaattaagcttccattatggatcctgtcagatatggggcaggcagtaattagataaaaatcccaccctggaggtgttcattttataatggagtagaaagatacataaacaagcaattaaaagagacatttctctgtagtgccagatgacacacagaagagtaagtggtcagttgattctttcagggaaaaaaatagaacacaggattgaggaaagttctacagtgggatattcaaagtagggtttgaagagtgagtaggtgttcagcagatgatgtagatgtagccagaaaagtgcttatttagtgctttagtatgttcgagacctggtggtagtactttacacatattacctcatttaatcttcctgagtctgaggaatgggtctccttttgttgggtgtggaaacagttaaatggcaaggtcactgattacagagacaggatta

SEQ ID NO: 241082 - DNA, 1241 bp, Homo sapiens
ggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 241083 - DNA, 680 bp, Homo sapiens
ggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 241084 - DNA, 949 bp, Homo sapiens
ggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 241085 - DNA, 918 bp, Homo sapiens
ggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 241086 - DNA, 408 bp, Homo sapiens
cgttggtttcaccaggttatttattaaaaacacaggacctagggccagattaggagggctcaaatcctagttcttcttataagctgtgtgatcatgggcaagttattaattctgtgactcagttgtttcatccattggtatggtttggctgtgtcctcacccaaatctcttcttgaattgtaactcccataattcccaagtgtcatgtcccataattcccacatgtcacagcccccacacagagtccctagcagggcactacctagtggagctgtgagaagagggccactgtccttcagacagcagaatgctagatccgacagcttgcaccgtgtgcctggaaaagccacaaacactcgacaccagctcacaaaagcagccagaagggagactatactctgcagagcc

SEQ ID NO: 241087 - DNA, 485 bp, Homo sapiens
tgtggtgagctggctcgcagcaagcccagatcaagtgttagtgagacggtgactctaggtgtgaagcaagtactgcaagtggcccagctgcccagcagggctccagagtttcttctgctgccacagttctcaaaataaatacttcagtatcaaccaggacttaaagcaataggaaaagttgcctgtttattccagatggccctagtaagccaaccgtcttttctgtgcctgcataccacactccagacctcagcaaagatacagcatctgctttgggctgttgagggacgcatcaagtaacctacgagaaaatgctctgagaagagtgaaataccgcacagtggaagtgtgcagggactggaggctcaatgaagaggatacagctatgtccacatcatgtcaactctcactgattgtagagctgttctcccacccaactcagtcctctctccctctacccctaacaggaacatttaactctgaaa

SEQ ID NO: 241088 - DNA, 354 bp, Homo sapiens
cagatgaatggataaagaaaatgtggtacatagacacaacagagcattattggttgttgtggtgatgaaagaagataacataaaaacagaaaaatggcgaagagcacagattccacagcctaatgtcctgagtttaaattcctactctgccatttaccaggctggaagtccaaggtgaagatgttggcagggttggctccttctgaggctgtgaggaaaggatctgttccagacctctctcctttactttgtggatggccgccttgtccctgtgtcctcacctaatcttccctctgtacgtgtgtccaaatttcctctttttataaagatgccactcatattagatttggccca

SEQ ID NO: 241089 - DNA, 552 bp, Homo sapiens
tatccaaaagtgtacattcttattttaccaggttttggaataatctcacatattgctacctattattctggaaaaaaaagaaccatttgattatatagaaataatatgacccataatatcaatttagctcataagctttatcgtatgaggctatatttacagcacggatagacattgatacctgaatgtattttacactagctactataattattgctattccaacaggagttaaagtatttaactgactagcaaccctacatggaggtaatactaaatgatctccagctatattatcaggtttaggctttattttcctgctgacagttggaggcctaacaggaactgttctaactcatcagcagacatcaatcctcatgatatatactgtgctacagcacatttctaacatgttctatcaatagctgcagtcttcaccatcacaggatttattcactgattcccatattttcaggttatacactcaacctgagccaaaatccattttgtatttgtaggtgttagcttgactttctttccacaacattttct

SEQ ID NO: 241090 - DNA, 435 bp, Homo sapiens
taactactgaaactacttagtttagttagagattacaaatggaattatcagcatattcttcactattttgcctattttacccataaaaacacaaaaagaacctttttattatgaaaaattttagctagctgcagtacttcacgcactcccagcaatttgggagactaaagcaagaggactgctttgagcccaggtatttgagaccagcctgggcaacaaagaaaaactctgtctcaaaataaataaataaataaataaataaataaattttaaaaatttaattagctgggcgaggtggcacatgcctgtggtcccagctacttgggaggctgaggtgggaggatcctttgagcccagaaggtcaaggcttcagtgagccatgattgcatcactgcactccagcctcagggacagcctgaccttgtctcaaaaaaa

SEQ ID NO: 241091 - DNA, 395 bp, Homo sapiens
atggtacccacatatttcaagatgaagttcaaattcttgagtttggcatacaagtaagatgaggcttctgttgcctcttaagcttcatgtctcttgttaggtcctccagagcctttcaatacaaccataaggaaggatcaatggttgctcaaatatgtcatggcctctctgccttcttccaagctgcttcctgtttcctgaatgctctctactgtgttggacactgtcccctaaaattcaggtccacctagaaccggtgaatgtaattttatttgaaaataggtttttgcagatataatcaagttaggacaaagtcatacagggttagggtgggccctaaatccaatatgatgggtgtccttataagaaagaaattaggacatagacacagacac

SEQ ID NO: 241092 - DNA, 656 bp, Homo sapiens
gcagggcaggtgaaacagacagacgagcctgctgcagacattctgaaggtaccactgattgagagattactgtgtgccagtcactatgctaacagctttatatgccagatgccatttaagcccctctcctgccctgggagaggagtgtgacctcccttcacctgagtacctgagaatcagaaagtgttaaggctgcccaggactcaaggtctgggtttcaccctctgtttatgctgttatgctgctcctagccatttaagacacacatggggatggaagggaagcctgtagggaaagctttggagaggtgaggacctcactcgcatatgaacctcacatacaacccccacagcctgaaatccgttcgttctcttcctgccacttctgagttgcatgaacaaatctcttaacttctctgagcctcagtccctcacctgtgaaattgattcagctgtagttcttacccctaggcatgtggagaggattcaatgaggtgaggcgtgaaagggtcataccatggtgctaggccgccactgtatatgagcagccgccattgtgttctacaatggaggtccctgttgatggcaggcagagacactcatctggttggccatatgcccagtggatggagctgtggcccctcctaatgctcttca

SEQ ID NO: 241093 - DNA, 372 bp, Homo sapiens
cagaagtccagtgtgtattttgttcccttattatttttgacagcgtctcagaaattttctttttaatagatataaaaatgaaattgtgagtccttggtttactttcttttaattttcttctttttatagttaatataccatctattctatctggcctttttgttgttttgtaaccaatactttaaatttttttcagtaggaatgacttgtgtcacttgaactagaattcctatatttgatggctagggataacacttaccttgtttactgttatactcccagtagttacataactctcattttagggaagtcatttaatttctctgacatttacattcctcctctgtaggctgggcgtggtggctcatacct

SEQ ID NO: 241094 - DNA, 317 bp, Homo sapiens
  misc_feature (14)..(14): n is a, c, g, or t
  misc_feature (58)..(58): n is a, c, g, or t
  misc_feature (89)..(89): n is a, c, g, or t
ggaattcggcacgngaagttaatcattgaaagacacaaccagcgtatcctctggaacnttgaaaataaagataaaacatagtataaatnatgtgttgtttttctttagtcctaagcacagagcaattttgtattagattacaaaatgtctgatgtctcttcaaattcccttcccaaatattttcctcagaagagatgttatctttttcctttccatcagaagaagcgaggcgagtaaccttaacctaacatttgaatgtatttgtcccaaatatattctttaacttcacttcctgaataagattttcctcctgctct

SEQ ID NO: 241095 - DNA, 104 bp, Homo sapiens
tgtgacacattgttactcttacatgttagttgtttaacacctacatgggctcttgcctcagctaaacagtgagttctcaaagatcacattcatgattagcagcc

SEQ ID NO: 241096 - DNA, 321 bp, Homo sapiens
aaactattaattagctttactactctggatttcttggaaagttttcttaaaattactagtgtgtttagtcttccgcggatttttttttaaacaggaattttcctgtttttttaaatttaaaattagaatagttattagctaagtttgttataaatgaataaaattattagagtcatcttggttttgtcaatttcaaaataaaaattcatttatacaaaatttgtgtatatcatccgtccttgggatcattacttgctggatgcattatggcagaaatacactattctcttgactgcttcatttattgttttaaaggacaaa

SEQ ID NO: 241097 - DNA, 481 bp, Homo sapiens
cagtgttctcccaaactcgttttaagcctccccttcactcctctcagatcactaaggagacgggcgtcactctgactgtagacaaaactgtcaattccctatgccactgcttccctgacttcagaccaaagtaagcaaatcgtttggacattgtggtgcagtaatcagataatttggctaaacccagacttgtgttcaaattatcagaactgatacctcaagtctctacttgattctccaaatgcagttgtgcgttctgtctccctttccccctccctcacactctccccgcttgctcattgcctctggtctcttctttgccccctctttcccccatgtacacaatcctttgttttacagataaagtggggctccagtcatttccttccagaaagaaaccattttccagatcccagctgatctagactttgggctgctaattaatggaagttactgaataaataaaatacaacaaatttgc

SEQ ID NO: 241098 - DNA, 478 bp, Homo sapiens
aactttcaaagctgtgcattattctatacacagggtgttcctgtccaacttggcttccataagaacttcaatcaaattcacagaccacattcaaatttgtcaattgtcctaataatagctattataggttcaggatcatacataatgtgtagttgtcatctctctttagttttcttcaacctggaccagttcctgagtcttaccttatttttatgatcttgacatttttaaaaagagcaggttactcactttgtagaaagtccatcaatttgggtttgtttagtatttcttcataattacatgtaagttatacaatttttggccgaattgtataaaaagtgatgctatgttctaatggcatcctatcaggacatatacaatatccatttatcctatgctgttttaacttttataagataatgtctgactcctctattgtaaaattaactattaaatatttggtattaatatgtagtct

SEQ ID NO: 241099 - DNA, 505 bp, Homo sapiens
gtgaataatttaactagttttccagtgtgataaaactgatctagtccaatctctcaccttatgtagacattccttctatgggatatatttccatgggtcccatctgggagtaaagagcacactgttggggtgtgtctgtctgtatgtgtgtgtgtttcatccaacaagtatttattgattggctactatgtgctaggctaaggacacagtgataaaaagacacattccctgcccttactgactttctaatggaaattttgctagcagcaaatgaagtctctaaacttttttcctgtcctctctttattctcaaagttcttttgaaagaaatgcagaatagtgggaagaaataaagaacaatgagagttaaacttctactaaaaatgcccacttttagtttgtaggggttttaaattcagaccagttcagttcaacaaacactgctgagcatctctagcccttggctagatcctgagcaataaaagcaataaaataaaattattat

SEQ ID NO: 241100 - DNA, 448 bp, Homo sapiens
gctcaggatttagggggattgggagccctgtgcccacctgccagctcccatttactcacaccaccctgcaggctggaggcttagccacttctcaggaggagcctagaaaggatattggtcgcccagctgctgaacctgccccagcatccttgagggtcttgaaaatctattttatgctgggcacctgtaatcccagaaatttgggaggccgagacgggtggatcacctgagatcaggagttcgagactagcctggccaaaatggtgaaacccaactctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctc

SEQ ID NO: 241101 - DNA, 401 bp, Homo sapiens
ttcagattcctgcaggtagacaccaaggatctcctcagagccagcgctgatctcatccacagagggatcacatgacctcatctgggaaaatataaaccctacccacctgcctgcccatttggaaatgcagactggaggacgctaagttcattcttacctatgtactaacaagtacacaagaagatgctcaatatcattagtccttggggaaatgcaaattagattataatgagattccagtgtacacccactagaaggctattaaaaaggacaataccaactgttggcaacaatgtggagaaatggaacccctcctacgtttctgatgagaatgtaaaatggtgcagatactttggaaaacagtttggcaatttattaaaagattaaataagcataaactt

SEQ ID NO: 241102 - DNA, 425 bp, Homo sapiens
ggtcccatcttaagcggccacacaaacacagccagtttccatttagaagcagctgcatgtctgtggtggtctttactctaggcagctacaccactcagcatctgttttgaggcaaataattatgactgagtcaggattataatccccatgggcttcattatgtccagatttcatttctactcctagtcggtcccttgttagataaaaaccctagggcacatggacctaccaataaaaagatgcattagacagcgggacatcagtagtacagctccctccagaggaaaagggctaatcacttgatagcagttctaacaccaccctcaggggatatctgtgaccaagaatagatgtactcaaagttcagtgagaaagttttgagcctggctgtgtaaaccctggcctagtgttttgggcattattta

SEQ ID NO: 241103 - DNA, 3866 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241104 - DNA, 3663 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagttcctaacacttgtactggttcaagctaggctggggtcgccaaattgccacacgtttcgtgccccattttacgcctttcacagccatatatcagacggcagggacacacctacg

SEQ ID NO: 241105 - DNA, 2720 bp, Homo sapiens
ccctcgcgacgtgtatccctcgcgaacgtgtatccctacggctgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241106 - DNA, 2621 bp, Homo sapiens
agtttgggggtttgttttaaaactttgtttgatttttgtagtccattgattaaaatatcaactcactttgtttccatttttatgtagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241107 - DNA, 962 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccgaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcggcacgcccccatcacacaccttttggacccgcccattcacaatgtgcttacg

SEQ ID NO: 241108 - DNA, 767 bp, Homo sapiens
attaagagtttgctttattttcaagtttttgataatattttattatttacaaactctaaatataaaggacttcttatttgacccacaggatgggtttccagatttccaggattctgtgcaaacactcttccagcaggctagagctaagagtgaagaacttgcagctcttagttcacagtaacataaactcccagttattactccatgatagtatctgaaggttaaaaaataaatgactacttcaactagcttcagttttaagtatctgaggcctgactttttatttccgtttgttttttaaaacgtcatctgagccacagctgtatcaacatgagagcaataacaacttggtttgattcagtttatgaacggaatctgatatggtgctacttatttattcttgtagttttgtaggaagtgagacagattctctgctcaagaaaacttaaacagtttgataatcaggaaaaccagccatgttgaccatggctgtgtgtaatgcaactctgagataaaataatactagttctcaataaaatattaatagtcaacattgtaattattgttaaatcttttaaattcatatttattgaaaaactattaaatgaatatgtggcttcaggtgcttttgccattaagttatttaattttgtctgtatactgaaattaaaattttaaaatgctttctgcaaacatcatcttttagaaagcactgtaaacttttattcctattgaacagcttctttgtaataagttgcttttgatca

SEQ ID NO: 241109 - DNA, 326 bp, Homo sapiens
ttatttaaattcttcagtgctcgttgactctcctcacttttttcctaaggagtgttcaggcaaaatttatttttaagaaaaaccatggtatgtttttaatattatgcatatttcttttttcttttcattaggagaaagacctttgaatctccgaatgcctaatttacagaacagacaaccccatcattttgtggtggatggggagctgagcagactttaccccagtgaggcaaagtcccactcatcaggtgagaacgtgctatatgatgagagggtaacacttgaataaaagcatctttaaattctgttctatttcctcccccatc

SEQ ID NO: 241110 - DNA, 3956 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241111 - DNA, 3904 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241112 - DNA, 3710 bp, Homo sapiens
cgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgaggatgggtttccagatttccaggattctgtgcaaacactcttccagcaggctagagctaagagtgaagaacttgcagctcttagttcacagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacaaaaaaaaaagtt

SEQ ID NO: 241113 - DNA, 437 bp, Homo sapiens
gcagtgagctatgattgtgccactgtactccagtgtgggtgacagagcgagaccccatctgtattagttcattctcacattgctattaataactacctcagactaggtaatttataaagaaaagaggtttagttggctcacagttctataggctgtataggaagcatggctggggaggcctcaggaaacttacaagcatggtggaaggtgaagagaaagctggcacatcctacatgcctggatcaggaggaagacagcggcaagggggagttgctacacactttcacacaaacatatctcctgagaactctatcatgagagcagcaaggtagaagtctgccctcatgattcagtcatctcccaccaggtccctcctccaacaattccacatgagatttgggtagggatacagagccaaaccatatcaccatctatca

SEQ ID NO: 241114 - DNA, 599 bp, Homo sapiens
gtccttgcagctgaaggagaaatgaatgcttccaaatccctgaagtcagcctccatggtgctggctgagtctcccatagctctccagctgcgctacctgcagaccttgagcacggtagccaccgagaagaattctacgattgtgtttcctctgcccatgaatatactagagggcattggtggcgtcagctatgataaccacaagaagcttccaaataaagcctgaggtcctcttgcggtagtcagctattgcatagagagtggtgtctattcctatggagaagccagtagttagaaacggtgagaattccaacactgttcatgtaacagtaactccatagatggaagagcattggcaggaaaaagctctagaggctatacagagaagaaaaaaagagcaaaaatgagacctgtatattacttttatttttaggaccataatcaactttgtaatattcttatataattaattagtggtggtctccgactttatagcaggaactttctggtagtatgagaagaaatcattgggtgactatgactaatgtttcagaattactttttaattgttttaaaaagcactccagataatttatagag

SEQ ID NO: 241115 - DNA, 482 bp, Homo sapiens
ttaggggttgggaattaagtctgtcatcagtgagcattctgacttggggcaaatcattctttgatgttccttttatctataaaacgagggagcctaacaggttgatcgctaatgaccctttcagatataaaatccagtgaatcaatgaagtgtgtcttcttagtacttcttaataacgtttggaagatacgttattaagaaagaagatagaaattaaatattcctgtttttcgctctttgaaattactttttttctattatggtgacataatagctgagacttaatacttattcgtatacagtttgcttacagtgagtttcagtgtatataataacttactgaaatgaaatatccttcaggatctaccactgatttgagacctgaaatgttctttatttttcatgtgccttaagggtttttcttgtacaaaaaaaaaaagcacatttaaaattataacgtattattttattattatttattt

SEQ ID NO: 241116 - DNA, 1947 bp, Homo sapiens
  misc_feature (918)..(918): n is a, c, g, or t
tcaaacatgtgacaacattaagcaccctggtagaggcaagatttgccaggcggctctcacatacccctgcctcccacaatactacccccgcctcccatgatatgatgagatgacaaggcactttacctctgcattatactccacaaaacccgtaatcccagacaatcatgagaaaacatcagacaaacccagatcagcagacattctacaaaacaccgagtccttcccaacactgtccacggaatgaaaaacaaggaaaatctaagaaatggtcacagacgagagaagactacaagaggcatgatgactgaatgcaagggtctcactctgctgtccaagctggagtgtggtggtgccatcatgactcactgcagccttggcctcccgggctcaggcgatcctcctgcctcagcctccagagtctctgggactacaggagtctcgctctttcgctgaggctggcttgcaatggcacgacctcggctcactgcgacctctgccttctgagttcaagcgattctcctgcctcagcctcccaagtagctgggattacaggagaaaagactgcagaaccacacaaggctcacgctgcccagggagaacgtcatctcagttcccatatgagtcccgatgaaaatatgacagagaaattctgtcctggaccacgagcatcttttcatcttcgtatcctagcagccagcaggcacttggtgaagaggctgctcaacgaatatacagtgacggttttacgggacaagagttacctgaggaacaactaaatctgccccatcaagcaattcttgacagagtgttgtcaccacacagaatcctcagtttgaaactaacacaaactgaaatgtgcaaaactgaatctgtttctttggggagcacaaaccagtagagcttctatgtgataanggaagatgctgcagtttgaccgagtttgccaaggagaagatgtccctgggacactgagctacttttttacacatacaggtcaagggtccacgtgtggtccttactgggcgccccctattctgccccgtgtgggaagcatgtgacttgatgctgtacatgtaaaacatggtttctgctcttaagaagtttacaggccagcagggaatggtaaaatgcgtgaggaagaacccctaggctgggcgcggtggctcacacctgtaatcccagtactttgggaggccgaggccagtgcatcacctgaggtcaggagttcaagaccagcctggccaacatgctgaaaccctgtctctactaaaaatacaagaattagccgggcgtggtggcacgtgcctattaccccagctactcaggaggctgaggctggagaattgcttgaacccaggagaaggaggtttcagtgagccgagatcgtgccactgcactcaggctgggcaacaagagcaaaactccgtctcaaaaaaaaaaaaagaaagaaagaaagaaaaaaaaaacccccgcaactccaggtggattggcactgactactgagcacaccatacatgtgcaaaggaagaaaaagggctgtgatgaagtgaggcaagctggggcctcaactggctgcatctggaatttcaacagcaagacaagaatggactagacagaccagtgttctcacccactgtttccatgatcactctcacaacagaaaaataaaattgacaagaaaaattactcaagaataaggctgggtatggtggctcgcgcctgtaatgctggcattctgggaggccgaggcaggaggatcacttgaggccaggggtttcagaccagcccgggcaacaaagcaaatccctgtctctacaaaaaaataaatttaagttagccaagcgtggtggagtgcatctgtagtctaagatacttgggaggtcaacgcaggaggatcacctcaggccaggagttcaagaccagcctgggcaactccatctctac

SEQ ID NO: 241117 - DNA, 1940 bp, Homo sapiens
  misc_feature (918)..(918): n is a, c, g, or t
tcaaacatgtgacaacattaagcaccctggtagaggcaagatttgccaggcggctctcacatacccctgcctcccacaatactacccccgcctcccatgatatgatgagatgacaaggcactttacctctgcattatactccacaaaacccgtaatcccagacaatcatgagaaaacatcagacaaacccagatcagcagacattctacaaaacaccgagtccttcccaacactgtccacggaatgaaaaacaaggaaaatctaagaaatggtcacagacgagagaagactacaagaggcatgatgactgaatgcaagggtctcactctgctgtccaagctggagtgtggtggtgccatcatgactcactgcagccttggcctcccgggctcaggcgatcctcctgcctcagcctccagagtctctgggactacaggagtctcgctctttcgctgaggctggcttgcaatggcacgacctcggctcactgcgacctctgccttctgagttcaagcgattctcctgcctcagcctcccaagtagctgggattacaggagaaaagactgcagaaccacacaaggctcacgctgcccagggagaacgtcatctcagttcccatatgagtcccgatgaaaatatgacagagaaattctgtcctggaccacgagcatcttttcatcttcgtatcctagcagccagcaggcacttggtgaagaggctgctcaacgaatatacagtgacggttttacgggacaagagttacctgaggaacaactaaatctgccccatcaagcaattcttgacagagtgttgtcaccacacagaatcctcagtttgaaactaacacaaactgaaatgtgcaaaactgaatctgtttctttggggagcacaaaccagtagagcttctatgtgataanggaagatgctgcagtttgaccgagtttgccaaggagaagatgtccctgggacactgagctacttttttacacatacaggtcaagggtccacgtgtggtccttactgggcgccccctattctgccccgtgtgggaagcatgtgacttgatgctgtacatgtaaaacatggtttctgctcttaagaagtttacaggccagcagggaatggtaaaatgcgtgaggaagaacccctaggctgggcgcggtggctcacacctgtaatcccagtactttgggaggccgaggccagtgcatcacctgaggtcaggagttcaagaccagcctggccaacatgctgaaaccctgtctctactaaaaatacaagaattagccgggcgtggtggcacgtgcctattaccccagctactcaggaggctgaggctggagaattgcttgaacccaggagaaggaggtttcagtgagccgagatcgtgccactgcactcaggctgggcaacaagagcaaaactccgtctcaaaaaaaaaaaaagaaagaaagaaagaaaaaaaaaacccccgcaactccaggtggattggcactgactactgagcacaccatacatgtgcaaaggaagaaaaagggctgtgatgaagtgaggcaagctggggcctcaactggctgcatctggaatttcaacagcaagacaagaatggactagacagaccagtgttctcacccactgtttccatgatcactctcacaacagaaaaataaaattgacaagaaaaattactcaagaataaggctgggtatgtacaatttcaacttccggagataatgccataccagttttcaaagtaattctatacttcccagcagtatataaacattcaacatgcattatgtacttgccattcattgtatatttaggttatccatgtgtttcccattcttcatcacatcctgttgagctcattcccctctttctgagattcacatttacatagttcattgtctgtactgcagaatctgtgcagtgaata

SEQ ID NO: 241118 - DNA, 487 bp, Homo sapiens
tgttatacccaaataatctggttgcgaaactaaataattcaaatttaagataatttgaatttacggctgttggaacttaaattttcctaagcctcgaagaaatgtgactatgcagcctgcgtcatgctcatgcagctgcaccttttacccttttttttctgtaaataattacgaccaaatggcgccagagataagacctccctcagatcactacccctccttacagagtaataaagtaatcttgctgggaatgtagcaacttgtaaccaactaaatcactgtggcatatgcacctggtcttgcatggaaaatgctgtaaccctactggaacttctccgtctctggaagtgacagatttcactctggaagtgaaatcttaactcctccactttggaaacattgactccattcatctagagtcggtgccttcctgggtggccatacccaagctttgtgctcaaataaactctgtacttgatcgtatttt

SEQ ID NO: 241119 - DNA, 322 bp, Homo sapiens
aggaaaaggagaaattttaaaaatcttgtggtggtacagtcttcctaggtataacacaaaccatggaaatcaaaaagagagagattgatatattaaatttccaaaaacaaaacaaaacaagcaggtttcatggagcccgagtccatgaaagcttcatggaccaacataaacaaagtcaaaagacaaacaatgaattgaaaatcacacataaaaaccaaacgactaatatccttaatttataaagtattctaataaattagtaagaaaagatcaataacataatgaaaaaatggaataaaggtataaacagacaattgacaga

SEQ ID NO: 241120 - DNA, 352 bp, Homo sapiens
cactagttttagaagtttcaatagcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctattgaacttctaaactaggggtccggctcgatc

SEQ ID NO: 241121 - DNA, 1217 bp, Homo sapiens
caataagatttagtaactgctttcagtgagcttggtcttaatatggaaaatggtaaatacattatcacatgattgaaagtaataactcatataaaatgtaagcacttcatatctctcaagtacagctggagggattggtcaaagcttcttcaggaggtggcttttgagttggaaactgaaaggtgggtagaatttggtcaagcagaattaaagaactgaggggaagggaacattccagttagaggaaatattgtgcaccactatggaagtactggccttatatgataaggataaagttaaatttggtaggtgtataacatttgaagacaggagaggagagcagttagattagagacagagattctagaaaggtactgaagcctgaattaggcaatggggatgagataggaattacaggattttacaactgattggtcatgataggggagcagtcaaacttgactccaaagtgccaaacctaattgactgagggaatgctggtactgttagaaagtattagtgaaagaattagtttgggaaggagaaagtagtgatgaggtttttgtttttagctgttttttggatgagttgataagctggtacaaagtcaaggtgaaaatatttggggtgcagctgaggctgcagacttgcaggttggtatagaaattaaagctagttgagatttaagaatgttttattagagttcaagctttaggaaaggccaagattgccaaggattagagtagggtaaagggtcaagccaggaccttaggcaataccacctgcatttagataacagaaggaagtctgaagaggatgattggttttagagattagaccattctgaggatattattttctaatcaaaaagaagagaaaggtctgaatctttaatttgaaataatttcaaatttacagaaaaattacaagaatagtacaaagaactcaatcttcttaccaagattcagtgtttgttaacattttgtcatatttgctttatcatcctaacatattattttaggaaccactaacaaggtgaaaccccatctctactaaaaatacaaaaattagccaggcgtggtggcaggcacctatagtcccagctactcgggaggctgaggcaagagaatagcgtgaactcaggaggcagagcttgcagtgagccgagatcgcgccactgcactccagcctgggtgacagagtgaggctctgtctca

SEQ ID NO: 241122 - DNA, 435 bp, Homo sapiens
gcggcagagaggcctagtctgtaaggcggtctctggcccgggtggggctgggaccggcgggctcccaggaaaactttgtacaattggaagtcagggctcctcccattctggaagccctgtccaaacccgcgcctgggggtatgcgcgtgagtgtacgggggaaggccgggcctggcgggagaaaccaggacaggcgccttgagtcggcaaacggctcccaggactgtgctgagcaccgcgaggggacctgaggcaggccccggagaagcccatcgtgccattaattgattctttggaaacattccactggggttgctgaggtcctggcagccggtgaaaaatcaaaggcctctgctgatggaatcccagtcaagaaataatggaatgacgttattgtatgttgaaggttttcataataaacagtttaataaacga

SEQ ID NO: 241123 - DNA, 700 bp, Homo sapiens
cagtctgccattgataggtgtttatggtgattccatgtcttttctattgtgagtagtgctgcagtgaacatgcatgtctttgtatctttatgatagaataatttatattttttggggtataaacccaattatgaggtgcctgggtcaaatggtaattctgtttttagttctgtcattgccacaattcttttcacaatggttgaattaagttatactcctacaggcagtgtatatgaggcaggaaatataaaaggaaaaacaagtaaagggaaaacaagtccttccctgatcagtctgactcactccaaagtcctgctggagctatgataacattatctgcaaggccaggcagggaccccaaaagaatgggctccaggagcagagatgagaaaaacaagttctccttatcagtttccgccttgaaattctttccccataccattattctttgttctgctctcacaactatttttgtaactatttctgcaagtttgcaaagatttcataagttcctgtttttctttctgtagcacggcaaggtcacaagacatgcttaagtaagatagggtcatgttgcaaatcctgttgtaaaacctgtcacggtatgattaactgtctttgttctgcttctgtaagactgctttcctgtctcacaggtttcatgccaaaaacctgacccgcccctgttggttgcatgtat

SEQ ID NO: 241124 - DNA, 369 bp, Homo sapiens
tttaaaaaaaaaaaaaaaaaaaaaaaaagatactaggaggatatatttaaaagttttcgtggtaagaaaaatagcaaaaacgtaagatttttcaaaagaaatgttgcatactagtatttgcataatgactacatgctaggagggattttaagtgaaaataaagcatgttgaagaataactcatatagttatgaccccatttttctgtttaagataaacttgtggctaggtgctgtggctcatgcctgtaattccagcactttgggaggctatgacggaaggattgcttgaggcagaggattacttgagcccaggagttgaagaccagcctgggcaacatagtgagaacctgcctctttaaaaaaaaaaa

SEQ ID NO: 241125 - DNA, 648 bp, Homo sapiens
ggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttctatgaat

SEQ ID NO: 241126 - DNA, 729 bp, Homo sapiens
ggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagacaaggtctcactctgtcacccagaatgaagtgcagtggcatgatcatggctcactgcagcctcaactttctcggattcaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttctatgaat

SEQ ID NO: 241127 - DNA, 843 bp, Homo sapiens
ggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagattacaggcaccatagtgtagtagattttggagacaacaagatgggtttggaagcctaactctgccacttactatttgtgtgaccttgagcaagtggtttaactcctgggatgctcagcttcctcatatataaaaagagaaatgattttttttaatatcctcctcatagagtgatgtaaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggcgtggcctcgttggcctcagcggtggagctctgcggccg

SEQ ID NO: 241128 - DNA, 408 bp, Homo sapiens
cacttctctcacatacaagtttatacttggttgcaaaacccaacacatagaatctacaacagtgaatttttattgggagaattttcaaaagttgttttcatgctacatcatgttcacaatggcggagttctgtgtattggaactgactgatattactaccaacaggaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaagg

SEQ ID NO: 241129 - DNA, 680 bp, Homo sapiens
ctatggcctctaccccaagagtcattacttttaaaaatgcaattcaaattagcataaaacatttacagcctagggaaaggcttatggcattagaatccttatttataggattattttgtgtttttttgagatatggtctctgtctgtcatccaggcagaagtggagtggcttggtcataattcactgcagccctgaactctgagtccaagccatccttgtgccttagtctcccaactagctggatctacaagcataagtcaccatggctggctaatttaaaaaaaaaattttttttgtcgagattatgttatcactatgttgctctggctggtttcaaattcctggcctcaagtaatctttctgccacagcctcctatagtgctgggattacaggcatgagccaccatgcctagcatagagtattacattattttcaaagtcttattctaagagccatttattgactttggcctaaataactcaatattatatctctgaaactttttttgacaaattttggggcatgatgatgagagaaaggggtttgaaactttctaataagagttaacgtagagccatttaaggaggaacagacacaaattatcagaaaaataaaagaaagatcaagtgcaaaagttctgtggcaaagatgatgatagtaaagaatatatgtgactta

SEQ ID NO: 241130 - DNA, 2294 bp, Homo sapiens
  misc_feature (1754)..(1754): n is a, c, g, or t
  misc_feature (1926)..(1927): n is a, c, g, or t
  misc_feature (2065)..(2065): n is a, c, g, or t
tatataaaaattattactttaaaaatagctgcataatattttatagtaactacgtgccatgatttatctaaacattccactactgatggattaacagattgtttccaattttttggaaacaatgacaaataatgctgcagtaagaattcttggacatatgctcttgaatactttctgtggcatagatttgttttggcttgctggctgaaattgtaagagcatttcaaatttaatagatattgcgaattttccttccaaaaatgtatagcagtttacattaacaataccagaaaggggtcatcattctcctgaatacccaacagtactgaatatattgctctttagaaatttttgccaggctgatgcatgaaaaattctatcttgttttagtttgcatttctctgactactgctgagattaaacatgttttagatgtttatgaatcctttggatttcttcttccatgaattgtctaattatgcatgtggctgtgtatgtgtgtatatgtgtatgcatctgtatgtttgtgtgtgtatgagatcaagtgattttcctattgggtaggttgtctttttgaaaatctagtgtaaaggtgcattagttaaaatcaggcctagctgtataaataacagaaaattacaaaataatattaaatatatttctctttcatgtaaatgaagtccagaggtacaaaggttaaggactgatatggcagctctgccccactaagtcctctgggtcttaacttcctaccagctcatttttctgctatttctgtgtagtggtccttgttttcatggtctcaggtggcagcttctgtttcaggaagcaggatggaggaaggactgaaaaggaacaaaggccaaaggcacaatgtctctttatatatatgtaacttaaattgtaaaatataatgttcacatagaaatataatgtttacacagaaactgtaccacaatgtatagttataaaaattattttaaggaaatgtccatggagcctcccctcaagtgaagaaacagagcattggaatttcagaagcccgcttttcctttctaatcacaactctccctagaggaagtctccctctagacctagagattactataattctgactttatggtaatcattgccttgcttttctttaaagtgtttcacccaagtatgcatttctaaatgacatagtttgcctatttttgaatcttggtgtttgtgttactttggttcttgcttcttctattcagtggatgtttattgtatatgatgattcaatttcatcaatttcattcgatgtattatatatgatgatttcagttatatatgatgattattaaataggatacaatagtatcctgttgtataaacatacttcaatttatccattcaactgttgatggacctttggattattctaattcttgtatattacaaagaatgctgctacaatatccttgtacatgtatcctagtacacatacatgtttctctggaatatagatttaggaaaatgttttggattattgagcatacatatcttcacatttattgactaacaccaaactgttttcctaagtgattataccgattcacccatcagtaatgtttaacagtctgtactgctctatatcctcaccaactcttagcaatttcatacttgaaaatgttgagatctagtagatgtctagttgcagcaaaggctggaagatgcagtgttcattctgaacagttatgtgcatagttactatttggaaatnctattattaatataagaaaaaaacatatattgggaaatacacagcaatctctgccacattcagaatactaacttaaaaatagctgccaggctgggcaccgtggctcacgtgtgtaatcccaacaatttgggaggctgaggcaggaggatcacctgaggtcagaagttcaagnncaacctggccaacgtgatgaaaccctgtctctactaaaaatacaaaaattagccagatgtggtggcaggtgcctataatcccagctactcaggaggctgaggcggggagaatcgcttgaacccgggggcagaagttanagtgagccgagattgtaccattgcactccagcctgggcaacagagtgagactccatctcaaaaaaaaaaaaaaaaaaaaattaaccaagtgtggtggcacgcacctgtaatcctagctacttgggaggctgaggcaagagaatcacttgaactctggggggcagaggttacagtgagcgagatcatgccactgcactccagcctgggtgacagagtgagactctgtctc

SEQ ID NO: 241131 - DNA, 208 bp, Homo sapiens
actgttctctcagctttgaggcagactaagaaattgtcatctggtttagaaaagaagaatatctttgatgtaatagaagatgtgatgatggttgttttcaaattaaataatttagttttattttaattaaatattcagaataatctggaaaaattggagaactgaatctgtgcagttgattgcagtattatgtactccaaagctaggg

SEQ ID NO: 241132 - DNA, 312 bp, Homo sapiens
ctcccaaagtgctgagattacaggagtgagccaccgtgcccagcctggctattttttttctttttttggtagagatggggtctcactatgttgcccaggctggcctcaagcaatcctccatccttaaactcccagtgtttgggattactggcgtgagccacggtgtgggcttaccttgaccctttctcatccctgagggcatccctcggccattcactgtcaaaacctgtcatagattcactgataacttgtccaacagatttatttcaagtctgcactacctcacccctcaagtgtttcaagtctcgaggc

SEQ ID NO: 241133 - DNA, 249 bp, Homo sapiens
atctttgtgcctaaacattaatatgcttttgaactaaaaatgatgcaatcattaaaacttatttatattaatatatcttgcttattcatagtgaactataagaactgaaatgccaaacaaacctgattacttttatcatctttctttcatacaaggaaggaagcaatcattttggtatctggtagacatttccagaaatctgcagatatttattattctaaagttggtgactgaatttgagacacacac

SEQ ID NO: 241134 - DNA, 477 bp, Homo sapiens
tatgatgttagatgtaggtttttggtagatgccttttatcaagttgaagttcacttttattcctagtttgctgaggtttttatctgtattgggattaaattttgtcacatgctttttctgcatctatggagattatattgttttcctctttaattcagtcaatacagtgaattatatttttaaaagaatgctaggctggacacatggtggctcacacctgtaatcctagcactttgagaggctgaggtgggaggattgcctgagctcagcagttcgagaccagcctgggcaacatggtaaaaccccatctctgctaaaatacaaaaaatcagccgggcttcttggcacacgcctgtagtcccagctattcaggaggctggggcacgagaattgcttgaactagggaggcggaggttgcagtaagtcgagattgtgccactgcactccagcctgggcaacagagcgagactctgtctc

SEQ ID NO: 241135 - DNA, 246 bp, Homo sapiens
tcagatgctagtaaacgtgagtgttacctaatattgagtttaaatgtgccagagccaacctggtacgaataatattaaagctaatgtcataggcatgcacctgttaatcagctcatctcatgacaagaaataatgttatttggtgtgtgaaaaataggtaggtactaattataccttgcatatatgttattcttggtagaaatcatataaagttacatgaaagaaactactatgtagcttttgagg

SEQ ID NO: 241136 - DNA, 482 bp, Homo sapiens
ctggtcttaaaatttgatgactgtttaaccaaatgggaactgtttttctgaaagtgctttagggcaatcagtgctaatgcttttacatgcttactgaaagtagaaacctaggcatttgatcagagtattttctaagagatagaaaatgtttaaaagtcagatgataagcttgcataagcctcaagggtgacacaatttagtattcctaaataaggacttagtgtttcttgcagatgaggatattgcaataggaagctatttgacataaaaataaagtgtgcgtgaagtgtgctgtatcacttttgtgtaaactctctttttgattttcttaagcagaaatggctgagattgggtttacatagtctcttaaaatcaaagcttgctttactgcatagaataaaatgtgtttctctgactgactagtactgtataaaatagcctacctctctcatgcaaaaactgatattggacagaagatggaa

SEQ ID NO: 241137 - DNA, 460 bp, Homo sapiens
tagtccattttgagaatgaaaaacatgatgacactttaaatcatacactcctgagaaaaatgggcagattattcacaatgatcatttctaataagaatggaaataaaaatcatcatacttgaccaatttatgatatatagaaaacactgcatcatgcaactactaattcgccatcactattgactttgcagaagcccatttcaaagataagacaccgtatccccagaacaagtgggatagatgtgttttctgtaaaaataattccttccatttatgcccccctaagaaaacaagtagattatgttttttcccttgaactgctgttattgctttttaaatatgtatctctcctcccaacattgtagaggtatgactaaagtcctatcatagttgagaatgccccagaagtaatgagtaatacaatccctgtcccattgcctaagcaactacatgcttttct

SEQ ID NO: 241138 - DNA, 466 bp, Homo sapiens
agttttgggggtacaggtggtttctgattacattactaacctttgttacacttatactcactgcatattcttgagggaagaccccttcattgtatgtacctaaatgttaccactctatagagtattcctgatacctttgtgtagctccagtgatgtttcatgtttcctttagagcatttaccacactgtgccttaaaatataatgagttgtataattcattctctttccccactagattgtaagccccttgatgacatggctcatgtcttatttaattaggatgttttgatggttgtctaatataagacaggaaatacgcaaatatgcacacacacatattttcatttactcagcttcagtatttacttttgagtatataacactgctacattcatttctatgaggatatatataatgaatgtatgttctgtgaacatatcttcaaataatttacatctacaagga

SEQ ID NO: 241139 - DNA, 433 bp, Homo sapiens
acatggaaaggatatagtggtgtgtgagagcaatggcttttatttacttctctgctaacctaaattcatatttatgtaattttgttaagagacgcttaaatgaataaaaagaatcatggtactgcatggatataccatactatgagcactgagtatatgctcctttctgcatgcagtaagcagaaaatgttgagaaatatgagaaagtgaagttagggactttgttaagtggccacatacactctgaaaattttttttaattgccttaaatctgagagtcttctggaaaaaagataaagcagcagtcatttttaaaaaatgaaatttctgtctgggtggggtggctcacacctataattccagcactttgggaagctcaggagtttgagatcagcctgggtgacataacaagacctcttctctactaaacata

SEQ ID NO: 241140 - DNA, 274 bp, Homo sapiens
tagatacaatgctgattgtactttctaagcagaaagaagcaattacaatagacattttggttagaagatggataatacaaaaattcaggagctggccatgttcattagattcctagaggactggccgggtgcggttgctcatgcctgtaatcccagcactttgggaggccgaggcagagaactgcttgaatccgggaggcggtggaggttgcagtgagccgagattgcgccactgcactccagcttgggtgacagagcgagactccattaaaaa

SEQ ID NO: 241141 - DNA, 510 bp, Homo sapiens
aattatacactgcaatgaatatcctctttttgtacatgtgcatataattctctgtgaaaggttttttaaaaatggaattcctggttcaagggaatatatacatttaatattttggtagatattgttaaattcccctcaaaaaaagctctaccaatttaaataagtactgatagtattttaccattttaatttgcatttccttgtggatgtggtggagcatcttttcatgtgtttcttcatttttattttttcttttgtaaattgttgttcatattctttcctaatttttcattgggttgttgattgttttcttagtgacttatgggagccttttatacattctatgagaaagaacaatgcagcccctccctgacaggggtcagacaggagttagcctgcgcctagcacctaggtccaggtgtttcctacctaacacaaactcagagaacttcagcatcagacaggcccattctgtgactgtgacggagcaagacaaaaatatgaccactc

SEQ ID NO: 241142 - DNA, 255 bp, Homo sapiens
catccaggtgattcccaggataacaggaggctgtagctgtcagctgagtttgcacagaagtgggactgttgggccagaagctggtgccaagctccatctggcgaggggcaggtagagcaatcttactgctcccaggcaccatgactgtggtctctattgaggctatggcactggtactggtctgctctggggtctcaggcctggagaggtccccttggactcaagagttgcccctgcgaaatgtccaggtggttc

SEQ ID NO: 241143 - DNA, 417 bp, Homo sapiens
agggagctggctgtgtccatagacaggggccaggcctcggtggagctcgccaggtcatagattccatctgtgcttgcagagttgagcagaccccagggactgagctgctctcatcaaatcccctagacactaaatagtgatcaatgcgtgcttctttccaagagacttaggcccctacgtggaaacaaagtccaaaaagcctgtctgtgtaactgagcaggagaaacgccagccagaccagagaccagcaagatcacagagaaagtggcacctgctgtcatccatcctgggaggctgtgtcctcccagagttttacaggctcatagccaccagccctttctctggacttggatttaaaacaagttgttagtccagcttcatggtagggatgaagttaaagcacaaatgagaccgaca

SEQ ID NO: 241144 - DNA, 2095 bp, Homo sapiens
  misc_feature (191)..(193): n is a, c, g, or t
  misc_feature (221)..(221): n is a, c, g, or t
  misc_feature (224)..(224): n is a, c, g, or t
  misc_feature (228)..(228): n is a, c, g, or t
  misc_feature (233)..(233): n is a, c, g, or t
  misc_feature (620)..(620): n is a, c, g, or t
  misc_feature (1063)..(1063): n is a, c, g, or t
  misc_feature (2044)..(2044): n is a, c, g, or t
gagacggagtctcgctctttcgcccaggcaggagtgcagtggcgctatcttggctcactgcaagctccacctcccgggttcacaccattctcctgcctcagcctcccgagtagctgggactacaggtgcccaccaccgtgcccggctaattttttgtatttttagtagagacgggagaattgcttgaaccnnngaggtggaggctgcagtgagccgagatngcnccantgcantccagcctgggcgacagagcgagactctgtctcaaataaaagtggagttacttttgtgcagagtttccactcccctggtaagaacaaaatacttgtgtgtatgagacacaaatatcaattctgtaatttctaatttcacataagaggtaaaggctcttatgtttgtatttaaaatgatcattacaccaggcctggtggctcacacctgtaatcccagcaccttgggaggctgaggcaggttggatcacttgaggtcaggagttcgagaccatcctggccaacatggtgaaaccctgtctctactaaaaatacaaaaattagctgggcttggtggcgcacgcctgtaatcccagctactcaggaggctgaggcaggagaagctcttgnaactgggaggcggaagttgcagtgagctgaaatcacacccctgcactccagcccgggcaacaagagcgaaactctgtctcaaaaaaataaaatgatcattacacaatatgaaaatgaataataaaattcatgctaacaattttactttacttagaatggcattaagtagcaaaatttaaaaccacgaccagttgagaaattgttaaaggatggaaaaagctttatagttagtacctttaacctaatttttccttttaatttttttttctttttttgagacagggtcttgctctgtcaccctggctggattgcagtggtgtgatcacagctcactgcagcctcagcctcctgggctcaagtgatactcccaccttagcctccctagtagctgggactacaggtgcacactactccacccagctaattttcaaatattttgtagngacagcgtcttgctatgttgcttagggtggtctcaaactcctgggctcaagcagtcctcctgccttggcctcccaaagtgctgcgattacaggcatgaaccaccgcacccggcccaaggagtttgccttttcattttgcactgggccctggatattacatagctgaccttgtcttcaggactaggaaaaggaccgatagaatcctgtgttccttttgaattaatctacatttctttgacaacaagctggacataggcttcatgaagtacagggggctccaggaatactttgttctgaaatccaagaatcctcactgtatcctttacccaagctctggcatatgtcatcatgactttggttcccttggggcaaagagcatacttttggcctgaatggacattgagtgtgggggtgcttaacacctctgaacaggtcttgtccacttttgagttggagggcaggtcagctaggtgtgcacttccaaaagagccctcactgtccaaggtgcagttgtaatccaggaaggaaatgaggtccatgatgtgccactatgtggagaactcacaggttatcacaacactgaaactcttgatgaatgattactggaggagggagtttacatcgtgtcaggccctacactatggagtgtagggatgccacccttggttcccattgtccaaaaacaaaacccaggaacttccacatcttactgtccttcacattggtgtggaaggctttgaagaatctgctgtcctgatgagcgccttgtctcaccacaaaaggctacaacagggatatggcatcaattggatcctcatccagcttgaaataaaccgtggaagctgcttttcctcaggacccgatagagggtgaagttctgggcttggtagagactgaagcagactggcacatcagtggtcacgactgcagtcaaagtgggagacacgatggtaaggaagatgccagaaccacctgctattnctcctagctctatcatacatgcccacatggcactcaagtatcctggtagca

SEQ ID NO: 241145 - DNA, 359 bp, Homo sapiens
tagtagagatgggttttaccatgttggccaggctggtcgcagtttcttacctaagaatttaaagtagggaaatatccccaggccaattatttaattcctgcgtatttaatttaacataggcatcttcatgttaattggctacaatggccagattcaagtcaaagagatttgattttcaaaaacaaggcataaaatacaatggagatatcaacaacttaagaaccctacagagtatctgacacaatgaccaaatgaaataagggaaatattggaattgaattactttttcataatcaccagccacctaaattcttgggtattgagaacaacttaaacatccttctttgatttagtttttt

SEQ ID NO: 241146 - DNA, 585 bp, Homo sapiens
ttagctcatcagctattgttagtgttagtgtattttatgtgtggcccaagacaattcttcttctaatgtggcccagggaagccaaaagactggacatcctgatttagatagaaccatccctggtatttataacttatgctaaaagaatgagattcctaggaagtatgcttggtaggtcagaatctgtatcagtccttcctacaccatgaatatctatttttattttgtagatttctaaatataagctggtaaaactgataattgattgcttaaaaatctaacaacaggttgttgcttcctttcctggcatatgctgacagtcaaaagagcaccctggtgagttccaattgccttgcaccagggaaacatgaatgtaggattgattccacaaatactccaggtcacaattacgcagttccctttcttccgtcatgatagccagttggcttgacatggaggcttggagccttgggcatggaaaaaacttccatagagcaaagcaccaaactttaatggagggctgagggctctactggggaatgctgcttgtagagaactgtactctaaatttgactgtacctgcta

SEQ ID NO: 241147 - DNA, 640 bp, Homo sapiens
gactagtgtccaaagagtgttttagtaaattagagtcaccgtgatcacagtgcagcctgattccaatcctgctgtggtgtttctggcaaatgattattttctggcagagcttcctctacatacagaccagatgcaacttgtatttttagaaaactgaatggttattctgaaattctttttaaaactacattattaaaaaccacataaactgtgttctttcctttgacctaataaatgatgataggaacaaaatctagtgtcagacttttcctcagtcatcagatcttcagcttatttctcctcccattgacttactagcaataatggcaatgagcattaagaacagaaaatgtgtcatcctgttggtcctgttttggattttcattaaccatgtgactgtagacctgtggcaacctgcactgaatgagccatgcagtgttgtgatgagcgttccgatctgtgtctcttggcaaaacacttggttggttgtgtttcccgtggtgaccaaagtactctcaccatgacgtgcgttcttaaaaaaccagagatcaaaaatgtaacctttgcaattgcacaaatcatgtaatatataacacatttaataaacagattatacatttatcatgtaatatatattcta

SEQ ID NO: 241148 - DNA, 360 bp, Homo sapiens
ccataaagcaagttctgagagtcgttttcttctctctttttctcctttcttgcttccatttctagatcctcagtgcattgcacatggactctcgatcctaaagggtccttggtggcttcaagttggttctgcccactctctacctcttctgcaaaggagtaaaggagtgctctgcaagacccagagacaactgttctgtagtttcatacaagaatggacttcgggagggtaggttaagtctggaccttggctctaccataaattgggggataggtgtcaaatttcctgtaggctatcactttcttcttctctgtatcattaggatactgtgaagatgggatcaagtgttttgccctcatt

SEQ ID NO: 241149 - DNA, 417 bp, Homo sapiens
tactgctcagatcacgtgcggtgcattcccagcacctcagagggctcctcattctccgtccactcagtgcgtccttctcccggggaagccgctgtcactcagtgcatccttctcccggggaagccgctgtgcagacttccagctccacagctttgtttttggcattacatttacagcattttccttctacagcaaaacaccttttaatattccattttatgaccagcctgagcaatatggagaaaccccatctctactaaaaatacaaaattagccaggcgtggtggcacctgcctgtaatcccagctactcaggaggctgaggcaggagaatcacttgaacccgggaggcagaggttgcagtgagctgagatcacgtcactgcattccagcctgggcgacaagagcgagactgtct

SEQ ID NO: 241150 - DNA, 565 bp, Homo sapiens
gccttgtgctgctctactcagggtggaaggcaaatgggcgctggtgtgtgcagagtaacaacaaggtctccaggaaactaacagagcaagaacccacttgctgccccgcccagggcagggcactgatctactcatgagggatctgccctcatgacccaaacgcctcccaactaggccccacctccaacactggggaacacatttcaacgtgaggtttggaggggacaaacatccacactacaccataatccaacattacagtatttattttgttgctcaaagtgttccagctttggacactgggagcttttcagccggctcccatgtccccctgacacacccccatccgcatgtgcacctgtgcagcctcaaagcacttcctggcattgcaaggtgcttcatgtacctttagggtatatttcccgccccagccctagaattgatcatttcctccagaagccctggtttacttttattggaaagtgccattaaaaatcaagatctggatggcaggtgtgctcattgtttcgcgggtctcacagcttctaggccctctccgctaatg

SEQ ID NO: 241151 - DNA, 525 bp, Homo sapiens
tggatcttgctctatcacctaggctgaagtgcagtggcgccatctcagctcactgcaacctctgcctcccaggttcaagtgattctcctgcctcagcctcccttagtccctagctgggactacaggtgcacactgccacacccagctaatttttgtagttttagtagagacagggtttcacccttcagaccagccgtgttggtcaggctggtctcaaactcctgacctcgtgatctgcccacgtcagcctcccaaagtgctgagattacaggtgttagccaccgcgcccggccaattttctgaatttttaaaatcatgaactgatgtgctttttgtgcatcaattgagatgatcgttttgaggtttttttccccttcattctattaatgtggtatattacattgatcaactttcctttgttgaactacccttgcattcctgggataaatcccacttcatcatggtgtatattccttttaatatgctgttgggttgggttcatcgctttttttgggagggggtgga

SEQ ID NO: 241152 - DNA, 514 bp, Homo sapiens
ctttgcagatgctgcagcttaatggccgagatcaatggcagaggtgacacctgggctccaccactaagcctggtctggtggaaagagaccaggctgagtcagggccatggcaagttccacgtggcacccaaaaggaggtgagtctgcccttgagtgcctccaaggtcacttagtctcctagagtcttgtgcagtgacagtgcccaggcagaaaggcgcccagaggaagcgtgtgtttattggatcagtcagacacatctaaggagcatgtggtttatgccatgtgctgtgctgcatgctgagagccatcagtgactaaattgcagttcctgccttcaagaagctctgtcacaaggcagaaacaagtaaaacaaaaacagtgatgctttggccgggtgcggtggctcatgcctgtaatcccagcactttgggaggctgaggcaggtggatcacgaggtcaggagatcgagaccatcctggctaacacggtgaaacgctgtctctactaaaaatac

SEQ ID NO: 241153 - DNA, 347 bp, Homo sapiens
tactattatttacttacctcagtctttacatcttagctccattttaccagaggctcaggtccaaaatctgggaggcattcttgattactccctttctcttcagaaccacatctaatcaatccatcagcaaatctttcaaaatatatccacagaagcctgtgtaggtggcccgtaactatagccccagcttgtcatagggtggaaggatctcttgagcccaggagtttatttaaggccagtctgggtaacatagcaagaccctatctctaattttaaaaaaatccataatcaccacttccagtgcctatgccctcacccaggccaccatcatctctcacttgaagtag

SEQ ID NO: 241154 - DNA, 429 bp, Homo sapiens
aatcaaggtgttagcagagctgtgtttgtttctggagcctctaggggaaagtctgtttccttgcctttttcagcaaagatgcaagtattctcttttttccatctttaaagccagcaagatagaatctctctgactctgcttccatcatctcatctcttttctcctgttctcttccgcatctgtctttcacttttaaagacccttgtgattactttgggccttcccagataacctccctattttcaactgattagcaaagttaattctgtctgcatccttaattcccatttcctgtgtatcttaacatattcatgggtttcagagattgtgactgggacatctttggggactattatgctacctaacataggcagaaaatgaaaagaaaaattcaaaccttaactgtattcagtgaaagctttaaaaaaa

SEQ ID NO: 241155 - DNA, 695 bp, Homo sapiens
tggctgacacctgtaatcccagcactttgaaaggctggggcaggaggattgcttgagccccggagttaaagatcagcctgggcaacacagcaagagcctgtctccacaaaaaaagaaaaaaaatgttaatgaaatgctacaattctgcttccaaccactagtttgaatgtaggtgcatgtgtttagtatttcaattttaaatatgattgtcttttaatgatagttttaaaagactggaggtttacttgtgcatgggcctgatgcccagcctgtgtgatactagttcattcctgatgagccatgactgtacccactaagccccttaaagagagggtactcttcctcctacttctctttctttgagttaagagtattaatagcacatgcattctagtccgtattcttgatgttaagacatgttggaaatgactgaggagcgttgtccctttcttgagcacacagacagttgctaaatgcagggcttgtcttaaattaatgttctctggtgtcttctattaccatctcactccatcattaaccccagtggtcttcatcctagacataacagtggtttgcactgtggcatccatgactttgctcctttttctccttcagctgcctctccaaccctctcacctccccctacaaagtctgggtatatttttgcccatttcttgcctagtgttatcaatact

SEQ ID NO: 241156 - DNA, 443 bp, Homo sapiens
cttaaaaattttcaaaataagttggggaaagtaataatagagaagtaaacagttcaagaaaaacaaacactattttatgcttattaaaccagttcctcccacctcactgtagtttgtgttttaaaataacttccagtgctgccaaggtcatggggaagctggtacagtgaattaccagtggcatgaccatggctcagcctgcataggccagcatgcagcaatgcttatcaaacatggaaacacttccatgctggctgaggcaggcattgccctaaggattcttttcaaggaattaggttgacaaaagtaaaaaaactatgcctgaaaactgaaaatgaaaacaacctaaatgtccagtaataagggttaggtttaggaaattttgcttcactactggatggactattatgcaagtattaaacatgggttttaagacttccaaa

SEQ ID NO: 241157 - DNA, 731 bp, Homo sapiens
cttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccat

SEQ ID NO: 241158 - DNA, 677 bp, Homo sapiens
cttcaatcgtggctcgaaccttgttcaacatcagagtattcacactggtgagaagccctatgaatgtaaggagtgtgggaaggcttttagacttcacctacaactttctcaacatgagcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccat

SEQ ID NO: 241159 - DNA, 3538 bp, Homo sapiens
  misc_feature (1817)..(1817): n is a, c, g, or t
  misc_feature (3451)..(3451): n is a, c, g, or t
gattatcagctggagaactgaatggtacacaccttcccccttcttccaacaccatggcccccaagatgctgcacctgccgccgcctcatttagccctacaaccccctgccactcaacattatgcagagggcccaggagggtcttgcagtcatctacatacttccctgcgagttcttggtttggtccctagaaatggcagcctgcatgtggagaaggctgcatgcagcctcaggcctgcccacccgatacgaggtctgcatgtatgagttgtgtgcatcacatagctcctcaccatgctttcctacccaggaggataagctttcctacccaggaggataagctttcctacccaggaggagactcaaggcaaaacactggaaactgtgtttatacaaactccccaagtgattctggcagccagcacagaatgactgtgcacagacactcaggcatcactagctctgggcgccgcgcatttgcctgcttcatccaggacagtggctaacacttcaggtagggcccacatacactcagaataaagagctgcctggtcaggaggggggcagtcagcatgggctaagttttttacagatctctggcagacagtgttgtctgctttggctaaagagggaatgggaaggcaaatgacaaatggcctctaacgttgcaaagaataatgtgttatgtggaactcagacaagccagttctatggagaaagcagtacattgaggatgagatttctgcttgtttctttttgtttttggaggaaaagccagggctgtgggcctgacagaagttgatatttgggtcttgaatgtgttctcttccagaatcttctctttccagttttcccagcttactattgataccattcacagaagtcttgcattcagtgccctctctaggtggtacctccttataaactgggccttatgctggcatcttgggtccttggaaggatagtttcctggtgcgctggattagtcatagcctattgtagtgactctggcatggttacctcaggaacaccaccagacaaatatagaccctttaacactggctggcccttgtgtctccagacccctcccaggagttcctcacactaggaaccttgggctgctccactttgggtcacaaggacccctttgcctagcccaaagcaggcctctttggttgcttttctctggtccactctggctatgaccttcaggatcagagggcaagaagtcgagaaggacacgtctccaagatagagcactaagagctaatgggcagaactggctggagctgcttattcttggcctttttatgggtgagatgcctctagcagtgttggacatctcatcccagataccaccaggaggtgagcttgctctgggaggcatattgaaagggctgcaccatgcaaaggtcaggaactctctccactgcatgaaacatggcacaagctctggcccatctggctgtgaccagctgggcctttgctcagggctgtctgtgctgctcctcaccaggtgaggagtgaaggggaaagaagaaggagtcttgtgctcctttcagaggttggacagtgccatgacactgttcaaactgtttagtttctctggggcttctgcttggagtttaagagagacataatttattctgaagtttgccatggagagaatagcatctctattccaatgtagtcataatatatggtatcatcctgcctatttaaaaatatgtttggtagtaaaattttcagtcttattaaaattttagcccaaattcttttcctcctttcttgtttttccccaatcggaagattcggtcngtatttcccccaggggaaacacaagaacattacctaagaactttgaaattattttcagagaattcaggtgctgctggttttgaagatgcctaaaggagtttccaatgttctccaacctcgtctatggtaaaataaattccaagtaagagattccttccaacaaaaagtaaccaaaatgtgtatttgccccatcttaggtaattaaactccctaacagacttgcagatttaggcaaaaagagtggtagaatataaaagctcattaatcatcctggcatcatgagctcatattgttatgaaataaatatgcttactaaatggatccagatgccatcaaatacatgtttccaataaagactattttttgttcttgcccaggcaataaacacacgaggcttgtttataacacctcttttccgtgaatcacagtggtccatccaacacatattcttttcacctctttccctggtgaaaagtgggtacgttttctgatgaggattctggggaaaaccctaacgaggtaggagatgtttccctgtaacccagagctgatgggtgataggaaaatggaaatcacttggctaatcgtataccaacatggaagacatttgtctctattaatcttcttacccaacacatcaaagtaccaatttcaatccaagacagtaccagtccccagaggacagacttgagtctaagaggaccccctgcgatctactctgtaaggatggaatggtagaaagatgaagatatattcaattatcatcaaaccccaggctcttgatgtgggtgagctgtcttcccaagatcacccccaggagttggctcaggactggaaagcagagggggcccattggagggaggatggagttcatagtgagttgagggcagtagttaacgtggggttggagccagacacatacaagttcctatcctgattctgccacttaatagttatgaccttcaacggtattctacctctctgagtccgtttgctttattcaaaaactccaagttgctgggaggataaatgagattgttattgtaaactgcccagcacctaagatgcactaagatgtggtagctcttatcacccttcctagaaaggttattccggatggggactgatgctgtccaggagaaatggatgagtagagggaaagctgtttgttcttaatagtagaatgaaactcacatgtgtcactaaccaaggggcctgccctgctgggacaggcctccccttatagcccactccaaatctatccttctcgagttcccactcactggaatctccagccttccagattttctgggacctggagttggccagtcaccaccaccatcctatgcagctttccctttattactggaggaagtgtgaagataactttttccctcaaacgattgtaaagagcttaaaggcattaagatgagagacgggccaggcgcagtggttcatgtctgtaatcccagcactttgtgaggctgaggtgggcagatcacgaggtcaggagttcaagaccagcctggccaacatggcgaaacctcttctctactaaaaatgcaaaaatcagccgggcgtggtggtgggcacctgtaatcccagctactcgggaggctgaggcaggagaatcncttgaacgtgggaggcagaagttgcagtgagccaagattgtgccattgcactccagcctgggtgataagagcaagactcttgcctca

SEQ ID NO: 241160 - DNA, 363 bp, Homo sapiens
tatactgtccctaagtgaaaaggcagcaagaaaactgcaaatgcaaataacacctctctccaatcttgatggaccaatgattgtcaaacttaagcattattactattattattattattattattattattattattattagcgatgaagtttcgctcttgttgcccaggctggagtgcaatggtgcgaccttggctcaccgcaacctccacctcccgggttcaagtgattctcctgcctcagccttccgagtagctgggattacaggactgcgccaccatgcgcgctaattttgtatttttagtggagatggggtttctccaagttgattaggctggtcttgaactcccgacctcaggtgat

SEQ ID NO: 241161 - DNA, 490 bp, Homo sapiens
gactagagattccttctcagatgccagtgaccacctcacagcccacagcccactacctcctctgtctctcacactcagggccaatattcccctgccctgatcacaccagggccaggtatcagacaactccggacagcccctctgtcccagagccctgaaattactcaaaccagccagtccaaagcctgctcaccctgccttgactgtttcttcccacagaaaccccaataaaggctcttgctcacgtttccctctcctccccctgacttcagcagaccccagcgttcgcccgtgtgtccccgacccgcgccgtgtggcgcagcccctgctcttgagaactgtgagtgacaaaccatcttttcaacggcaacatcccctgatttgtgggcctcactacacctgcctgcatttcaagcagtgggcgcagctagcagggtggagtgaggcgccactgcgctgctctcggtaactggttccaccgggcggccgc

SEQ ID NO: 241162 - DNA, 639 bp, Homo sapiens
  misc_feature (568)..(568): n is a, c, g, or t
  misc_feature (572)..(572): n is a, c, g, or t
  misc_feature (576)..(576): n is a, c, g, or t
  misc_feature (585)..(585): n is a, c, g, or t
  misc_feature (593)..(593): n is a, c, g, or t
  misc_feature (596)..(597): n is a, c, g, or t
  misc_feature (599)..(599): n is a, c, g, or t
  misc_feature (613)..(613): n is a, c, g, or t
  misc_feature (617)..(617): n is a, c, g, or t
gtgagtcttccaaccagagcttgtgcagcatgggatccttgagtgataaagaagtagagactcccgagaaaaagcagaatgaccagcgaaagtggaaaagaaaagccgaaccacatgaaactagccaagggaaaggcactgctgggggacgtaaaattagtgattactttgagtttgctgggggaagcgggccagggaccagccctggcagaagtgttgcaccagttgcacgatcctcaccgcaacattccttatccaatcccttactgtgacaagtagaacagcccctctgtggtttagatggcagcactgcaaaggaggcaacggaggagcagtctgctctgccaacagcctcatgtcagcaatgctaacaaaacctcggcttgacccagagcagctggcacaaaggggagctggcctgtgcttcacttctgtttcagctcagcaaaacagtccctcatctatgagatctggcaacacagagcatttctgcagctcccaaaaacagatctccatctggcacagacagacccagtccgacctcacaatataaaaaatatctgcactncagnctgngcgacagantgacactncgnntnaaaaaataatattnaatnaataattaaaaaaaaaaatgcg

SEQ ID NO: 241163 - DNA, 302 bp, Homo sapiens
tctcagcaatacaaatgaatgactactaatgaactagttaattaatgaactactaataacaacataggtgaatctcataatcatgccaagagaaagaagccagatataaaagggtccatagcgtgattttatttatataaaaatctataaaaacctaatataatctgtggtgcacgcctgtagttcccagcaacttgggagcctgaggcaaaagaatcgcttgagcttgggagctcgagtctgcagtgagctgtgatcatgccgctgcactcctgggtgatagagcaagatgtctcaaaaaa

SEQ ID NO: 241164 - DNA, 452 bp, Homo sapiens
gttttcagagcaatgtataggtaattatgattactctgattctgggtatgaaaaaaaatgggactctggttgattgacattttctcaaggttacacagctggcaaacagccaggtcaggactggagcccacacctgcgtgactctaaagtgcccactcttctgtgctgcaagagcctcccaactattccttagggtcattatgtgaacatgttgtgggggaaagcacaacgtattcatcattcagggcttagttcagcagccacccgcttccctgacaccctggtctgggctggatgtccctcttctgcactcctggagtgctgggtgcatgcttatcccaggagcagctttccccgctctgtatcccaacacctgctactgtctgtcccctaattcatgtgtaagaaacatttttaacaaataaatttgacaaataaatgatgaaatgaaa

SEQ ID NO: 241165 - DNA, 544 bp, Homo sapiens
aaatgtaatatagttttttattttcagcaccacacagggttatgacagttcactaagcctttatttttttttcctttttatctgcccaagaataaccatgatcagtaaacctctaaatgtgaaagaactgttagtgatttcatttgttccaatctgcatgtcctctgaagataaatccgatatggaatttgggataaataccactggccttattactattcatgagtctattttaatttctttggctgttcaacgaaatcctcatgactgacttctctaaatttcaggaaagtaggatgtcagaggaatacttggcattatggtagttatttagagaactttaactctgaagagttcttactagttaagcacatatcttgtaacagaatagtgacttcagtgatttaaaaatatacgacctgttggccaggcacggtggctcacacctgtaatcccagcacattgggagcccgaggtgggtgaatcacttgaggtcaggagttcgagaccagcctggccaacatggcaaaaccctgcctctact

SEQ ID NO: 241166 - DNA, 476 bp, Homo sapiens
agctccagaagctctggcatttggagaacatcttcccttatttaatgcttagcctgtgcctaaactgacacaccttacgtcaggatagggtggttgggcaagtgggtgtgtgtagaggttgctgtacaagtcaaatgacattttctgcctgaaggagatcacagaattagggaatgttgagttcaaaattcctacagaacaatctgcctgctgtaccagcgtgtcatttccccattctccttccccttctccaactactgttcagtctgtaccccattaacctgcctttgcttttcttcatttttttatgattacctgtaattatcttatttgttggcttttttatttatcagctgtttccccaatcccaatataaggttcatgaaagcaggggccttgcctgtctgtgccccaggcacccagtgcctggctggtaagcacatattgaataataaatgagcatcccatgaactcta

SEQ ID NO: 241167 - DNA, 2076 bp, Homo sapiens
  misc_feature (595)..(595): n is a, c, g, or t
  misc_feature (1939)..(1939): n is a, c, g, or t
cctctgatggcaccagtgatactttaatcaggacctattttaaatggataccatatagtatctaatggtaatattccatctctgcacagatataatatagtatacctattagatttttgtgaatagagcagatatttgctagggctcattacttttatttatttttactattttttttaacctccatcaccaccaccaccacctaggattcattacttataaaaaaaatatgtagtgtgaagaaaaatggcaaatgcagagtggtaaagttttataacatatttttgggtcaatttttagaaattatttttaaaagaagaggcataaggtagggatgttagaattctagtttgtggaaatgcaagggatcttgacgtgcctctttttgaaatattatgttaagaaaaacaacttgaaatttagacttaaagaaggaacaggttggagagtaaaagagatgaatttagtgttttggccttggtatatttgagatgcttctgagacaccctatgggcttgtctggagctcaaaaaaaaaaggtcagggctggggagagattgaggaatcttccgaagagagcagagatgataccctnggatgggatgagttagtatagatgtcttgaaacggttaaagatacagattccttgggtcctgcctttggagattctgattcagcacatctggaatggggctcgatccccgcctcttccttaacaagctccccaggccattccgatttgcagccaggttagcgcattggctcatctatcaactcaggtcttggctgttgctttgttgcctctaaaggggatcataaaatgtgaaagattcttctcctgttctttcaaaagagggtagtttccaaaacaaagcaagtttgagagatatattttgaggaaatatttgtgaaaacaccagaaatagtggagccacttccatttcaatcttctggatttgatttgtttgtccattaaaaaaggggggggtaattatttgtgtgtctgtgtgtgtgtgtgtgtgtgtgtgtgtgtggatttatctcagacattgaatgggtcatttttttcatattttccaaagtcacataaataataataattttaaaaattcagagtgctgggctaattttactacataagtagaatatacttagcagctattagtggcttctacactgaaatagaaccctgcagttatgaaaatcatacctgaaatttgagaaaagttgtttttgcacagtaatatagggtaaatgataactctggtagaaatagcctaaatgaagttcaataaatgctggacactatttgaggttgacttttggattttgttgtaagggttatctccagatctaagtgtaaactcagatcactccggtcttcctgaatcagacctatttttcatttgagacagatggaaccatcaagaatttttcccctttgactatgtcttggaagaacagggtgccattcctttcaggtgcatttaaacccaatccaagtagtcaaactgaagaatgcagagagcaatggctattacaggcctcaaagagtccgaatcctttgcaatggccatgaaccagtcttgccttttcagatgatctataagcctggaataggacagttttggaccatggtagggaacttggaaatgttagttggtctaaattcctggttatggaattaaaacaagttgtatctactttagttattaacttaatccagtatttttgttttggcttaatcctattagtgtcacattttacttttagaatatcttccactgttaccgggcgcactggctcacgcctgtaatcccagcactttgggaggccagggtgggcggatcacgaggtcaggagttcaagaccaccctgaccaacatggtgaaaccccgtctctactaaaaatacaaaaattagctgggtgtggtggcncatgcctgtaatcccagctactcaggaggctgaggcaggagaactgcttgaaccaggacctgggaggaggaggttgcagtgagccgagatcacaccattgttctccagcatgggcaacaagagtgaaactctgtctc

SEQ ID NO: 241168 - DNA, 397 bp, Homo sapiens
atgagggatctgccccgtgacccaaacaccctccattaggccccacctccaacattggggatgaaatttcaacatgagattggagaggtggaatattcaaactattgcaggaagcatagggaggaagggcaaattcctcaagtgcacacaggtggttgactggagagctgagatttgaacctggacctgtgtgaccagatgcagagctctgaagtgctccataggctctcactccaggctgtgaattggggcagatgttgggtgaatggagactggtggtgcaatgtcaccttgcattcgctcatatgcctttaatcccatatgaaaggactgtgcatgtcagtaactatgatgttttctaggaaggcattggctctcttgcttcagacttcctccg

SEQ ID NO: 241169 - DNA, 468 bp, Homo sapiens
gggcatatgctggtttctgactgcctccctgtgtgggaaacatcacatctgcatgagaaagaggcaggcttgtctgcaccgcagccacaagttttgctctcactctcttcttagggacaaggatgaggagggctgggggctggggagtcatctcccacgctcatgacctcccttgcagggggctggcagccaccatgcggagatcccagccttcaccttctgcgcctgggctgtgtcccactcacttcgcttgtcttcaaagaaagcagccttttaaaccagtcagaatgaaagcaccatcctctgaagcagaattcgtaactttgatccaaagctctataatgtatttacaggtcttgcagcgcaacaattccacttccatgaccctaaggaaataaccctaaatacagaaaaggctttagtgcacaaagatgtttggcacaggccgggtgcggtggctcatgcctg

SEQ ID NO: 241170 - DNA, 461 bp, Homo sapiens
ctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactggctcatgagtgacatgagccaggcaacataatgggtgttttatatgagtagatgctgttatttttaatttatacctaaggctcttttgcccaagattgaactgtttcttggtggaaaggattatcaatgcatatctctttttttttttttttttgagacaatctcactctgcactccagcctaggcaacagagccagactccgtcccaaaaaataaaaataaaacttggtccttcccaaa

SEQ ID NO: 241171 - DNA, 470 bp, Homo sapiens
catttcatttctccaaataattgtttgatatttgactctacagcccttcagggcaggcaaatacttgtaacattagctccatagagatatggttctcaattaccaaaagactgtagaagtcacttttctttgcctgacactgggaaggattctgattgaaggaagcagtctttgttcctctggtctcatgtgacagtctgtatcttcaggtccatacaggttgatgcacaccaaaaagtggattcaaagctgcctattcaagacttggtgatagggaaagatgaggagttaattttcattttcgtttatcagctgcctgtttgattaagatttttggtaggaagagccatctttcagacataatgcctagggtaggttaagggcaaaaattaactctttgaaatataaatgcttcctattaggttggcagatttcactaagctctttttgggaagaaaatgctaaaattc

SEQ ID NO: 241172 - DNA, 566 bp, Homo sapiens
gggccaaagcaagttatgagagctgccatatgccagctgccaaatgtcttcagtgccaggcatgttgccaaactaggggtaaaatagtgaatgagaaacaaatgcagcctccaaagagctcaagtgacaaagactgacttttacaacataacggtgctgaggtgcactgaagccctgaacctctggaggctgcaaggatagagcagtgatgtgtcagaccacctgcatcactggttccctgatggcacttaattcaaatttcatcctttggtagggtctagtgaaaatcagctcaaaccttgaaagatatttctatgtaacctaattaaatgagtgagaccttggtgcctctcactgcaggacaggcaggattgaaaatgaaaccaatatctgacccaacgagattctgtcctaagttcaggggaacaggttttggtggcaggcccttttacatgactgtttgctggagcccacaagaaccaagatgagaatctgagggaaatggccactttgcagccaggttacaacaggagagtcatgaccggctgcagttataaaaactgaaa

SEQ ID NO: 241173 - DNA, 193 bp, Homo sapiens
ttagccttattttattttgccttgcattggagttatttgttcatatgtcttgctgctttctagtagattttaaattcttcaagggcagagagacctgtctcatttatctttgcatttttccttcctcctgacaatacccagtgagtgcctggcaagtaggaggcactcaacaatgtttgttaaaatagaatga

SEQ ID NO: 241174 - DNA, 397 bp, Homo sapiens
aaggatccagatagttattggttacacacattaattctgtttaatatgctaaagtatataaatggagaaataataactgagatttatccaaggcaaatgaaaggagaaataataactgagaattatccaaggcaaatgaaaggcatcaaaccacagattcaaaaaccccatgaatcacaagcaatataaacaggaaaaaaaaaactataggcatattataaataaaactgctaaaagtcaaaaacaaagagaaattcctaaagcagagaaaaaagacagatcaccctcagagggacaacaaggcagttagctgacttctcagcagacgtaacaagtcagaagacaatggattgtatcttcaaagtgattaaataaggtcaaaacttgaattctttac

SEQ ID NO: 241175 - DNA, 536 bp, Homo sapiens
agaaccatgcagagtccatgtcccagtgctgtcctgctctggtcttgtgacctggacatgcctcctctagaccaggaggatgggatttaaaagttggggactttagttcacaggttcctcatccactgcttcagcttttccttatccactgcttcagcatacagtggcagtttctgagggcagcttacaggtaaagagaatttaaaatgctctcaagaatttaggctttggtcagcttctgggaaggggagaaatggaagagagtgttgaggaactagttttccttcttggtaagaaaaacagggtgcatgtacaaaagagcttaaggaagttttgaatggtgcataataacaaattctagcagacaagatgagctagttgatgggcttaagaaggatcttgaaaccctgtcacctgactgggcactatatctcacacctgtaatcctagcactttgggaggccaagacaggcagatcaactgagctcaggagtttgagacctgggcaacatagtgacaccctatcttcacgaaaa

SEQ ID NO: 241176 - DNA, 465 bp, Homo sapiens
cctttgtaaaaaatgtttgaaatttgtgtttttaatccctatgtttttctagcagcaaaaaaggaccaactccaggtaaacaatgcccaattgaattgtgattcctgtcaactctatcattgccttaatcatagcacaatacaaacacacagcatatccaccctaataattctaggtcgcattcctggattatggattcctgtaaatctatctgagccttgggcagccacccccactttacattttgtaaaacttcttactcagcttactcatggcactcgtagagccttaggcatgataatttttactatagtctccttaattacattaataccctctgttgtggtgtcctcagtagcactggacagctccactcaaacagctcaatatgcagaaaattggatgcatacagctgaccaggcatggatgtttcaaaataaaactaacactgagatacaaacagaa

SEQ ID NO: 241177 - DNA, 266 bp, Homo sapiens
taccaagggaattgaatgaagaatttttaaaaactggtgaggggctaacttaatatccacagcaggaaagaagtcatctctactcaaacttcacaaccgtacagacattagttcaacattgaccatagcctaaatgtaaaatatcaaaccataaaatggtatcctgtaggagactgaaagaaaaaattactcacaataaaatcgtaagaatcaagagcttgttcaaaaattcttagccatagcagcaaaagcatgattcattaaag

SEQ ID NO: 241178 - DNA, 754 bp, Homo sapiens
tgaaagacaaatttggatcagattgtagagaacagcttatataattatttcactgtatttcatttttatagtcttattataagtgaaaatgacaaattactatagaaagctaagacaaatatcaaatttcactcctaaaaaagtgcctaaaaattagaatttatagacaactttaaaaaatcttattagggaataaatctgttaaataatatcagcaaagtttagtgaatattatgttctgttttttatacaattacttttattgcataaatactttcaggaaaattatcttgctactaaaagaaaaaagtgtgtatgagaaatacctacatatactcagaaccacacacacttcttttatttatggaatcaaactcttagagctgaaaagattttaatctgttcggtctaatcattttagagataaggaaacagcccagtttaaatgacttataggagttagtattggcagagcagaaataatgtaactattttaaagcaaatcattatgaacttacacctatttagagctataaaatcacttcatgtgtacataacaatgaagtttaaaaattgataacactcttatcaatacagcaacaggaggtttacaaaaacagtatcaggtgacatgatttcagattctatagttatttaaaaaaataataagggaaaatgatgaacaaagttgttgaagtatttaacaacttacatgaaatggacatcttaaaagatacaaacagctcactcaaga

SEQ ID NO: 241179 - DNA, 644 bp, Homo sapiens
gcttttgcccattttccagttgggttataatagttctttatatatcctacatactagtctcataccagtgtataatttgcaattttttcccaatgtgtggatgtttttctttaacagtttcttttgatcccaaaaccttttatttttaatgaagtccagtttttctattttttcttttcttgcctgtgctttaggtgtcacatctaaaagaaaccattgcctaatccaaggtcacaaaagtttacccctgtgccttcttctaagagttttatatttactcttacatttaggtctttgatccattgagttcattctgtatatgagggaaaggtccaaatcagttcttttgcatgtggatatccatttgcccagtacctgtttgttgaaaagatcattcttccctcatcatttgttatactttcacctcagtagttgtgttttgaagtatgtatattaaatcttttataggcaaccttgcatttaaactttgtgctctgaaccatctaactgtattcaggctgggtgtggtggttcattcctgtaatcccagaactttgggagatcaaggtgggaggatcacttgaggccacaagttcaagaccagacagggcaacgtagtgaggccctgtccttccaaaaaaatt

SEQ ID NO: 241180 - DNA, 280 bp, Homo sapiens
aaactaggaatctgcccttctacaaaaactgagacacagatgtatcatctccttcaataattgcattttaaagggatggctctgaagtcttgagaaaggcattcctgggttgcaaaactaggaagaggctagaagaaaatttgggagaagatttgcatctcaaagagatagagaaagaactcacaattgcaagtttcctaaaataaatcctccgtgaaaaaaggaggcctgatggatggaactggaggtcattatgttaagtgaaataagccaggcacag

SEQ ID NO: 241181 - DNA, 478 bp, Homo sapiens
actctctacattaaaaaatgtatttcaatcccttacctgatacttaaaaacttagagaaggggaaaattagcttcaatcttaagatttagagaggccaaacctttctgggtatcccatcttcgggtgggtagcagtaatgagggagcatgactgtatacttgtccccgtacactcccagcatctgctgggtcgggcctgtgctctctgaatatttggtaacatggcagctcctatcttccagctactgccctctgaaagcctgccaagagcattcctggtgacatcttgtgcaacctacaaactcttcttatagcacaggctctgctatgacatggaccagagcaaaggtagacactgcaaaattatttcttcccagtgaggcaagtatgattgagcacatatccttgctctgtttactggagaaacagactgatcaactggcatgaaatattgaaacatgaaacttacactaccatt

SEQ ID NO: 241182 - DNA, 318 bp, Homo sapiens
aatataagttacttcctatcaagtgtaaaagaagtttttataaaggtgggttttttttccatgtccagtgtttatatccttatttactgtccttaagtgacatgaaactcaaaataatatacactttacctaattaaaaatggaaaatggtcctgatcctagagaatggttataatttttatttctacaaaattaggttttagcttagaaatcttttctagaataataattacagcatacaaaagtatttcttctggaaaagtttttagtttgatgatacatttgcttcctatctaaaatatgattttgagacagcaa

SEQ ID NO: 241183 - DNA, 433 bp, Homo sapiens
tctaggctgtgaatagcataattttatcaaattagtagcaatatttaataacagaaatggaaagcttagaaaaatctgaaacccaaataaagtcattaagttacaaaatcagtatttctcatgactcattggtctattgtaaaataaatttactgggttatgtagcactgagaaaataaagagagaattggggtggggatgaacagaaaagagagcactacatataataaggttcattattgtttcattaacattttgtttcatttgtttgggtgtgtgtgtgctaaggtgtaatgtaaaatacatttctgcataatggtgaaaaagtttaagacatggataataggatgtacttaagaacgtaagtttataaattcaggaatatatttatatatatacatgaagattgtgggattaggaataaatcgttacc

SEQ ID NO: 241184 - DNA, 388 bp, Homo sapiens
cctcctcctcctcctcctcctcctcctgcttaaattcagtgccagatgttaaaataaacttggtaaatggtgggtgtgctactggcaagaagattgaatctaatgcaaaaaagccctaatttttccctagcatctttgttagatattacaaagatccagagctttcttttaagaaaaaattagagatttttctgcagtggtcttcagagttcattttgcttgcaacatggttttaaagtggccacaaacagaaaataatttttaaaagtcctaattctaagaattaaggggaaaaaagaaccatatgcacagaagtgcatgaataggcctcccacttaaataatccaatctaaaaaaatgtttcacctgaagtattcattcctttgga

SEQ ID NO: 241185 - DNA, 534 bp, Homo sapiens
aaaagagattcaggaaaggagacgtagcgtgactcagcatcccgcgcccaggtatttacccagaagagatgaaacacgtccgcaggaagactcgcctcaaacctttgtagcagcagcgttcgcaaagctgagaaaaccaagtatccatcagctggcgagtggataagcgaacagtggctcatccctacggtgggaagacaaggccgccgctacggggtgaatcccaaaaacaggatgctaagtgagagaagccacacacaaaagaccacgtgcttagggcctcctttacgtgaaatcctagcaaaggccaaactatccttacagaaagcagatgcgtggtcggtcggcggggcaggggacccggcggcagcggaggtggcagatgcgtggtcggtcggcggggcaggggacccggcggcagcggaggtggtttcctgctttccctttgtccaggctcttcaagtaggatgcttaaaattggtaaatatcgttgtatgtaaaattatgcttcaataaaactcaatttttattttt

SEQ ID NO: 241186 - DNA, 681 bp, Homo sapiens
cccctccttcctattctcttacagctaggacccagcgttctgggcagaatagcaggcagcgcagtagctactgagattataagtggtaggtttatggagctgtgaccacaactctccacaagccagtgctgtctcatgcaagcactctcagtgtccaagtgctgagtgtgtgagtggtctgggctttgcagggtcggccaagctcttggaagagcaggctttgttagctggggagtcatcgctccatgcaggccctgagaatggagcatcctgagtggactggtagagatggggcatgggtcactctgagggtttgagctacttctgctatttttgaaattctggtttgaactgcaggattgtgctgagtttggcacagactaatttctctgttggcagcacatgatgtatcaactcatgtgtcagttggtttgatgccactctggaccttgagagttccaaagggctattgagggagaaacctgacttatggcataaaatggggtactgaatttgggaggctgaggatgctaaatggtgtatgccctgcctctgttttattgctgaattgtgtctctcagtggaggttcttagaggcttttcaacaaaacctatgctgtcagctaaaaggcttttaggacttcataatcatggcacagtatcttttcctttttcttaaaa

SEQ ID NO: 241187 - DNA, 481 bp, Homo sapiens
aattgccaaaatactgaattattcaatcataaaactagatgggtatctaaagctctctacccagtaggggaaaaaaccgaaaaaccgtttgggaatccttcagagagaaccgtaatgctatttactggataaatatacttcattttcttctcccagttctttccacaacacgcttgttaagtcgccatggaaagcaccatgctttatcaatttggcaaataacacatttcattttgccaaggcagaaacagcctaaaagtaatatttataccgagaaaccctggctgcagtccccagctgctctcccgcagccctgcgcctccggctcatgcagcgctctccccccggagccggcaggtgcccaggtgagcggggcctgcggaggcagcgaggggcgccggccgggaaccggcagaacgcgtgcagccagaagacaggagagataatacattcccttaagtaataaaagtttccaggacaa

SEQ ID NO: 241188 - DNA, 863 bp, Homo sapiens
ataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaagg

SEQ ID NO: 241189 - DNA, 422 bp, Homo sapiens
aggtttcttctcttggcttgcagacagctgtcctctcactgtgtccttacatggcagagggagaatgagagcaagctctgttgaggctgtctcataaggacattaatcctattggatcagggattcccaaaggacaatatgaatcaaattataaaatatggcccaggaaataggcacagataaatctatactaaggtgttgtgctgatacacaagtctagtactgttccatgagttcatttctcatcacacaccaagatttggtattttcactttttcatggcagattaatctatttttatcatgttaaaaggaactaagaagacagggtaactaaaagcctggctcctagattcaaaaaacacaatagagaaaagggagattattagcataattaagaacacttggatatcaactaggtat

SEQ ID NO: 241190 - DNA, 386 bp, Homo sapiens
accaaaggctgtctctctttccgcttaggcgtctgttaatcattgacacttaattagccctgtaacatattagaaagtgctttgaaaattgtaaagtcctattcaaatatgcgggataattattacacggacctattctctccactgaccctccttaagcgtctactccaggtcatgtgctctgccatgcatcaccttgtgtaattactgttggaggccctggattctcatccgttttacagaaccaagaagacagcaatgtaaatgacttgcccagggtcacataggcagtgagaggcaggttctgtgtgcttctagagaaaccctctttccactttgcattcttcagtgcagtcttttctttctttcaccaaagccaggattct

SEQ ID NO: 241191 - DNA, 517 bp, Homo sapiens
cttcctctggccccactgaggtgatgcaggggtatgtgtggccatatttgggaaagcgcctcgctcccatgcagaggctctgagctcacccaggaggggcaggctctttggtgcccactatccctgggccaggctgggaaggccctatagggtctgcccacgctgaatctgcaggggttgtgctgctggggtgggggtgctgtgtgcatttgaaacaggttcttcaccacccccgccccgggatagtttggacgctcctgggcaccttccccttcactgtggttccctgcagagtgtttgggaggagtcaggttctaggaggcggaagggcgaggccccagattgggttgtggtctagaaagagtggaaagtttgcccaggtgcagtgtgattcatgcccgtaatctcagcactttccgaggccaaggcaggagaatggcttgagcttaggagtttgggaccagcctgggtaacatagtgaaaccctgtctctacaaaaataaaaaacaaaaagtta

SEQ ID NO: 241192 - DNA, 662 bp, Homo sapiens
aatatcagaaaagtatatttatagagatctaaataataaacaatgggagaaaataggactagagggggacataaaggatggggcaggatcatcgacagaggatctttttcagcacaagcttagaaaaggttctctgcctcttccaaaaggctaggctgaaaagatatgatgtcactttcaagtcaacttaagactaacaagggctggaaattttcacaaagtgacaattacaagttggaagtttctttctagtatctttggctagaaagttatttcccaattctcacaaagaattccatgacaattgtatttccctgggcaattaacaggtacacagaagctcaagcgcattcctgctgaaggctgacactcatccgtgttctgggcattcgtacagagcattactggcattcacggtcccagcgaaacctgaacacagctctagagtctagaccaaatcaccggccccttgtttaaactgtttgaacccgagtgtatctgtacaccaccagtcccctggcgctctggggtgagtctggcccggtctccggtgggccctggagcttggcactctgagatacccctggctgtctggtaaattcctttataagtttcacaaccgcaggtttgggtgaggagacaaacaccgctgtagtttgctg

SEQ ID NO: 241193 - DNA, 471 bp, Homo sapiens
tgagagctgcagggtctggctggaactgctcccggccagcggacttcacccgggcgcgggggccgcacctgccgggcgcggcctgctctatggcgccctctgctgttagtccgccccaggctccgcgccggcctctcctgggtccgtggggcctgcgggctgcggggatcaccgagacccacattcccgtggccagcagcctttcgctctgctcagaggagaggcagaagggcatattgctgtttcccagtcgctttttacacctgccttcttcggataaacccaaaaatcttccttcagagaagacggcccgtatttcccgttatttgggggtggaggtggggctaagggcgtcatagggagagccttactttcaacattctgcattatgaaaccaagggagactttttttcccaacaagtgtgaacattttttttcaagagaattaaatcgtttattgattacacatga

SEQ ID NO: 241194 - DNA, 994 bp, Homo sapiens
cgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttttttttgtttttttgttttttgaggagtcgtcttgctctatcaccaggtgggagtgcagtggcacaatctcggctcactgtaacctctgcctcctgcctcccgggtccaagcaattccc

SEQ ID NO: 241195 - DNA, 495 bp, Homo sapiens
ttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaat

SEQ ID NO: 241196 - DNA, 430 bp, Homo sapiens
tgtatgctgagaaggaatgagtcagtatcatgcggtgggggaacgaatttgggccgtggagtcagacagccctggctgtgaattcctgcttgggaatcctctgtgtgtttcctgtggggagaaaagtaattgagccgttacagcagccaagaccgtgcctggcatggggcaccagagcaacagatgccagctgcttttgttattaaaagatgtgtcttctgcctgggcaacatagcaagactccatccctacaaaaaataaaaatgaaaaaaaattaaccaggtgtggtagctcatgcctgtagtcccagctactagggaagctgagacgggaggatggcttgagcccaggagttggaggaggctgcagtgagctatgatcgtgccactgcactgtagcctgggcaacagagtgaaaccccatttattta

SEQ ID NO: 241197 - DNA, 861 bp, Homo sapiens
cacaatgatgagaaaagccagcaagttcacacctgttgggaaaagcacacttttaacatctcaggcgtaaaagtcaacagtaaaattactgtggtacaggttgagtatcccttacccaaaatgtttgaaaccagaaatgttttggatttcggatttcggaatatttacacattcataatgatatatcttggaaatggttcccaagtctaaacacaaaatttatttatgtttcatatacaccttatacacatagtctgaaagtaattttgtacaatattttaaataattttgggcatgaaacaaagtttgcatacattgaaccatcagacagcaaaagcttcaggtgtggaattttccacttgtggcatcatgttgatgctcaaaaagttccatattttagagcatttcaaattttggattttcaaattacaaatgcttaacctgtacttagatgttaaatacagtgcctcttccacgggcacttccaggaagcattcttttatataagcccagtggtgttaggtaaaacccaggttcaagggaataaaaacaaagaaattgggttcaccagatgaaaaagagatttcaaatacataaacccttatgaggaattatagacttctaaaattcagatctaggcatatcatgaagtaaactctagctcttttaaagcatgaaaagaagctatttttgttttcagctctctgcaaattcaaaccttaagggattactgtaatcatatgcacatctcaaaaaataaaaacaaccccattttcttatcctataaacatgaataataaaagaataaaaataaataaaaataattttaataaatgaataaaataaaccttgatcgcaagt

SEQ ID NO: 241198 - DNA, 441 bp, Homo sapiens
agctagagagctacaggaagttcatgatgcctcttaagcttctgcttagatgtaggcatctgttgcatctgctcatatccctttggccaatgtatgacatagacatacaaccaattccaaaatcactgaatgaggacataatactccagaagtcaagtgcatgggcaaatacaaacagtcctcttacagaaaaatgggagagtaaaaaactgcaaacaacaatacaatcttccacccgaaggataacttgcttaaaacagacaactataaaatataatcacctctatctttcatcttcattctgccattttgggtggttgtcataaattatgcagttttctataaagtttaaaggaagtattcctctaaaggttcaaattaaggtactgaaatatgtgggttccaaatattaaaattcttgtcctattttgccatgatata

SEQ ID NO: 241199 - DNA, 504 bp, Homo sapiens
cattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttattt

SEQ ID NO: 241200 - DNA, 456 bp, Homo sapiens
aggaaattgaggctcagtgggtgaggctggggccagctgtctcctctcagtctgagagagttggggtttgcgacactgactgtgtgagggcagcaagccttgaggataccatgaaaacctcacagttgttctgattgtattggctgagcatcacctttattaaatgtggacaagcaggccgggcgtggtgactcacgcctgtaatcccagcactttgggaggctgaggggcggatttcttgaggtcagaagtgcaagatcagcctgaacaacaatgtgagatcgcatttctacaaaaaatttttaaaaaatatctgagtgtggtggcacaagtgtagtctcagctactcaggaggctgaggtgggagggtcacttaagcctaggaaatcaagattatggtgagccatggttgtaccattgtactctggccccagcaacagagccagaccgcgtatc

SEQ ID NO: 241201 - DNA, 364 bp, Homo sapiens
ggcctctattaacctggtgaacccctaagggtaactgagcaaccctaccctctgtgcctagagagggcaggtagaccaactgctctgctcccgttcacacccgtccccttgaaaggggctgaagattgaagagatcatcggagcatggaggagagactttgagccaaaaaggaaccagggaaaaagacctaggccagaaaccagcccagctgaggtcccaccttctccctctcccttccaacccaggcatcctggagaaacttggccgggactttctcaatccccccgcatgccttcacattgagccgaatggtcccagacattgtagtgtccatgaatccaaaagctagagaactgaattttt

SEQ ID NO: 241202 - DNA, 378 bp, Homo sapiens
tctgtacccagcctgtgccatgtcctccatgtgtgtcgctgtagtactgcccataggtgctgtccccgttttacaaatgagccacaaaggtggccaggcacggtggctcatgcctgtaattccaacacttcgcaaggccgaggcgggtgaatcgcttgagcccaggagttcaagatcagcttgggcaacatagtgagacctagtcgccacaaaaagtacaagaattagccaggcgtgggggtggcacatctagtcccagctattcaggaggctgaggtgggaagatcgctttagcccaggagaccaggggtacagtgagcagtgattgtgccactgcactccagcctgcatgacaatgagagaccctgtctcaaaaac

SEQ ID NO: 241203 - DNA, 419 bp, Homo sapiens
taacacagataaacaggaatcccagcttcacctctggccctctccccagaattaacattttgatgcgtgtccttctttcctgtttgttgttccagtcttcattttaaacagaagccagaaggtgcaatatatcctgttttctagctttctgtttatttccacgtttatttcaggtacttaaatgttcgtcttccagtgctcaacctccagagagatacaccattagttcatagccagtctaccacacacaatctaaggaacaggcactatgttcccagtgttcctattataaacaatgcttgatgaacatcctattttccaatctttccacccaaattggtggctggggccactcattctactcctgtttctggccttgatacagtcctgtacatactgacaaatgcagtggcgtcaga

SEQ ID NO: 241204 - DNA, 1316 bp, Homo sapiens
  misc_feature (1269)..(1269): n is a, c, g, or t
  misc_feature (1314)..(1314): n is a, c, g, or t
tttctctagatctgaagatatgctatacagatgtgtacaaagaatatgtagtgcttttcttcttacaaagcgcataggtaagaaaaaagcacagcacaatgcattggaggaatccaaagaaactgagcatccccagaaggaaagtatatatgaatatgtggcagaagctgaaaataagaaataaagatcatatcttgtgcttacttaagcaaatactttgaatttatcctgagaaaaatgtaaagttattaggggacatttgaacaggagactgacataatgttattggtgctttatagtatattaagaattaatttttgggaaaaaaagaaaaccaaattcaactgcagacattaacgaatatgtgttggctcatgtaatcaaaagtccagcgtgctacaagtaagttttgacataggtgctcaaaaagtgttatcagaattcagtttttctttccattcctcactactggatctgttgtctgcaggctttctctacatactcccaaggtaagtatcagcagttttgagaatacatgattctttgtttatgtccagcggaaaagagagagcttgcttctctggaagcgtataaggcaggccttattttaacctctgcttgatttggtaatacatccattttcgaatttataggccagagaaatgaaatctattaactgacttaggcctgaattataagatcaacacctagagctgggggtaaagtcaacttcactatgaagcactcaactgaaattggagagaagtctcaaagaaaactgagaatcctggcctaatgagacatttttctcttaaagaaatctaaagttactctatactcccggacaataccaggctaggcgtgtatctttgcctccagataccagatgccaaagcttttaagttttaatgtgacttaaaaggagaattttcagaagtagtaagtgttccacatgatactggggttgatgagtcaatggctaaacaaagggcagaggaaaggcataagtggtagaaaacaaagggagaattatgctggatgcaatttatcatagatactagtcagaagaagaaattcattaatctttcctcaaaattgtagccatggtcaaaggagacattccaccattttccatccccgtaattggttggcccttttctatactgacagtaaaaatctctgtgttgggaacttatagcaaaatgaactgccattctctgctcttataagtagcaataaatttcaacaggacaaaaataaggttatttntgtaaaacaaaaccagcaaacatttccaattagggaagttagctntg

SEQ ID NO: 241205 - DNA, 399 bp, Homo sapiens
ttaggaaaatctgtcagattaaatcatggcctaagacattttgtgaatgtgttaggaggaaggggacaaccagtagaagacgggagggggagatatttttcagtctcatgatgaaatacttcacccggaagagcaaaaaaaattctaaaaaattaaaagaaataaactgccataaacgaacggaaaagaggcattccagggttagaaaaattgtattccaagtataatttttttaaaagcctgaaggaaaggctcgagttcatccaggagtttaaaccacttcctttgcccccccaccacccgcgccccgggcgcccccaggaaaactttagcacagcgcagcggcgcgatccaggcccctcccctgtggcgcgcagcgggcccggttttatgaatggg

SEQ ID NO: 241206 - DNA, 518 bp, Homo sapiens
gccaggttgatgttagtaaaggtcaaacaatttcaggagcacctctgacctccctccacacaggttttcttaccttgactatgcagagggtggtccatcttggcactgaagatggaaccccctcttccatggtctggggtgaccccatgcctgtaactgaatgtgctcagatccttggggtgcggggactgtagggggaggatttgaaggtgtgggactgtcctggctggagaccactgggtcaggagaactccagtagagggtttgggtgctgggaaccaggaagagtgggggaaggggcagagccaactccagaggcggatctcctggctgaggacagagggtgtattgtccaagctggaggttgctgtagctgggcggggagcagctcagctcgtctcttccaaatttcttttgggggagggtaagggaaggcaagcccccctttacttgtggccctgggggctacaatggttgctgagaaacaaggcttatttgacaaataatgcttcccagga

SEQ ID NO: 241207 - DNA, 810 bp, Homo sapiens
ccggcagtcagcgtctggcgctctgccggggctctgcgccgaggcccggcagcacagcaccgcgggcctctctcctgaagccagctgcgcactgcgtgcgggggcttgtagttgcttgtcttctcccatcatcctccccttcctcggggccccaccggtggaaactgctgcatgtgtactcggatctctgccataggggattttttagctgagacttggcacccctttcccgcttacgtacctgaaaactcttggcaccccctggtttttttgtgccccagccaactgtagctcagcttccaagatgcccttacctggtgacagaagtctgggatgcacgaaagcggagcagctgggcacagtgggcatgcgcaacattagaggaaggtgggctttataccggaaaaggttttcctgcgtctggaccagaagatttttaatacgattatttacagccacttcagacgaaaaaccaagtgatataatacaaaaatgctcaggaggcgacaggactaaccacttttacactttgatctttccttctaggctgtacattattttttcagtgttagctggtgagtcaaattcattttttaaaacccgggacacatgttccacgtggcaaggcttccataaaaacatttggtgaacgaataaagtaacaaaaacttacagttcagactctcaaattgctatcatgtcttttgaaggaccggcatacattaagctaaggcttccctcagaaaaaaaaaacaaaacaaacaacaaaagaaaacaaagcgtgatctcacgctttcttccaagcgaaga

SEQ ID NO: 241208 - DNA, 330 bp, Homo sapiens
aacatcagagccactcccaccacctcgctcagccccttcagtgggtgtccttcctttccaggatgaaaactcacaaaaatcccattattttgctgatgacttttagatattgatgtcctgaagtcactttcagttaagttggccaggcctggtggctcatgcctgtaatcccagcgctttgggaggctgaggcaggtggatcacttgagtccaggagttcgagactagcctgggcaacatggcaaaccccatctctactaaaaatacaaaaattagccaggcatggtggtgcacacctgtaatcccagctactagggaggctgaggtggg

SEQ ID NO: 241209 - DNA, 433 bp, Homo sapiens
ctatataagtaagcattatatttttggaagtgatgtttctcatcttgctctctgaggtcaccctactctgtaatagtctctaataaactatgctaaatttactgtattctgtaacacgccctgaatttttagctgcgtgagatcccaagggctcttgggacaagaccccttttctggtaacaattagatctagaatttcactaaactataaagggagaataagcaaaatgctctttacagggtcattattggttaattcatctgtttaccttgatataaaataaaataaaatttatctaaaataaaacaattcatttttggttaattcatctgtttaccttgatataaaatataataaaatgtatttaaaataaaataattcatctgtttaccttgatataaaataaaattgttaatatttgtcatgttacct

SEQ ID NO: 241210 - DNA, 390 bp, Homo sapiens
gtgtcacatacccatcatgcatgacaaaggcccttcttccaccttgtccttgttcttagatggtaacaaaattctattatctggaagattgctgtagtaagaggaaacacagggagggaagcacagggaaacatgggctagcttttcaaagcttctacttggaagtagcaaacattacttccactcacattccactggccaaataaagccacgtgggcacacccaacctcaataggggctgaagtgcaatcttgccgtggaatgggagaaaacagaacctgaatattggtgaaaagtgctaatgactgcctgtcaaccgcagtgttagggagacttcaaatagaagaactgagctgatcttgttgtagaaatatgggaggaaacaaaaac

SEQ ID NO: 241211 - DNA, 429 bp, Homo sapiens
actctgactatcttaagcaaaaggaaatgttttggaacaatagtggaaagccacagaattacaggaaggctacagaaccaagcttaaaaactaacaggaaccaagccgtcttggtggaagaggaaaaataactataggtatagtttatatcagatacagagtgaataagtgagccgtactaggataaatgaattccaaatattttcagtctatttgctgctctactcaagactttataaaaggagaatggctttcttgagctacggtacttaacctcaaaaaaaaaaaaaaaaaaaggagaatccagttagcctggcttgggtaacaataactcttccttgactaagagagggaggtgattggaacgcagccctgccagtctatgttcaatgaggacaatacttttctaaatgcaactgaggctgctct

SEQ ID NO: 241212 - DNA, 473 bp, Homo sapiens
tgcatttggcatatactgccaggtatcacttattttattttttctgtggaaaaagaaaatactaactgaatttttgtatatatttattaatatccagataggatatcataattaaagtaatcagatcaagtttctaaaatattactggctcttgttttccattcccaaacacctgagagatactgtacacttaacaagtgaaacagtggtctgtatatccagtatttgtatcctacaatttccaaagtgtgtttttattatgaccttactcctctttactgtccatatttcacaaaaagaagttatccattgggtaagaagatcttaatccattaccaaagacatttttaatagtaattaataaatcacatatgttctatatattttggacataaataaataatgtaaaatgtcggtacaaatagtttctctacactcaatgatattatattattaaagtcagctgcatttaa

SEQ ID NO: 241213 - DNA, 356 bp, Homo sapiens
accagctggttgaggatcttggtgtagcttgattaaaagaaaaaaacattgtttttgtttaaactggtagtagaataatgtatggttcactatggaaaacactaaaagaaaatagaagcatctctaatcccaccacctagaaataaccattgcttcacgtttgagagtatgtccttccaggttgtgtccgagctcatcttttacataattaggaatctatactatatatgcaatttttgtatcctgtttgttttcccccactctgtattacattgggaacattgtcccaagtcatgaaacgattttcacaaatgtttttaacggaaggatatttcattaaataagtaaatagcttt

SEQ ID NO: 241214 - DNA, 818 bp, Homo sapiens
cctctccctctccctctccccaacttcattggctttccattaaatcacctggaacaccacttttctaaaagactgtctcctttgcctatgaaaactagctaccacttgtttttagtaataaagcctttctaaaatgctttgcctaattaccacatcactctacagatggtcacaacacaactgcatgtttcaagtacaatcaacttacagatattctcaagctaatcccaaaatgccattaagtgcttatcactttaattttccaaaggtagatttgaatccatcagtgggtgatccttttttttaagaactcacagtgaatccaacatgaaaaaccataattaagaggtttaaaacaattttattaccaccactgcacaaagtaagggtgaacaagttatacttcatgtcacacacacgtgtgtgttcgatgaataacaactcaagtggtccaggtgaataaagtaaagaacaccaaagacttgacaatcacaagagaaaccaacgtctaagaatttatgaaactgggcaagttatttcctgggactcaatggtaaagacacagcagtaatccaaattttccatctttgaaattttccatctttcagtcaatattagtaatacctgggtcaaaggggagagttaggcataccaattaatgatcatcagaaatgacatagtcctacaaaagcaaagaaaatttagagacactttcttaaaaatacgactcttggtactgttgaagaaaactgtatgaggaagaacgtgatgtaaaaataaaaatggggaaccttccatctaaaaaagagaaaagtaaa

SEQ ID NO: 241215 - DNA, 352 bp, Homo sapiens
tgcagcaatctggggagcatttattcaagaaaaacattgaatctcagtaagaacattaagaattgtggcattttaacttgccctgttcccatgctgccttttcccagatcagctgtagcctggacaaccgatagcctgcaatcacagtgaaaccaggaggctggcagttactgcaaaagggagaacagaggtgatactcctcatagaccatccccagaaaattgtcatttgactggtctgatggtttcctaaaattgtccattcacaaggctgtctttatttgaccaacacaagtcagtaaggaaagaatagtcttcagtaaatggtgctgggataactggatatccacatt

SEQ ID NO: 241216 - DNA, 1242 bp, Homo sapiens
gttaactgcatttgcagctagaagttaggctctgattcactgttttgtattttctaaaagggttatatgtaatttgaaagatagacctgccaagacgtgagatctgtgttctccttggttagagctaacatttttggtgaggaaagcactgcaggagcaggctggcacagagaagaggacatgcggaaggagctccagctctccctgtcagtcaccttgctgcttgtctgtggcttcctctaccagttcaccctgaagtccagctgcctcttctgtttgccttctttcaagtcccaccaggggctggaagccctcctgagccacagacgtggcattgtgtttctagagacctcagagagaatggagccaccccatttggtctcctgttccgtagagtctgctgccaagatttatcctgagtggcctgtggtgttctttatgaagggtcttactgattccacaccgatgccctcaaactccacatacccagctttttccttcctgtcagcaatagacaacgttttcctcttccctttggatatgaaaaggctgcttgaagacacaccattgttttcatggtacaatcaaatcaacgccagcgcagagagaaactggctccacatcagctcggatgcatcccgcctggccatcatctggaaatacggtggcatctacatggacaccgatgtcatctccatcaggcccatccctgaggagaactttttggctgcgcaggcttctcggtactctagtaatggaatatttgggttcctcccccaccacccctttttgtgggaatgcatggaaaactttgttgaacactataattcagccatttggggcaaccaaggccctgagttgatgacaaggatgttgagggtatggtgtaaacttgaagacttccaggaggtgagcgacctcaggtgtctgaacatatccttcttacacccccaaagattttaccccatctcctatcgagagtggaggcgctactatgaagtgtgggatacagagccaagcttcaatgtctcttatgccctgcatttgtggaaccacatgaaccaggaggggcgggctgtgattagaggaagcaacacactggtggaaaatctctatcgcaagcactgtcccaggacttacagggacctgattaaaggcccagaggggtcagtgactggggagctgggtccaggtaacaaataaagctaacactcgtttgctgctgctgcagtgtggaaatgg

SEQ ID NO: 241217 - DNA, 825 bp, Homo sapiens
ttttagagtgaggtaagtttggtaaacttgcaaaatcgggctgtggcaaataggattttgggaagctggcttctttaacccctccccagcctctctgggcctggcctcctgctgtgatgcccctccctcttcccctggctacttggggctgatttgcacctgctcctgcagatcaacgccagcgcagagagaaactggctccacatcagctcggatgcatcccgcctggccatcatctggaaatacggtggcatctacatggacaccgatgtcatctccatcaggcccatccctgaggagaactttttggctgcgcaggcttctcggtactctagtaatggaatatttgggttcctcccccaccacccctttttgtgggaatgcatggaaaactttgttgaacactataattcagccatttggggcaaccaaggccctgagttgatgacaaggatgttgagggtatggtgtaaacttgaagacttccaggaggtgagcgacctcaggtgtctgaacatatccttcttacacccccaaagattttaccccatctcctatcgagagtggaggcgctactatgaagtgtgggatacagagccaagcttcaatgtctcttatgccctgcatttgtggaaccacatgaaccaggaggggcgggctgtgattagaggaagcaacacactggtggaaaatctctatcgcaagcactgtcccaggacttacagggacctgattaaaggcccagaggggtcagtgactggggagctgggtccaggtaacaaataaagctaacactcgtttgctgctgctgcagtgtggaaatgg

SEQ ID NO: 241218 - DNA, 770 bp, Homo sapiens
gttaactgcatttgcagctagaagttaggctctgattcactgttttgtattttctaaaagggttatatgtaatttgaaagatagacctgccaagacgtgagatctgtgttctccttggttagagctaacatttttggtgaggaaagcactgcaggagcaggctggcacagagaagaggacatgcggaaggagctccagctctccctgtcagtcaccttgctgcttgtctgtggcttcctctaccagttcaccctgaagtccagctgcctcttctgtttgccttctttcaagtcccaccaggggctggaagccctcctgagccacagacgtggcattgtgtttctagagacctcagagagaatggagccaccccatttggtctcctgttccgtagagtctgctgccaagatttatcctgagtggcctgtggtgttctttatgaagggtcttactgattccacaccgatgccctcaaactccacatacccagctttttccttcctgtcagcaatagacaacgttttcctcttccctttggatatgaaaaggctgcttgaagacacaccattgttttcatggtacaatcaagtaagtgtttagggaaacttaaaatgtcaacgaattgtatatatgggtaaactgagggtaaggactcaggtcggagatgggaatagaacccacatttgggttgactctcatttggccctctttttaccatgttgagaactgattcaaataaagagggaagacttacattaggtgcatcttta

SEQ ID NO: 241219 - DNA, 215 bp, Homo sapiens
gccattgcactccagcctgggcaacaagagcaaaactccatctcaaaaaaaaaaaaaaaaaaaaaagagagagaattgggaagtgataggggcctgcatagactgcttttcctacctcctacccctccaaccccagataactttattctctctacctgaatatgtctgaaactcaggagacaggtctgggctagagacaaagataatagctacat

SEQ ID NO: 241220 - DNA, 390 bp, Homo sapiens
gagagaccgaggcaggagaatcacttgaaaccaggaggtggaggctgcagtgagctgagatcatgccacttcactccagcctgggcaacagagtgctactccatctcaaaacaaacaaacaaacaaacaaacaaacaacaaaaacccacaccaccccaaaacttagagttcagggcagttcttcagttccatgtgatgttggctagagctgcagtcatctcagggcccacctgggctagcacatacaagatggcacatcagatgtgtgtggcaccgtggtggggatagcatgaaggctgggcccagctgggttgtgcagtgtgacactccatgcagtgtcagcactattcctctgtggcctctcccccgggataactagatttcttgcat

SEQ ID NO: 241221 - DNA, 418 bp, Homo sapiens
tgttgtgcccacaatctccggttccaccctcactgtaaaatcacgtctccatccgcctgcttgatctttcagccagccgctcctcagctggagaatgggaaataatgggctgtgccagcaagccacactccaagggcagagtgctcagtgaacctgttcaaagtgtggcctgggcagctgcctgagggtcacccgggccatgaaaaggcaggcccctgggtcctacccacatcttctgaatctttagaagggcattgacaaatgctctactgatttttaagtattcctggattaagatattttttctttaaattgtccatcttttactctattttatcttgaaaaaaatcaaacccaggacaaagttgaaagaatgctgctatgaacaccaatatatccttcccttggatttaccagt

SEQ ID NO: 241222 - DNA, 1141 bp, Homo sapiens
ttaaagagtcacttggtaggcgggcgtggtggcgtgtgcctgtaatgccagctactggggagactgaggcaggggaatcacttgaacccggaaggcggaggttgcagtgagccgagatcgcacctctgcactccagcctgacagactccctctaaaaaaaaaaaaaaagccgcttggccattgaaatgctgtgttcaggttgaaaagtaaatacatgtgtatcttatataaagtgtgttaattctaagttggttttctaaattactatgatttcattattgtaagagagaaaaaaagagggaaactaagtttgaggtctttttaactaaggacagttgccaaaagccatctccctgttcttaattgctaccattgatcaagctcagttttaaaaaacacaaaagggcagccgggtgccgtggctcacacctttcatcccagcactttgggaggccgaggcaagcagatcacttgaggtcaggagttcgagaccagcctggccaacatggtgaaaccccatctctactaaaaatacaaaaattagctggatgtggtggcgtgcgccagtaatcccatgtactccagaggctgaggcggaagaattggttgaacttgggaggcggaggttgcagtgagccaagatcgtaccactgcacttcagcctgggcaacagagtgagattctgtctcagacagagagagagagagagagagagagacacacacacacacacacacacacacacacacacacacacacagtgagattctgtctcagacagagacacacacacacacacacacacacacacggaaaaaatgcatttcaaaggaaactactagaaatgttcatattccctttgaccattttgctttcgtgagttttctctgtcacaggtttcctgccaagttaattcaaagcccagtgggactaacatgctcctctctgcaaaatattctccagagcttctgggaatacctcatagctactgctaccaggataccaaaatatttcccaaatacacttgcagctggaagcaagatataacatttcctctctaactccttcttgcctgtgcttttcaaataacctcagctgtgaatggagggcttagaagtccagttgtctcttatttgtttga

SEQ ID NO: 241223 - DNA, 488 bp, Homo sapiens
  misc_feature (62)..(62): n is a, c, g, or t
accgcccagtgccacgcgcgcacacccgcacatcgactctagagagtacccgccacacatgnaccctctcacacacacacacacacacacacacacacacacacacagtgagattctgtctcagacagagacacacacacacacacacacacacacacggaaaaaatgcatttcaaaggaaactactagaaatgttcatattccctttgaccattttgctttcgtgagttttctctgtcacaggtttcctgccaagttaattcaaagcccagtgggactaacatgctcctctctgcaaaatattctccagagcttctgggaatacctcatagctactgctaccaggataccaaaatatttcccaaatacacttgcagctggaagcaagatataacatttcctctctaactccttcttgcctgtgcttttcaaataacctcagctgtgaatggagggcttagaagtccagttgtctcttatttgtttga

SEQ ID NO: 241224 - DNA, 396 bp, Homo sapiens
gcacccagttcttctgaacatattactttacaaaactttcatttatgcctggtgactctcatcaggcattcaaaagctttccctcagtgcttcagggctcttccttttcttccctttatacatacacctttatgtatcttcatacgtaccctgcataacctcatatatcttagcatttaccatattctgttgaaaaactgtttccatttctctttacttactagaatgtaaacagatgcacaatgttgagaaaatgaaaagtgacaactttgtttacaagtttagaaattatcagattctcacttaagctctagtctctgtaaagtccacaactactcaataaaagtgaagaaaaatgttaacagagagggaggaatcaaaaacaaagaactattt

SEQ ID NO: 241225 - DNA, 175 bp, Homo sapiens
aaacaaaccctaagagctgttgtttattccaagctttatgtaacatagctggctagctactatgaacagcagataagattgggcaacatttggtatcaaagataattagaggaatgatgttgatattttcttgttttttgaatgccattaaaattaaaagtaataattgaaaaga

SEQ ID NO: 241226 - DNA, 1097 bp, Homo sapiens
tagggtcttgttctgtcgctcaggctagcatgcagtagcacaatggcagctcactgcaacctccacctcctggggtcaagcaatcctccacttcaatctcccaagtagctggcacacaccactagagatgcacaccaccacgcctggctaatttttgtatttttagtagagacgggatttcaccatgttgcccaggctgttgaagttttagaacttctgagctcaagcaatctggccgctttggcctcccaaagtgctggaattataggcataagccactgcgcccagccctcactgcatttctaattcttcctcttgtttttggaaacagggtctcactctgtcacccaggctggagtgcagtggcacaatcatatttcattgcagctttgacttcctaggctcaaacgatcctcccacctcagcctcctggcttgctgggaccagagatgcccatcaccacgcccggctaattttttaaattttttgtagagaaggagtctcgccacattgcctaggctggtctcgaactcctgggctcaagcgatcctcctgcatttttaaacaaacatggaacaaattccaaatgaagtttttttttaaaacaatcgccttgagactatttattccaacaatgttattgttcggctaaaagcatttggtaaggttttctttcataattaccctcaaagctcctttagataaaagaaaaatcactcatgatcatatagtcacatcttactttgcatctataccaaaccaataatccaacctggtatgatactctagctgctagacttggctctaaagcaacttttagtcattctcagaaatcaaactgatactaagctgacatatcctaaaagttatgccaatgaggcattccagggaagcactgctgaaataaacacaaaaactcccatggtgactacgttgaggaagaccaatattcatttggataactaaatcatgatttattttaaaaaataataaaagccatttctgtcgttttttaatttaatgatagcccagacatacttaaatctctagaaagtgactgtggtttctctaaggtcccctacctcatatagcaaaag

SEQ ID NO: 241227 - DNA, 596 bp, Homo sapiens
tagggtcttgttctgtcgctcaggctagcatgcagtagcacaatggcagctcactgcaacctccacctcctggggtcaagcaatcctccacttcaatctcccaagtagctggcacacaccactagagatgcacaccaccacgcctggctaatttttgtatttttagtagagacgggatttcaccatgttgcccaggctgttgaagttttagaacttctgagctcaagcaatctggccgctttggcctcccaaagtgctggaattataggcataagccactgcgcccagccctcactgcatttctaattcttcctcttgtttttggaaacagggtctcactctgtcacccaggctggagtgcagtggcacaatcatatttcattgcagctttgacttcctaggctcaaacgatcctcccacctcagcctcctggcttgctgggaccagagatgcccatcaccacgcccggctaattttttaaattttttgtagagaaggagtctcgccacattgcctaggctggtctcgaactcctgggctcaagcgatcctcctgccttggcctcccaaagtgctgggattacaggtgtgagccat

SEQ ID NO: 241228 - DNA, 351 bp, Homo sapiens
gagacagagtctcgctctgttgcccaggctggagtgcagtggcgcgatctcggctcactccaagctctgcctcccaggttcacgccattctcctgcctcagcctcccgagtagctgggactacaggcacctgccaccacgcctggctaattttttgtatttttttagtagagacgggatttcaccatgttagccaggatggtctcaatctcctgacctcgtgatgcacccgccttggcctctcaaagtgctgggattacaggtgtgagccactgcgcccagccagatgaaggtttcttacagagctatcagaatacagagtttgtgatactgcacaggcatacgaaatgga

SEQ ID NO: 241229 - DNA, 399 bp, Homo sapiens
caattcttgaatcactatttgctcaaataagcccattaaatttttattgtacctcggtttactctttagcaaaagtaaacaaactaataaaataatcacaatttctgaaaagtgtgatttatttatgaaatttggaatgccccagtatgacaggcagtgggcacaccgctggaaatacagcatgttagaaaggagacaaatttcttgacctcgtgggattttcattctagtgggaagtgacaaaaaaaaatcagcagaaacagccctccttggccgggcgcggtggctcacgcctgtaatcccagcactttgggaggtcgaggcgggtggatcatgaggtcaggagatcaagaccatcctggctaacaaggtgaaaccccgtctctactaaaaatacaa

SEQ ID NO: 241230 - DNA, 231 bp, Homo sapiens
tcccaggttcagagatgtatgtcactattaggaattaagaatgcagccttgagcagcgagccagaagaatcactcctctaaagataggaaaaaaatgccaatttttaggaaataaagctacacaaattgtaagaaaaagctgacctttactgtaagtaattattcagttttgtttcattcagttatctatttccagcacaaaaatactataaaatcattaccacggtttaa

SEQ ID NO: 241231 - DNA, 617 bp, Homo sapiens
gaaaaaaagaaaatttacgcaggctggggcacagtggctcaggcttgtaatctcagcactttgggaggcagagacaggaggatcgcttgatgctaggagttcaagaccagcctgggcaacatagtgagatccctgtctctacaaaaaaaattattttaattagccgggcacagtggcgtgtgtctgtagtctcagctagtcaggaggtcaaggcaggaggatcacttgaacctaggagttcaaggctgaagcgagccatggttgtgctattgcactccagcctgggagacagagtgagacactgtctctagggggaaaaaaaaaacaaaaaactaaagcaagcagaagagttttatagatgcacaccacattgggcagtgaccagtacctgcacccacatgctctgcctgcccacctgacaccacaggtgaactctccttgctcctgtctgtgggtgattcctcccctatccatgtactacatccaggaaatggctgctgcaattctctctttgctttcttgtatcttcttttccttctctttctctcattattcctctctagattattacaaacgtggtaaattttttccatctaaaaaacaaaacaaaacaaaac

SEQ ID NO: 241232 - DNA, 576 bp, Homo sapiens
tatctttgagcagtctattcattatgaacacatgtaatctgttggaacaaagttctaggacaatccaggtcatccttcaatatttgcagaaaacagcacaaagaaaacttgatacttaaacttagttggaaactttatgccacagccattaaatacagagatcatataaaggaatagaggaagctgttgaatactaaactaactcaaatcatcattatccttacgaagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccatctaaagaatttgggaattaggcttctgctgccctctctgctactgacggtcaaggcctcctcattgtattctgtcctccatatctctgctgattcccattttgtctatttccatttaccccactactacttgctcaggtcactctccttcattgtcggtgtttgttcaaattcctcagacccatccacttcccatctaaactt

SEQ ID NO: 241233 - DNA, 391 bp, Homo sapiens
tctgtgggctccgtagtcagacctcattgaaattcttgcctctaccacttgcagtcagcagtgtgctcttgagaacatctcctaactcctgagcctccagttttgcatctatgaaatggagctgttcaaatcactgacctcactgtgtcattgtgaggactgacagatgctgccaattaaagaaccaggcacaagacccagcatatgatcaaaacattggcactattattattcttatgagttactattattgtgtatttgggggggtttgaatgacttgccctaagtcacatagctgataaacagcagagttagatttgaactcagctctgactaatcccagagctcttctaccggaacacctcagggcagcgggtctcaagatgtggtc

SEQ ID NO: 241234 - DNA, 475 bp, Homo sapiens
ttccctttaccacctgttcatgtgcttcatattttgcttcctaggcatggcaagtttgatttctggtacaggagttcatgagtcattcttgccccttattctcttactgggggatattgggtagacttcgacatgtcatcatctcaccacttggtggagaacctgatgtcccagaccccccggcatctcctcatcagggacagaagataacctgttgaggagatggcagggttctgagacatcaatttctccaccaagtggtgagatgatgatatgaggaaatctacccagtatcaaggggaatggggaaattggtacgacttagcctcaacagttacgggagcaaaattatagagagtcattatcttgatttaaataacaaaagcaaaacccagtgacagtgaccattcattggtacagaaccttgtctcaagaaaaccttcaaatttcccatgttctaaaaccgagcgcaata

SEQ ID NO: 241235 - DNA, 441 bp, Homo sapiens
ccatcccctaggctgtgccatgactttctgatttctctcatatatgcaattgtgtttatgtctggctcccaaaaggggaaaatgagaaaaatgaatgggagtggggagggaaacaccagctctttaattctcctggaagtcacttcaaccagaaggtgaggggcttgcaacaatggaagtgcaacaatggctaatgactctctgcacctctgtgatcacgagtggcagttaggaatcagagcacagatctaacgttttgaggacaatgtactttttgcccccctagctcctacaagctgtgtgcaaaccactctaggaacatgtgcacagctgcgtgccatgagattcagtggtaggagatggttagctgctgctgtgccaagactggaaattgaccaattttttttttttttttttgagactgtctcaaattaaaaaaaa

SEQ ID NO: 241236 - DNA, 1806 bp, Homo sapiens
  misc_feature (1)..(1): n is a, c, g, or t
  misc_feature (5)..(6): n is a, c, g, or t
  misc_feature (8)..(8): n is a, c, g, or t
  misc_feature (357)..(357): n is a, c, g, or t
nctanngnttattcatttcatttattactcacaatctttctaggtagctatgctcttaccccgattttacataacaggaaaatgaggcccagagaagttaagtaacccatccaaagtcacacagcctgttttggagtgatcaggattggaacactgtccttttgttttgttttgtttcttattcaagtctgtccccttaattcctgaaccagggggttcttaaccagaggtcccccaagggctctttgaatgggcttcaggggctctgtaaatctcagaaatttatatgtgtacccaggtgggcacatttttctgggagcaatattatataacacccaggattctcaaagcgggtgnggatccagaaaaggtaaaggctggaatcaggccactgtagggaagggaggcaagccactggggaagggggatggaagcggcctcctcccaggcctggggagcagggaggcagctgcttcaaaattcaggctgggctccaagcctgctcctggacctgccctgctttttctggccacacccagctcttaggacctcagctggcaggaagacgtggggcaccatctgagggcaggacactcctttggtcccctccctgattctccccttccctacttcttttgtgagctgaattccttcagagcactgtgacaaggtgaccataccacatgcaccagcctcctccaggcactgtaatcctgcttggaaggagcggggagtgcttgccctttggaagtactgggggacatagacagaccactgagtgacagagacaggaagggaggagaagagacaagttcccagagatgctcaagtcctgggtgcccactctctgcagcctctagaacagccttctcttttggttccaagcttttgctcccctcatccaagggttgggatgatttgtgtcccttcctttcctggcacctcctgctctgtctctagtgctcaactcatttcctgggggaaaccttctctgccctgttcagctcctctgcgctccttagcacattcccctggatgtcactgtcatattgccaagaatgtgttgctttgtctgtctgtcctgcctctctctctccatctgttgtgaacttgggaaggaaggacctgaatcacctctccatgcccctatgccagcccagcatacaccaaggggtccaagcatttgttgagtaaataaactaaataaataaacaagggacaaaaatggagccagacagggaacttagcctgtgcctcagagagaggaccaggggtaggtgtattggttttgccagctgcctgcagatgcgtgcggtgctcctactgctcacaccaatatactcagaggggcccagaagcctcattctctaatgctttttggctatgctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 241237 - DNA, 503 bp, Homo sapiens
acttttctccagctgtttctcccttaccctctcatcaattttgataacttgtactttttctaggagaacatctatttcattgaggctttctttcaaatgcatttgcctagagttgtagaaaatattctcagtatcttctatatacctgttttactttctttctttcattttttggccaacaagagagaaactccgtttcaaaaaagagagaaaataggctggggacggtagctcacgcctataatcccaacactttgggaggctaaggcaggcggatcacaaggtcaagaattcaagaccagcctggccaacatggcgaaaccccatctctactaaaaatacaaaaaaaatgagccaggtgtggtggtgggtgcctgtaattccagctactcaggaggctaaggcaggagaatcacttgaacccaggaggcagaggttgcagtgagccaagatcgtgccattgcactccagcctgggcgacaagagtgaaactccgtcgcaaa

SEQ ID NO: 241238 - DNA, 495 bp, Homo sapiens
ggactaatacagcatccaaattaaaaatcggaatgaaaagcaggtttcatcctcaattcatccctagatcaccacttggaccccagctcttagctccagatttccagagttccaagtctacatgaacatgaaagagtcagggagactgtacatcttggcttgggcaggatggtcctgctttatacttgttgtcctggcataattattaatggcaccctccttcactctcaaaagtgtcctagtttacatgagaagtcttagagccatccaaagtcagggggaatcagtgactaaacacaaacttttaggagcaagttcatttattcaagtttgtgcaagccttcagatgaagctaagtagatttggcattgttttgtaagtataaagatatttaaataaacttccaaaatatcccaacagaacggttcaataaaagcagtatgtcatgaattttaaaatcatagacaatataggaaaggctatccatatgtgaaa

SEQ ID NO: 241239 - DNA, 398 bp, Homo sapiens
agaaaatgacaaccggatgagccctgggctttaataggacacctggcttagaattgaaatactaatcaaattatttgttatgactattttcagtaatttagcatttcacttataaaatgtctcatccactctgaatttctccaattgtagtacatggtgcatcatcctggaccatgatgaggataaaaatatctaccacttattaagcactcactatgttcccaacactgtgccaaacaaagaaactctaattaccttttcatccccattctgtagataaggaaactgatgtttagagaggttaagttacctatccaaggtgtggtaggcaaaataatggctccccaaaattgtccatgtcctaatccccagaacctgtgaatgttaccctgcaaagc

SEQ ID NO: 241240 - DNA, 474 bp, Homo sapiens
ccggttaaatattttgaatagccctgctaagcagtaatgaatataagaggtctagcctcgtgcctggctcatagaaagcactcaggaaaaggtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaata

SEQ ID NO: 241241 - DNA, 382 bp, Homo sapiens
ctcaaataaaaaaaaaaaaaaaaaaaaaaggatagagggcccagaactcccatgtgtctataaatggagagtgaaggattcaactgttgaaggaagctcttgctgaacgtggactagtgcttactgtgcatgctatgcttacgttgttttgttttgaagtgtaaataggtagactcagaaaaccctgcttcctctggtccatctgcgccccctgagggagggatgctccagctggacaagagcttagacactgccttgagggcagcagtagtcagaatgcagctcccagaccgcacccctcatctcccaccagcggacccttgaacaagtcacttaactttctaaatgctgtttcctcattggtaaattgtggacaacagta

SEQ ID NO: 241242 - DNA, 425 bp, Homo sapiens
agtggggtaaggggaaagataagagccccagggaggttggagactgtgggattaggggctcccttcacccaggaaccaaggagctggggcagaggaggattttaaggacaactttggagttagaggataagagtttggagttgggattctgccctttcatgctgagtttctgcacatggccaaaaatctctttagcttggctcatgctgtatcaggcggtcgtgctagcccagggcttgggacactgcccaaattaagctttcttctagggctaagtcctaagctagaggcatgggttagtggctccagcttgccttggggaggtcaaagtaataccctaggcatcatacatcttcttggaggttccacctaacttctagaattagctggtaatgaataaaattggtagcaaatattaaaaaaaa

SEQ ID NO: 241243 - DNA, 491 bp, Homo sapiens
ccaggcatggtgccacatgcctgtagtcccactactcaggaggctgaggtgggaggatcgcttgagcctggagaggtctaggctgcagtgagtgatgattacgccactgcacacaggccctgtctcaaaaaaaatttttttaattaaaaacaataaaggccaaggtaaataaatgggataagttagaagtgaagtaatttaagaaacataaaataacttaggaaaattctaattggttttcatataaaaactcaagatcttgcatccataaaataaaaagtggaggctactgggaaaggaatactcagagggaaaaaaagttattggaaatcttttaattactgcaaaaatcaaaaatttaataagggttataagagaaagtttaagaaatctcccagaacacagatcaaaaagacagatttattaaaaaatattatttacaaggaaaggcagtatcaacccaaaaggtttgatttgactattgggaattt

SEQ ID NO: 241244 - DNA, 466 bp, Homo sapiens
gaagaaaaaaaaaagtgatttggtaattcttgggagctgtaagaccagtcagcaaagagaacattaatcactgggccactcagccagaagaggcctccaagaagggaacaatcaatgaataggtcttctctgggcagacagaagaaaaggtcaaaagcattaagccaggaaaggtaggggcatctcatgtacattttccaggactgtgtgtcagaataataactgtttcaagggaagcagtctggtatttcaagagaggccagtctcaaacactggcttgggaatgtcctgccactggctggtggtccttgctcctttactggagttgtatcagaagcaagtatcacagggccatttgtcttcaccatccctctaggctttagggtggggaagcaggaagtagacaagcaacccaaatggagcaccaagtaatttgaagaatgtcctgtaaaaccagtactaaaaa

SEQ ID NO: 241245 - DNA, 425 bp, Homo sapiens
ttgaataagtagtgtttaattactaaaacttttgtttaataaagagggtcggattttagggtgggaaataacttttggcatcaggtacatttaagcatggatctgttggaaggcaactatgctttctacacttaacacttgttttatgcacctaagttaaggaagacacttgatctatattacgatattaatgaattatgagcatttcagtgttgtagtattaagtttagttaggcttttagacttgcagaagaaccacagaaataggacggttattgcaaaaacaggaggtttagaaaaacaactcttaatcggcattagctgtgtttatcagtactttgtgatacaaatatttttagtaggagggaaaaaaaaccctgaggaatttaagtacttaaactagttagagcccctgtttattcaca

SEQ ID NO: 241246 - DNA, 516 bp, Homo sapiens
gagttctcactcacaccacctgagtcagaatttgtggaactgagtattaaagggtccataacttctttgcaatgtaaagaaattgggccccagagaggtggttaaagttatcttgaattatgtagcagaaccaggaagaaaaagcagttttttgaactgttgcagtacttttctcattctgtcattgctgtcattacctgactgccttcatgcctccatttcttttaagaaactttttttggtggaagacctcagaatcttcatggtattttctttggttctgactagcaatggctaagacaggttatctctcagtgcttatacagaaatcctttaggaatctggaattctattagattatcaatatgttagatatataataaatattagaaacattttatattttgtgtgtattctgaactgtttaaaaagcacaaatattacctgtttctagaggatttgaaaaaatttatctgaaaagaatggaactagctggactcaggtggtgtgcctgta

SEQ ID NO: 241247 - DNA, 130 bp, Homo sapiens
ctgcccatcccagtgaagtaagataaccaggaattttatttctgagagagagtatcctgggcctccacatcaaggagcaggaaagctcagccttggcttcttgagctatatcccagggagctgtatcagc

SEQ ID NO: 241248 - DNA, 973 bp, Homo sapiens
ctgctcttcctgatgagacttttctaggttccagcctctctccgggtgtcccctttttccctcctgccctaggggcctgacctcccggctccactagcttcgttctatcagcagaggtgagctgtgccaccacactttgccatttctcccatgagacatttcagcctgaaaggccgcaggttccaggcctcatgaatctgagccctattttcttagtatcattcagtgtgctgggacaggctgagggtgacaggtttggggcttctctcttggctgttttctgactttccacttcatttgtcttttctcctgactgcctcttggctggggtcttgctccttagcttgtttcttgtgacctgtgggatcttctttttagagcctggggagtagttttattaattacaatgtgtttattaaataaaggccaaggttatagaggtcctgatgtgtcacatgatatcaccttcttgcatttgagaatcaaatacaaaaccaccctttatttttaatttaccacctcacccattccaggcatactgctctggaagtgtccttcatgtgacatctgagtgcctccctaagacctagggtcttagggagtgaaactattctacatgatcttggaatcttggattcatggcattatgcacttgtcaaaacctacagaacttcacagcacgaagaatgaaagttaatgtatgcaagtttaaaaaatcatttaggtcacagaatctcaggaaagaatgtacaatgtgataggagaatctgttttacaaatgtatgaaacaaactcactgaagggcatgagaaaaggtgatgtaagtaactctggaaacgaagagcctaaaaccaaatgcaaaggaactgcacataatcactgtactccagtagacagagttgttacccacagagatatgggttaacaactctggtactgcaatacatatatactggaaatatacgattaagca

SEQ ID NO: 241249 - DNA, 449 bp, Homo sapiens
gaaaatggcctttaaggcacacactcctgaggtttcactgctgggttagctgacattctttccttcacttccctagttgagctgacctcaaagttcttggtgtccaagacttccaaaagaatgcaaaccacattatcttccccacaggggaaaacagaaaaaaacttggatgatacgtcaggataaggaataggtccaccacatggtggacctatttaagaaggaaggagagttccactgcaatcacaccaaaaatcaaggttttgtggacatggatttgtccacataaaaaagaagagtggttttgccattcagtcaaaggcccttaataagcagttaaaaaaagagcaagttgggagccattattcttagtttctgccacacacctgtgaaatcagatgcaagacagaatataaagatccctatctccaaaggatttgaaaaatgga

SEQ ID NO: 241250 - DNA, 338 bp, Homo sapiens
caaataataaacacaaatggatagtcaacacattttttgaaagaacatctgaaagacaaaatggggaatggcgagtctgtctaataaaccattttgagaaaactggatattcatataaagaagtataaagaggactgttatgttgcacaatacacaaaaatcaactcaaaataaattaatgacctaaacttaatatcagaaatgatgaaacttttaaaagaaaacatagggtgaatgtatgtttagggaaactcaaatttatgttcacaggttgcaaaaagaaaaatatgagaaaaacatagaggaaaatgattctgccaataaagtgagttggaaat

SEQ ID NO: 241251 - DNA, 385 bp, Homo sapiens
gctgtttaaagaagttgaaaaatttatctacggtgggcaaggactcagagtcaacatcttatcttggcacaagacaggaggtttggtggttgtaggagacctgtattctttccacacatgcaagtgagaatgaagtcttccacttgacatacctctaactctgatataaaactcagtaagttttggccaggtgctgggattacaggtgtgaaccaggccactgcgcccggcccctttctatttttgtacccattaaatatcccatctctccccaatccccccactaggttgttggaaagacaaaacaccgaaaccatttgtttgggctgggttatgaataaaaatgaaactaggctgttgcaaaggatagtctacttcaccaaaa

SEQ ID NO: 241252 - DNA, 456 bp, Homo sapiens
atgacactgatcctgagtaattcaaatattaggaaagacaattcatttgaatcatctcctttgaagagaatgagtgtctgaacaatggaagtgcagtaaaggaaatgtaattatagcatgcgagttgattgaagccaaaaatatttatctagttataataatataaattctgttcattgattttcaactttttggagtcagcatgcagacaaaacatagaaggattaattttgcttatagagcaaagtctgaatattatcaattttgatagtatgaaaacaacattatgaagctgacagaccttggaagctggaagggaggaagagagggagagtcagtacctctaaaatcttcctcttaggaaactgggagtcaggttctaatgaatatgttgtatggatcaaaaaatagaaggttactgtttaaatttataatagaagccaataaatgagccaa

SEQ ID NO: 241253 - DNA, 394 bp, Homo sapiens
cctttcaaaaaaagcttctttgaccatctcaatctaaattaacctcttcctcccataaactccctttgactccattaagctactgacagtttatgaaattatgtaaattccagtttatatgttaaatgattgcttaatttttcttacattatctttctaactagattgtttgcttcttctggatttgatcccccagctggcacctggctcagacttaattaatgctgcctgttcttgtctgagtttccatgaacttataaatacaagttgtttttgtaaattgagtcccaaacccatatgtttataagagcaaacaccttgagcaggattaactatgtgcaggtatggatattctgttgcatttttttctaaataaaatcttatttattggcta

SEQ ID NO: 241254 - DNA, 245 bp, Homo sapiens
agcattggaaccaagattgggtttatatcccagccctgccctcattagttttgtggttgctcatcgaccctgagctcatctgcaggatgacagtgatgtgaagattggggacggtcattgtctggcaggtgttcagcacattgtgggaagggcattgtttccaaccaccccctggatatttccacctgagtgtacagaatctcaaaaattcagcacatctaaaactgaaatcagagctcccccca

SEQ ID NO: 241255 - DNA, 330 bp, Homo sapiens
gtcctcaacattcataggatctttcttccatctgccaaataaaaaacaaacaaaaaaaaactggaagcacacactaaatgcagaaagaatctcccctttaaaaactgtgagtcattgtgaagacattaagtttattgtggccgatggagaaaggccatttccctgccgctcaaaaaaagatgtcctcatcctgatccctggaagctgtgaatatcttccaggaatgcttaaggtaagatttttgagatggagaaaggatctggattattcagctgggcccacaaagggaatgcaggaggcaggagagtcagagaaggaaatgtggtgatg

SEQ ID NO: 241256 - DNA, 482 bp, Homo sapiens
tttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccctcccctttctttacatataggagatgggatactcattcccgctgctattgataaggtcggaggcggccgggcctctccccagctttcgcccgccccagcgcccgctctccctccgccctcccttggcttccttttgatgtagtggggaacgcgtcctactaaaaaaaaaa

SEQ ID NO: 241257 - DNA, 875 bp, Homo sapiens
ggagaggataaaaggattgggatagaaaaaaaaaaaagaggaaataactacagaaaactttgcaaatttggggaaagagatagtctttacgcatccaagaagttcacctaatcccaaacaggataaacccaaagtaacaaacatttggacacattgtgattaaaatattgaaaacgaaaaataaattttttaaaattttgacaattttgacagcagatataggaaaagacacattccatataagcaaataatgatttgaattagagtagatttctcattagaaaccacaggagacagaagacattggaacaatattttggaagtgctaacataaaagaactgttaacctagtgaagataccccacagaaatgaaagagaaataaacccatttttagatgaagaaaagctaagaaagtttgtcaccagctgctctattctacaagaaatgctaaaggaaattctgcaggatgaaggaaaatgatactggatgaaaaattagatctttaggaatgaaggaaaaccaacagaagggataaatggctgggtaaatatattttttaaaaaactacttaaaaatatgtgtgactcttgaaatcaaaaagcataacattgtctgctggttttttcagtgtatgtagatgtagcatacaagacaactatagcattaaggctagtggaagatggagtaaaagaatctatggttgccaagtttctacatatcatatgaagtggtacaatataaactcttaagtagaccgaaagttttggtgcatatgttttactctcttaggacaactaataagaaaatgcaaaaatacaaaaggataaagccaaaaagtcaatagagaaattaaaattaaatactaaaaaatat

SEQ ID NO: 241258 - DNA, 178 bp, Homo sapiens
tacaagtaatatggtgctggattttgaatggctgttagtaagacaaacagctccacaaagtcaattctctccttaatacccactgtcctaaacattttgcattagtctttcttgttctcagtaccttacataatcacatttgcatcccatctgtccccacccccaccatgatttttcc

SEQ ID NO: 241259 - DNA, 501 bp, Homo sapiens
aggggagatggtctgttttccttgtgttaaggttaattctttgggatcctaaattcattgagctgtttctttctacatataactaatttttgaaggttaaagagacagtgtaaaatcccaaagtggtgatcatcaatgatttttcaaactattagatgaaaagcttactgtggaatttatgatggatcagtctgtcctcactagtgatcagttttaacatcactaaaagtaggacaactagacattatgttcctgctgatgtgatgcaagaagaagtacacagcaccacctgggaagtattcttgccaagtaaattgaacttgaatctaatcagatctttggactaactatcagtttacaggaaatactagagatggaggaacatgttagatggcacatcaagcatattgttcaccaaatctagaatgtgaaaatttttttttaggacaaatggcccaatttcctcagttaataaatgacctttttaaaataaaaaaaaaa

SEQ ID NO: 241260 - DNA, 509 bp, Homo sapiens
cgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaa

SEQ ID NO: 241261 - DNA, 364 bp, Homo sapiens
ggtccttgtacttttttctattttgtcaactactggactttttttcaccattgtgcatcctagttttgaagtcaaaatcccaatttatttgaaacacaatgtggtttagcatattagtttcctagggctactgtaacaaatcaccataaacttgatgtcttaaaacaacagaaatttattgtctcacagttctggaggacaaaagtccaaagtcaaggtgtcagcagagttgattccttctgaacactctgagggagaatccattccaggcctctctcataccttttagtgcctgctagcaacttttgacattccttggcttgtagaaatagcacttcaatctctgcctccatcttctcattgc

SEQ ID NO: 241262 - DNA, 1282 bp, Homo sapiens
gccactacactccagcttgggcgacagagggagactctatctccaaaaaacaaaaagaaaaaaacaaagtaaagctcatcaaaatatatgcagcaactcagttcacctctctggttttgatttctctaaccatatgaccttgggcaaattaccccctggaggacttgacttcctaatctaaaataaacactcaagatgatatctacttcacagagatgtgaattttgaatgagataatttagattgaaagcaacatgtgtatgcatatgtacttcctactttaggccagagccatggcctaagtttattaacaagactgctttttttgttgttgttaaccaaacagcatctcactgttgcccaggctggagtgcagtggcacgatcatggttcactgcagccttgatctgagtgagtggctgggactacaggcgcacactaccacactcggctagtatttttaaaatctatttttgtagagacgggattttgctgtattgcccagctggtcttgaactcctggcctcaagtgatcctcttgcctccgactcccaaagtgctgggattacagatgtgagccactgcgcccaaccggtaacaagacttttaatagagacacctgaaaggtcctacagtttgatttgtataaccaactacatgagcattgcacaggagaagggcaatttagcatctctaaaaagattaaggggattttgcttctagcaagcttgatatgaattagtaataggatgtgactgctgtttaccaacaacattcagcaaagattgattgattgattacctaaccatgtaatggacgtttaaaaagtctattcatagaaatatccaaaactgcaatttcccaagagtaagttctgcagagactcacttgatgttctggtttgggaaatggcaggctaaataactaaacatctctcttctgggaatttctgggccttgagttattgtgcattgtgaatctccaaaaaggggcttgcttttacagatctttggtaacaggtggaacagggctgctggtggtttgtgtgtttctaggctcatcctattgcatctggacaactccgttagtgtggtcacaactctttgtcaagtgtagacaactgggccagtatgcagagagcgcagcctggatggggagtgaggttgtgatgatgaagttgtgatgatgaagatgtgaagttgtgtgaagttgtgatatgggaggggcacacatagaaggggcctgagtgggagagggtgtctggggaaggttgagagagaac

SEQ ID NO: 241263 - DNA, 1228 bp, Homo sapiens
gccactacactccagcttgggcgacagagggagactctatctccaaaaaacaaaaagaaaaaaacaaagtaaagctcatcaaaatatatgcagcaactcagttcacctctctggttttgatttctctaaccatatgaccttgggcaaattaccccctggaggacttgacttcctaatctaaaataaacactcaagatgatatctacttcacagagatgtgaattttgaatgagataatttagattgaaagcaacatgtgtatgcatatgtacttcctactttaggccagagccatggcctaagtttattaacaagactgctttttttgttgttgttaaccaaacagcatctcactgttgcccaggctggagtgcagtggcacgatcatggttcactgcagccttgatctgagtgagtggctgggactacaggcgcacactaccacactcggctagtatttttatcctggcctcaagtgatcctcttgcctccgactcccaaagtgctgggattacagatgtgagccactgcgcccaaccggtaacaagacttttaatagagacacctgaaaggtcctacagtttgatttgtataaccaactacatgagcattgcacaggagaagggcaatttagcatctctaaaaagattaaggggattttgcttctagcaagcttgatatgaattagtaataggatgtgactgctgtttaccaacaacattcagcaaagattgattgattgattacctaaccatgtaatggacgtttaaaaagtctattcatagaaatatccaaaactgcaatttcccaagagtaagttctgcagagactcacttgatgttctggtttgggaaatggcaggctaaataactaaacatctctcttctgggaatttctgggccttgagttattgtgcattgtgaatctccaaaaaggggcttgcttttacagatctttggtaacaggtggaacagggctgctggtggtttgtgtgtttctaggctcatcctattgcatctggacaactccgttagtgtggtcacaactctttgtcaagtgtagacaactgggccagtatgcagagagcgcagcctggatggggagtgaggttgtgatgatgaagttgtgatgatgaagatgtgaagttgtgtgaagttgtgatatgggaggggcacacatagaaggggcctgagtgggagagggtgtctggggaaggttgagagagaac

SEQ ID NO: 241264 - DNA, 882 bp, Homo sapiens
atttgcagagcatgttactagcaatgagggacggctgagagaaagagctccagaaatctgcagagggatccccctgagccttctgctgaatattaagtgctagctgtgtagggtgaaatttgcaaagcaggcaagaacaactgccatgaagctttgaggtgaactattcacagtgcttgcatcaggctggggacagccattcgaaacagccacaatggagacagcttattaaacaaccagggcacccaggagagagcccagaagggacacaccttgatggataaaatagttctaaaggctactctagacacacaaacagaacacaacaacaagccaacaagtgatcaagctgatctacaagtaactcactgcctgctaacacaagtgttaacacttttaagggaagcaatgaaatctaggcactcaacatggtaatatctacaatcctgttttactagaaaggagtaaaaacaggaaaacataacccatagctggaagaagaatcagtcaaaaacagatcgagaaatggcagattatacaatttaaaacacctattttacacaaaaagaataaaatacctaagaatacagctaaccaaggaggtgaaagatctctacaacaagaattacaaagcactgctgaaagaaatcagagatggcacaaacatggaaaaacattccttgttcaaggataggaagaatcaacattattaaaattgccatactgcctagagcaatttatagattcaatactattcctattatactaccaatatcattcttcacagaattagaaaacaaaactattttaaaattcatatggaaccaagaaagagcccaaatagccaaggcaatcctaagcaaaaagaacagctggaggaat

SEQ ID NO: 241265 - DNA, 406 bp, Homo sapiens
gcaggctttgcgaccttgtgaggcttgggagagaagcctggttctcatttgaacagatgggcctgtttgcaaatacttcctctgataccctagaacagacaacatcctgtctgaggtgcactagggccccgtcttacagaagaggatgctgatgaccagggaagcccattaataaggtcccactgctgcctggagagcaagcaagtcagaggtcctctggggccagtgggccggtgctgagcagcccacccagatgcagttgatgcagtggaggactctccagccctagaagactaccgagatactagaaaggaggtgccttgtccccaaaagactgggaggagtggaacatcccagctagctcactttaggctattactgcaagaaattaaacctgtatagtgtt

SEQ ID NO: 241266 - DNA, 498 bp, Homo sapiens
gccaggatggtctcgatctcttgaccttgtgatctggccacctcggcctcccaaagtgctgggattacaggcgtgagccaccgcgcacccggccgtcactatgtatttataattactgttctttgaaaatcgaagtaactttcatctacccagtgcttactggtttgagaaaaagctttgttgcttttatttcagaagattaaaatttaattttccagtaaagattccttttgctccagtggaattttgaagcgttatacttgtatgaagaaaaaaagaatttcaaaatttataatttttgtggtaccatagaggggatactacttaattatgctagcactgtctgcagaggtctaaaaaaccataggctgctgtctatattgaacttgttaagattccttttgtttcacagtgcctgaagattggtcatgaaccagtaatagccattaaacaatgtctgttctcataagagatgaaataaatacaaattaaaacaac

SEQ ID NO: 241267 - DNA, 426 bp, Homo sapiens
cagcttgtgacttagccaaataaatcttctgattcctagtaaagtgtttttcattatacgaaatgccagctatgtaagaggagattaaaagtactaagaactgtaagtactgcattgattatcatatgctaaccatgggccaggcacggtggcacacacctataatcccagcactttgggaggctgaggcgggtggatcacttgaggtcaggagttcaagaccagcctggccaagatggtgaaacccctgtctctaccaaaaatacaaaaaatttgccagatgtggtggtgcatactggtaatcccagctactcaggaggctgagtcaggagaatcgcttgaactcgggaggcagaggttgcagtgagctgagatcgtgccactgcgctccagcctgggtgacaaagataaactccatctgaacaa

SEQ ID NO: 241268 - DNA, 683 bp, Homo sapiens
  misc_feature (586)..(586): n is a, c, g, or t
  misc_feature (590)..(590): n is a, c, g, or t
  misc_feature (594)..(594): n is a, c, g, or t
  misc_feature (611)..(612): n is a, c, g, or t
  misc_feature (615)..(615): n is a, c, g, or t
  misc_feature (627)..(627): n is a, c, g, or t
  misc_feature (659)..(659): n is a, c, g, or t
  misc_feature (676)..(676): n is a, c, g, or t
ctaataagcccagggaagaagagtcagacccagtgccagcgcaggggaaacgcatctaatccagaacagcagacacagctcctctcccatggaacacccagagcagacattgccagtcgatcccagcaccctttccccgggagcctgggctcagcctcaagactttgcttccgcttcacaaagctctgcacagccagttctcatcaattggagttggtccaaaatatggaaactctttgctctgcctgacccaaaccattcctctttcccataacaattctgacatttaaaaacagcagaattccccaacactcatccccgggaaaagaaatttggcattgttggtactttcaactcctgaccctggtcagctgttgagtcaacttgtggttgagtctgagccccatttctgcagacagaaagaccgcatttgcgtttctgagtctcaggtttaggatgaattttgtatagtcactgtaacaaattactgcaaacgtagtggcttaaaataaaacaaatccattagcttaccaaaaaaagaaaaaaaaaaaaaaccccgagggggggggcccggggaccccaattntggncccnaaaaggtggagccgggnnttnacaaattcaacntgggccggccggtttttaaaaaacggccgggngaccttggggggaaaancccctgg

SEQ ID NO: 241269 - DNA, 568 bp, Homo sapiens
ctaataagcccagggaagaagagtcagacccagtgccagcgcaggggaaacgcatctaatccagaacagcagacacagctcctctcccatggaacacccagagcagacattgccagtcgatcccagcaccctttccccgggagcctgggctcagcctcaagactttgcttccgcttcacaaagctctgcacagccagttctcatcaattggagttggtccaaaatatggaaactctttgctctgcctgacccaaaccattcctctttcccataacaattctgacatttaaaaacagcagaattccccaacactcatccccgggaaaagaaatttggcattgttggtactttcaactcctgaccctggtcagctgttgagtcaacttgtggttgagtctgagccccatttctgcagacagaaagaccgcatttgcgtttctgagtctcaggtttaggatgaattttgtatagtcactgtaacaaattactgcaaacgtagtggcttaaaataaaacaaatccattagcttacaattccagagattaaaagtccaaaatgaatctttaaa

SEQ ID NO: 241270 - DNA, 513 bp, Homo sapiens
tggcagaacggactcggggctgtccttcgtggcccggaccccgcgaggcctgtccttccacctctgtggggaccaagagggcaaggatcgtgccaggctcaccgtgggcgctcagtaagcggccgtgcagaggacggttgagggctttgtgcagaggaaatgagagactgctctgaagcaaggcccgcctagtgagctgctaggaaaatggaagtctgggattaatcgtctctacaaggagggtgcgtgggaggcaccaaagcaggcggtcacagctcccgcaaaggcagccggctctccttccccgcctgacgctcagggactactcgcacagactgggctacttccttcttcattcattcatcaagtatttattgagaaactgctaagtgccaaatgctttgttctgggcattgtaggggcagaaaggtgtgatattttcccttactcatcccaaaggtcacagcggacactcctacaaataaaatataggttagcaagagaaaagcataa

SEQ ID NO: 241271 - DNA, 349 bp, Homo sapiens
tggtcagctttattgcaaaatttgcacacaacagactgtttataaagttttttgaaattgcaggccagggtggtggctcatgcctataatcccagtgcttagggagactgagacaggaggattgcttgaggccagcagttggagaccagcctggacaacatagtgagaccccatctaaacaaaaaatttttttaattagttgggtgtaatagtacaatcctgtaatcccagctgttcaggaggctgtggcaggaggatcgcttgagcccaggaggtcgaggctgcagtgagctgtgatcatgccactgcactctggcctgggtgacagagtgagaccctgtctctgggg

SEQ ID NO: 241272 - DNA, 918 bp, Homo sapiens
attaatattttgtttgtttttattgctctatatagtccatggcatgtgtatattacaatttgtttatccattcaccagttgatagaaatttgggttgttttcagttttgggccattatgaatatttgcatacctggtttcatgtggacatatgtttttatttctctaggttgaatacctaggaatggaattgcttggtagtatggttaatgaatgtttaccgttataaggtatttctatactattttgcaaagtggctgtaaggttttatgttcccaccagcaatgtaggagagagtttcagttgatctgcatcttcatcaacacttggtattcacagtctatttaactttagtctttctagttggtgtgcagtggtatcttgtggttttaattagcatttctctgaggattagtgatgttgaacatctttttatgtgccaattgactatttgtatatcttcttttgggaaatttctgttccaatctttggtctatttttattggtttttttgatcttttgattgagtcttaagggttctttatatattctgaatacaagttcattgttttgaaacattttgcttccaatctgtggcttacctttgtgttttcttaacaatgactttcgagaagcaagacttttaaattatacagcccattttcaattttttttcttttatcatttgcacttttggtatcctgtttatggaatctttgcctaaaccaatgtcacaaagattttcttcagtattttcttctagaagtttaatggttttatctctaacatttaggtttataaacatttttgagttaattttatgtataatgtgaggtaaagtttgaggttcattatttccatgtacgatatccagttgtttcttatctctgttggattatcctggtacctttgttgatag

SEQ ID NO: 241273 - DNA, 1666 bp, Homo sapiens
  misc_feature (83)..(83): n is a, c, g, or t
  misc_feature (151)..(151): n is a, c, g, or t
  misc_feature (399)..(399): n is a, c, g, or t
  misc_feature (804)..(804): n is a, c, g, or t
  misc_feature (834)..(834): n is a, c, g, or t
  misc_feature (853)..(853): n is a, c, g, or t
  misc_feature (908)..(908): n is a, c, g, or t
  misc_feature (1106)..(1106): n is a, c, g, or t
  misc_feature (1204)..(1204): n is a, c, g, or t
  misc_feature (1342)..(1342): n is a, c, g, or t
aaaaaaataaaaacaaattaaaagtagttacctctggaaagagagggagggaaatgtgattgagaaagattatgtaggaaatntcaaatgtaagtacatacatttttttcttagataaaacaaaaataaaaatctgtaacaaatatagaanaaaataagatttgatatagctatataacagtaaactgatgttaatgatattatttcctatacctttctagatggtagaaatatttcactgggaaaaaaaaaagaacaattgaccagaatagattgtccaggatgcggcgaagtgaataataagagaaagggttggagaatttgcccagaagaggaaacagcacatacacagtgggctggagcaagtggacacagtcagggtgttggtagccgttctcngtcaacatccagaatattgttgtctacttctgagggagacccagagactgaagatgaaaagtagttagatttgaaattatgtttcctcgtagtaacatgatcattccttatattcaagcctagacagtttcatatcaacatttctccccaccatagcgctctggttagattacataatatttgctcttctcacatcctctaccaattataactcaattcatactagataagtataattgattttaaaaaaccctaatgtatttaaaaattagacttttctttacaaaataatagtgcattttgatatgacattaaataaaactaagaatgctttgattaaaatacaggaaaagtgaagtttaggaatagtgctatgctctagtctcctcttggctgtatggttgntgtgccttgtgagaattctcactgttacanggctataggagaagcatgnttacagcaaatctctgattcagcagctagataaacaattctcttgaaggaggtgnaaatttcttcctccttagagaagcatttgccacaaaattagagtcctatggggctgctctgctaatcttgcctccaaactaacttagatctgatggagacaagagatgaaaaagtgaatgttgtgagtttgttttcagaaaaattcattgattagaaagtgataatttagtcaacttgattatatcatatagataaanagtccttgggggtttgtggaataaagcatctttctcatctgaaatcagttaaaattgcctggtagactaagtgaataattttctccatgattagaacngacaatgaattcatatatcttcagggcatactttccactctataataatccagtgaatactctttggaataataggtcataacagttcctccagcttcagagttaatgaggtaacacaaattcccacaccatcacaangtgagatgggtcatacacaatatgagacaggttcatagaagttctttctcattttcctctctaatcaccatagctttcctaatgaaacaaaacaatctgataaaactttgctagaattaaacctgaattattaggcaagaatacagtgacataagaatgtcaaataaaagaacattggttttgataaatttaatatattcttattacaggccaattagaattttagatagaaatatgtgataatgtctatttatataaagcaagaatatagaaaagactgaaggaatgaaatagttaaagaatgaaggaggaagaaaggtatgg

SEQ ID NO: 241274 - DNA, 590 bp, Homo sapiens
tggtagcagcctagacaagcagccggtagagatataagacaatggcccctcggttgtggttgccatagcccttagtatgttttatcacttgcttagagttttgttccaaaggcaggagccatgtggcagtgcactttcagtgcctcaagcattgtttgtatgtatagttcttgaaaattcatctcactttgtcacgtcacaagatgaatacgtactcagacttgatgtgaaatgctttcttttgatcatcagtgcagacacagtggttcgacttcattagtcagaggtggggcccagatactgatgttttttcaaagctccccagatgattctgatgggcagctgatactgagattttttttttttttgagaaacacagaagcatataaaacaacaatctgttttgcatatatgcagtacttggtatttagaaaagctgtttatagcctattcctattgtcaacttgaattaccataaggaaatatatttaaagtttagccttatcacctgtttgcattaggcagtggtctctaagaagcctaacaggtatttgtaagaaaagtaaattttaagcacaactcatccatct

SEQ ID NO: 241275 - DNA, 357 bp, Homo sapiens
aatatctaataaattaataaatatttaatacattaatagatggataaatgaacaatcaaccaaataagtggacatgtattctaggtatagcgacaggcataccttattttcttgtattttacttttttgtgcttctcagatattgcatatgtttttttaacaaattgaatgtggcaactgcataaaccaagctggtcagtgccgtttttccaacagcaagtgctgacttcatgtctctgtcatattttggcaattctcacaatatattaattttttaattattatatctgttatggtaatctgtgatgtctgatgttaacattgtgactatgcccatataaaatggtaaacttaaca

SEQ ID NO: 241276 - DNA, 352 bp, Homo sapiens
ctcctgcaggggactaggaggccggcttttatcagctcatgagcttttaaaaatggagagaagggcaggtgtggtggctcatccctataatcccagcactttgggaggtcggggtgagaggatcatttgagccctggagttagagaccatcctgggcaacatagaccccgtctctacaaaaagtaaaataacagtcagccaggcatggtggcacacatctgtagtctcagctacttgggaggctgaggtgagaggatcacttgaacccaggagtttgaggctgcaatgagccatgattgtgccactgcactcctgtctgggtgacagggagagatcccttctcttggaagag

SEQ ID NO: 241277 - DNA, 1920 bp, Homo sapiens
gtattcctactgtgctctctgaggatgtggatgctgttgatctgcggaccacactttgagaaatacacaggtgacagctgtggtggaaagaactcccatccaggaatcaaaacatgtcttcacattttggccatggaacttgggggtcttgctttgttgctcaggatggagtacagtggtgcaatcttgtctcactgcagcatcgacctctggggcttaagccatccttgcacttcagcctcccaagtagctggtactacaggggatgcaacaacaaggcgccatcttggaagtagacaccaggccctcaccagacaccaaacctgctggtgcctcgatcttcaatttccagcctccagagtgtcatggtttctggaagaaaagactcaagatgttctcagtagctgctgttttcagacatcatgaaagtcttctcctaccctctataaaaacaaacaataaaactctacaaaggaaaagcccacaaaaacatgctgactttagaagaatccatgatttagaatatttttataaatatctaagaaaacaggagtcctttccatatatatggtccttggagatactttccatatatatggtccttggagaatccagtttttatgagaaaggtgatttccaaaatctcttacactttacaatttcaattttggcctgagcatatctctcgattgatctacctacctacatactgatctatcttggatagagcactggacaaaaggtaggcactgtttacaatccactgacaagaaaacacatgaagaagcaaaccccacagcgctctgaaacctggaagagatgggttctacatgggtctgatgggattactgtactaaccagcctccgaatatcccgctccgactcccacttgatcttcgagatggcttcttggtgggactgatgctcactccgaaggtccccagccttgattttatctgcttggatcatattgctcagagcctcgtccacctgcttcttggccgttttcaggtccgcaatttcctgtaagagcttaaggcgctctgtgtcaaacagtttccgggcctcctcccgggcctcaatggtgagcgctgtccttactttgtcactgctgccgtcgcggagagcacagagagcagacttgagcctctggatctctccatcacgtaccttcaccgtccttgacatttcctgctcgtgctgcttgataaggttctccctcacagcctgcagctccttcatcttctcctcatggagcttggctttgagttctgtcaccagcaccgtgtgcttgcgctgctccagctcacgaatcctcttcgcttcttgagtcttctctctttcaagctttgatacctaaaaacagagaggcgaaatgatgaagagaaatgagcctcaaaggacgggtgtgctcctaggcaggatttgcagctcaggccgctgtgatctcttaattcctcatctcttttccaattccaggccctctgagaaaaaagaactacaggccttgaagctgggaatacagtgtgtaagaggaggaaatacctgaggatatttatattactttgttcagatgaatatttgatgttctggggccttactatgcaatgtgtggtctgcagacaagcagcctcggtatcacccaggaagcatgttagaagcacagaatccctggcttagccccagatctatgactcagaatttgcatcttaacaaatccccatgtgattggtatacgccttaaaattagaaagtatcgctatcatggtttttccctttacggggaggactgcaaaacagatcgcctggagagctttttagactacacaaccctagctagatccaaactgataaatgtgtgtcttagaatagctcacagtttgatattgtgataaggctaataaattagtgcctcaagtg

SEQ ID NO: 241278 - DNA, 2200 bp, Homo sapiens
  misc_feature (1600)..(1600): n is a, c, g, or t
  misc_feature (2190)..(2190): n is a, c, g, or t
aaaaatttaagagattgaggtcattttaactacatttttttaaatacggttacagatttttaactatgaataaggacgttagcatacttagactattcctcgttctccccacctcccttatacttagttccttcatgttttcctgaactaattttatttttgccttatttttcttaaaaacttttaatttctgctattttgctatattttatgatatgttaagccatccttagtttataataggaacatggcagaatataaataaatcatagataaacatactagaagttattataatttaaaattttgataattctgatttatgatttaccagtaattttttggtatgcaatagtatgtgtaatggttacttctagttctgtattcactattgaaagcacgctttaaagcagcccagaagtctctttaaatccgtatttacctctacactaataaatctctataaattgttgtgtcttcaatttaccattaataagcagtagaaaaaattgttttgctttgctttggtactactgaaattgtgtgttctaatatagtgaggccatgaggtgagtgactcctagtttgctattttttaaattacaggctgttaagtcagatctgccaggatcaggtcctaaaagtgctatttttcacacatcaaaatccaagttgaaatactggcttgtttgttaagattaattaactataggtaatacttgcaccttgcctcattaaaagaagaaaaaatgccccactatattcactcacagaattttagtagaaaaattaatgatgaatgtaaacaaacttcatgcaaatacaacatttttaccatttaggaaaaagaaaaacatgatttttccccctccaaaatagagataattactgataacgcaatttgcagctgttttcttcatgtgacctctgttttttttttgttttcaagtatcagaaaattgcaaacttgaccatctgatctcaggtagttgagcagtattgggtgttaaaaaaatactggaattagacacatagtagctctgtcataattggatttgaactttgacaagtttcttagccctgtgagcctcagtttcatttgaaaaatgatgggattaaactagcaggtcactaagtgccttctatttgtaaaacctttgttcctaactgagctatattgaaaatatcagtgccctcttgagtgttcctatatcaagttgcattgcagcaattttaaaacattgttcaaacaaaatacattgactttgaaaaataaaaatatctttgaaaagaagtatgaaatgaaaataagtaaataaaaaatatgttgacttcctttaacttaagctttaagtggttttgtgaaataaaacaagtgtaactgagtgtccaacctcaacacatcagtgatcatatttctgtgacaagaaccacattgcatctctgaagccctgtagtacttccccgggtttgtcctgcagaccaaggcacattgtagttttaaacacagactggaaatgttcagaagattcagtggaagtcatggaccaggaaagatggagttggtggtaattcagacaattagtttatttgctctgangatttctctaggttccagaagtacatgttttaaattatagtggctatttgtcccatgaattacctgaaattaaacagtttaattttaaaaaagcagtatttatttagaaattaaagatttttgaaaaatttgcatatggtaatgaataactttatcttctattagatgatcatcatgaaaaagtaaatgaatgtatttaaattaatgggtttcaaagattagacacaagccctggactttcaaaatatatcttttagattataaaaataattcatgctaatcatagaaattttataatttacaggaaagtataaagaaaaataaatttatcagtttcatcatctggagataactgctgctcccatttttctgtacttttttctttttccattcacaccaacaaaaatattttcactttaagtgtcagtgggattatattgtatatacagtttttgattcctccccttcccactcatatccttatatgattatagaaaaatgtctctaattgctacataatattcccttgttttgaccattcaaatatcttgccagcttttaatgattataaatactgctacaataaaganccttgcatat

SEQ ID NO: 241279 - DNA, 497 bp, Homo sapiens
actctccttcaccagcaagaaactgggaaagaaaattgcccctcttgagttgatcactcatatgtaaactgcccaccccactgcagttaacaccctgggttgggtttgcaatggttgggggaatcccagggcatcagaaggaagtttggaggacatgtggcggtggtctaatcattagcaggattctgcaggaaacgacaagtttaaggagccagatagctcatggccaagaggagagtcacagaaagatgatgacgccaacttgggccagccctgtactataggagtttgacaaaggggtctatagacaccaggccaggggtactccagtgtgctccacataacagcacctggacacaaaccaagcccctactgcaacaaggcatgctcagaaattgacagtgagtgtctagaaactgctatggaaacaggacgtcgtaattttatgtctgttgaatctaacaagaaaaaaatagagcttaccttttgcaagaaaa

SEQ ID NO: 241280 - DNA, 476 bp, Homo sapiens
  misc_feature (28)..(28): n is a, c, g, or t
gacaaaaaaaaaaaaatagcacagtgtntgtatatgatatgtcactctcatgtgcaattacttgaaaatctgtaataaaatgggcttatctgggagttgctttaaacatatttttcggctgggcttggtggctcatgcctgtcatttcagcactttgggaggccaaggtgggaggatcacttgagcccaggagtttgaaaccagcctgggcaacatagggagacccccatcaccctatttttttttttttgatacagagtctcgccattgtactccagcctgtgtactccagcctgggtgacagagtgagactcaatctccaaaaaaaaaaaaaaaaaaattagccaggcatggtggtgtgtgactgtagtcccagctactcagaaggctgtggtgggaggattgcttgaacccaggtggtcagggctgcagtgagccattattgcccactgcactccagcctgggtgacagagtg

SEQ ID NO: 241281 - DNA, 480 bp, Homo sapiens
agctgtgcctgcacttattccactgaaattgtggaaatgatataccatctacctgagaggattgttgaggagtttatgggaggaaatgggagaataatttgtttagtgtcagttaaagaactcctggcgtattcaacaaatgtgtctccatctgctatgtaactactccaactcaatcctatcaatatgtattgagtatcagccaggcacggtggctcacacctgtaatcccaacactttgggaggcggaagcggggggatcatttgagttcgggagttcaagaccaacccggccaacatggcaaaaccctgtctctactgaaaatacaaaacaattagctgggtgtggcatacacctgtaatcccagctactcgggaggccaaggcaggagaatcgcttgaacccgggaggtggaggttgcagtgagccaagatcacgtcactgcactccagcttggacaagaatgaaactccgtctca

SEQ ID NO: 241282 - DNA, 284 bp, Homo sapiens
tgtgcgagccgagtcagcctggccctgagcctgtccacctccaccccactcagggcccctcatctcctgcagccccaggggccttgggaggttgacctttgttggagctcagaaaacaataccccaaaatgagggactcagaagcagcctcaaaagctaaagttggctgagtgtggtggctcacacctgttatcccagcattttgggaggctgaggtagaagaatcacttgaggtcaggagttggagcccagcctgggcaacatagtgaggcccccatctctat

SEQ ID NO: 241283 - DNA, 361 bp, Homo sapiens
tagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcacca

SEQ ID NO: 241284 - DNA, 450 bp, Homo sapiens
tgcataggcttctccctaacctggagcaagtcaaaataatagagacagtcttatattccttgtctcgggtcgacggaatctgagacgagtcaaggtaacagaggcagctgtttgaatagattcatcggagggtctaaggcagtctccagaccaagctgtaagggaggtaagatagaaataatcattcaggtaccacagtagacagaccttgaaggtaccagggccctcacagcttaatcagacttagcaagcattttttgcctctgaccttctagttgaaacaaaattagttatcagtggacttaggcgaatgctatactgtacgtagacacataaccccaacctatataaacactaagaatactgtaacatttcgagttggtctggtggagttatctccagccttctctctgtatccagttacagcaataaatccccttctttcctaaa

SEQ ID NO: 241285 - DNA, 429 bp, Homo sapiens
tacagaattagtccccatgagtccctaaacaaacaaaaaacaacagcaacaataataactgtggagggtggggtcataatccagaattactaaaatatatattatctacagtgtcaactttttaacaattatgagacatgcaaaacaaacaaactgcacacacagagaattctggtccatacacaggggaaaaaaaaataccagtccactagaaactgtctctgaggatgtccacatgttgcatttaatagttaaagacttggtgtctttatatattaaatagccacgtgtggtggtacatgcctgtggtcccagctaatcaggaggctgaagcaaaaggatcgcttgagcccaggaattggagactgcagtaagccatgatagtgtcactgcactctagcctgtgctacagagcaagacactgtctca

SEQ ID NO: 241286 - DNA, 284 bp, Homo sapiens
cttggttttaggcatggaatgaacctctctgctcatgcttatgaagctgttacttggtcaacaattaaaacttagaaggatagatgcaaataaggagagaaagttttcatctttttctatgttttgaaaaattacagcctaactaaagctgtcattttaaacaagctttttacctttttaccaacttctacgtggaaaacaaaacaaatggcttctgtgagaagcctggaaacctgaattctggttgaggcttttttactagtttgtcagcttcttctttcaaa

SEQ ID NO: 241287 - DNA, 378 bp, Homo sapiens
ttctggcgacctagttttatactattcattacagaaataccatgaagaccagtgggtaatgtcctagagttgaacttacatcaaatcatacctaactgttttcatatttgaaaaaccttaaaaacaatgaattcataattctattgtaaatgattttactatactgtagtaaatgattaaactgtaaacaatatgaataattcttgaaagcataattatgtagacagtttcttttagattaacatgataaaacaattaaagaaaacattccaaatgggataaaattaatcaaaactgcatattttcaatgacttggcttaattatcatgcttttggaaatggccagatgactaacaagaaataaaaacaagattttga

SEQ ID NO: 241288 - DNA, 2277 bp, Homo sapiens
atctctttgcattattacagttgttgttatttttagttctatttatatgaaaaatgtactttttagcccacaaaaatagcatagcagcagcttatcaaaatgtcccagacaagtttacttcaacaaattagtaacaccttcatgcttcctgtggtggaagaaatgcagagtccacttcctcccagtgaacatctgagccagatttctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggcggggaacttacaaggattagatgaggggatatgtgtaaaggcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctgtgtcaaatatcaacattttaccaggtttctctgttgttgccaaacctgtcatttttatttggtgtggcttcttgggaaacttccatggcccatttgatgggaatcaaacagagtgaaaacaaggacagatgcagcagaggtggcatcaggaacaaatgggtcataagaacttaccttggcagcagccccagaatggtcaggaggaaaggcactttaaggtatcagaaggtagaaaggagaggttggatgatagaatggggaagggattcctccttgtgttcacagaagtgaatcaatgggagacacaaggttaccacttaatattcctgctctcctaggcatgggtcaggtacatcttcagccatgggtaagtttgttcaacaaatgagtgatctttgggaggctgaggcgggcggatcacgaggtcaggagattgagaccatcctggctaacacgatgaaaccccgtctctactaaaaatacaaaaattagccgggtgtggtggcgggcgcctgtagtcccagctactcgggaggctggggtaggagaatgtcgtgaacctgggaggcagagcttgctgtaagcagagatcgtgccactgcactccagcctgggcgacagagcgagactgcatcccaaaaaaaaaaccaaaaaaacgaaaacaaaaacaaaaccaaatgagtgatgcattgacctttcgtaattcttggatgcaaaagtagaactcaagctacttaataacaatcatggtggcatgggcaccagcaagtcagggtggacaacagccatagttctggagcatggtcctcaagactaccttttgtatgcagagtattaacactttaactcttagatccttggaacataaggaagagaggctggaacaaaaaggggttggcatttggaggtggagaggtagtgtaaggcacaactgtttatcaactggtatctaagtatttcaggccagacacgtggctcacacctctaatcccagcactttgggaggctgagccaggaggattgcttgagtctaggagttcaagaccggtctgggcaacatggtgaaaccctgtctctacaaaaaatacaaaaattagccaggtgtggtggggcacgcctatggtcccagctactggggaggctgagatgggaggatccacctgagcccttgggggtcgaggctgtagcaagtcatgattgcaccactgcactccagctgggtgataaagtgagaccttgtctaaaaaaaaaaaaa

SEQ ID NO: 241289 - DNA, 2223 bp, Homo sapiens
atctctttgcattattacagttgttgttatttttagttctatttatatgaaaaatgtactttttagcccacaaaaatagcatagcagcagcttatcaaaatgtcccagacaagtttacttcaacaaattagtaacaccttcatgcttcctgtggtggaagaaatgcagagtccacttcctcccagtgaacatctgagccagatttctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggcggggaacttacaaggattagatgaggggatatgtgtaaaggcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctgtgtcaaatatcaacattttaccaggtttctctgttgttgccaaacctgtcatttttatttggtgtggcttcttgggaaacttccatggcccatttgatgggaatcaaacagagtgaaaacaaggacagatgcagcagaggtggcatcaggaacaaatgggtcataagaacttaccttggcagcagccccagaatggtcaggaggaaaggcactttaaggtatcagaaggtagaaaggagaggttggatgatagaatggggaagggattcctccttgtgttcacagaagtgaatcaatgggagacacaaggttaccacttaatattcctgctctcctaggcatgggtcaggtacatcttcagccatgggtaagtttgttcaacaaatgagtgatctttgggaggctgaggcgggcggatcacgaggtcaggagattgagaccatcctggctaacacgatgaaaccccgtctctactaaaaatacaaaaattagccgggtgtggtggcgggcgcctgtagtcccagctactcgggaggctggggtaggagaatgtcgtgaacctgggaggcagagcttgctgtaagcagagatcgtgccactgcactccagcctgggcgacagagcgagactgcatcccaaaaaaaaaaccaaaaaaacgaaaacaaaaacaaaaccaaatgagtgatgcattgacctttcgtaattcttggatgcaaaagtagaactcaagctacttaataacaatcatggtggcatgggcaccagcaagtatgcagagtattaacactttaactcttagatccttggaacataaggaagagaggctggaacaaaaaggggttggcatttggaggtggagaggtagtgtaaggcacaactgtttatcaactggtatctaagtatttcaggccagacacgtggctcacacctctaatcccagcactttgggaggctgagccaggaggattgcttgagtctaggagttcaagaccggtctgggcaacatggtgaaaccctgtctctacaaaaaatacaaaaattagccaggtgtggtggggcacgcctatggtcccagctactggggaggctgagatgggaggatccacctgagcccttgggggtcgaggctgtagcaagtcatgattgcaccactgcactccagctgggtgataaagtgagaccttgtctaaaaaaaaaaaaa

SEQ ID NO: 241290 - DNA, 621 bp, Homo sapiens
gccattctcctgtctcagcctcctgagtagctgggactacaggtgcccgccaccacgcctggctaatttttttttttttaagtagagatggggtttcactgtgttagccaggatggtctcgatctcctgacctcgtgatccacccacctcggcttcccaaagtcctgggattacaggcgtgagcccagttttcattttttaatcagacccgttattattccaaatggtgacagggtatcactcccttaaagttctttgcttgttcaacctgggtctcacctggagcaagcccttctggaaggcagggactgccacctcgttcacgttcatgcctcgtgtttttcatatactaagcctctttatcaggcgagaacacaaaacaaacgaggtggaggatgctcttccccacctgtgctgagtcttacttagaacacattatttcagaaaatcaagattttaggcacggtgcttgagtctttagatttttaggcactgtttcttaacagttgggattttcacattcctaagtctcaccagtgtgacttaattatgccccacatcaccaaaggattagtggttactggaactgctatgaccatgacacgattcgtgcgcgtaccc

SEQ ID NO: 241291 - DNA, 694 bp, Homo sapiens
gccattctcctgtctcagcctcctgagtagctgggactacaggtgcccgccaccacgcctggctaatttttttttttttaagtagagatggggtttcactgtgttagccaggatggtctcgatctcctgacctcgtgatccacccacctcggcttcccaaagtcctgggattacaggcgtgagcccagttttcattttttaatcagacccgttattattccaaatggtgacagggtatcactcccttaaagttctttgcttgttcaacctgggtctcacctggagcaagcccttctggaaggcagggactgccacctcgttcacgttcatgcctcgtgtttttcatatactaagcctctttatcaggcgagaacacaaaacaaacgaggtggaggatgctcttccccacctgtgctgagtcttacttagaacacattatttcagaaaatcaagattttaggcacggtgcttgagtctttagatttttaggcactgtttcttaacagttgggattttcacattcctaagtctcaccagtgtgacttaattatgccccacatcaccaaaggaaagtggaaaattggctcatcaccagctgttcccaccttgcttctaagcaactgtggacctgcctgccggtcatatcagcccgactaagaagagaaaggaatggatcttttcttctgtccctctt

SEQ ID NO: 241292 - DNA, 448 bp, Homo sapiens
gatgtgcaatattctcttgagctctttgagctctctgtttccacatttcacctcttctgccctgggtcttgctctgtcacgcagggtgaaatgcagtggaaccatcatgactcactacagcttcagcctcccagactcaagtgatcctcccacctcagcttgttgagtagatgggactacagatgcacatcaccatgcccagctaactttttattttttgcagaagcaggatctcaccatattttccaggctggtatctaacttctgggctcaagtgatctacctaacttggcctcccaaagtgctggattataggcatgaaccaccatgacctgatgaaagaaatttttttaaaccaaactgttttacccaaaattttaatccagagctttcattagatgacatatcagagaaaataaagttgagccatataaacatgtcaaaaata

SEQ ID NO: 241293 - DNA, 405 bp, Homo sapiens
ggcaaacctggaccactggtcaggctagaagacagtatttaaagagaaggcatacaggccaagtatggaaactggagaatatttatgcttaagggaataaagacagggacgaacttgctaaagagagtgcagtcagaaaggtagacgtgaccaatgcatgctgggctcttgctgtgaatttggggctgggaattcaggtggaaggcattgaaaggagaagtctccatcagagagggctgtgaggaaagtagaaccatcagataaaacctggatttccattagggccaggcagagaaaggaactttgtggaaagatggaagacaggacaactggaagataccaatagttatacccacaagaaggcctgagactggagaggagctgggctgagtggggaggagattg

SEQ ID NO: 241294 - DNA, 408 bp, Homo sapiens
gtaagatgatctacattgttgctgtatccaggcctttactgttgtaagaaatgttggagtgttagttgagggaaaaagtatgtattggtaaatataaactctactcatactaatgagagtttttgatatggtctactttatgatggcttcaagaaaaggatgtaatctagcatataacccattatttttaagagccctgggtaaattttagcctttgtcatatataaacttgtttatatattagtgtatgtaacttcggaggtactaattctaacatagaattctagtattttagagtgtacaatttctcccttagatactttatataaacagtttttcaaaatcctaatttttaatccatctatgctgcaacaataaaaaaactttgtaaatattattggtatatgc

SEQ ID NO: 241295 - DNA, 1895 bp, Homo sapiens
  misc_feature (1246)..(1246): n is a, c, g, or t
  misc_feature (1255)..(1255): n is a, c, g, or t
  misc_feature (1291)..(1291): n is a, c, g, or t
  misc_feature (1304)..(1304): n is a, c, g, or t
  misc_feature (1695)..(1695): n is a, c, g, or t
cataaatcataaaattgtaggactagaaagacacttggaaatcatcctgtccagtctgccatgaaaatatgcattccttgggaggtgctttctctcacagcacattcattgtgcagatgtgtggtccaaggtcacagaactggtagcagatctgggatcagaacccagcactccagctcttacccagcatccactcagcagcccacactgagctgatatggcaaagaatgaatgggttactgtctccaggctatgccagggactgcaacaggtgctgtaattacttgtctttagagtaataagcctctgtaataagtatgtaatgtggaagctttattcagcccatcaaccctcaataaccattgttgcctagctgtactctcccaggcccggcccctgctgcattgcccatcacttgggatcttaagtaacagcacttcttgtagaagaacaaggccctgccagatgtgactagatcacaagaattagcattgaacactggttaaaaataaaagtagttttttcatgacattcctatctgccgtgtgtgtatgtgcatgggtgtgtttgaaatgtgatgaacaacagcaatgatgttatatagatattcatatgacaaatgtgtgctggacatctactaacagaaaggccttgtgctaggaattttgttccaaaaacaaggaagcataaatgctgtaagcatggtgtgaacacaatggtctgaggctgccagggagagagcacaatgggttttcaaaggggataagaagggggcagaagaggaatcaaataaggcttcaaggaagtgatgacacttgagtgattttaaattcccagacacctgagaatttgtaaaatcagaaatggagagaatattccaagtagaaaagatagcttgaacccagaagatgttaaggttgactttcagcaaagcttgaaaaatagcatataataactgttcttatatatataatgtagaagaagcacaaaagagagaagacgactagttttaggaaactgctgatataaggattatatcattccaggtcaatctcgtatgttgaacacagagggaaaaattctaaataagagcaaacgaatccagcaggatattaaaataactacattgtcactaatgagccttacctaaggaatgcaaggatagtatgaagttttagaatctatcagtataggtctggcacagtggcccatgcctgtaatctcagcactttgggaagccaagacnggtggatcncttgagcccaggagttcgagaccagcctggggaatntggtgaaaccccntctctacaaaaaatacaaaaattagccagtctcacaatgtggtctcaaaataaataagtaaaaatgtaaaaataaatctatcaatataattcatttattataggaaaaataatatcattagttcagtaggtacagaatcaatcattagtaagctcccacacttatttataatttaaaaaataaaaccaaacacctcttatcaaactagaaatgggaaaaaaaattgctgctggaacctaaaagcaaacgtcatattaagagtgaaataggcaagtctttccagtaaagttcaaaagaggtaagaatgcctgctatcacatctattatccaacattatatttcaatttttttgttaatataatacaagtaaaagaaatagataggcataagnatcaaaaaggcaaacaacaattttagtattttcaaaagttatgagtctatgtaaaaaaaaaagagaacatatatattttcagaactaaaaaaagcactcaaaaagtccaatgacttttagttctaaaaattttaaacacaaaatttacattttaaatacaaaacccacattttaaaaaaatttgtaagtttctataggcc

SEQ ID NO: 241296 - DNA, 769 bp, Homo sapiens
gtgattatcctcactttgtgactgaggcatttttcagacaatgccatagagggagggggagcccaagcagaggacagagtttttgctgatttgaaaagaaagagatcagaattcaaggaggctaaagtagctgaaatttgtggctgataaagaggaagctactaaaaaaaaaaaataaaggctacagaaatttatgtagatttggctgaatagtaaactctgcatgcacaggatgagaccccacacagtttggcaaagaagatctagtgaggaaaaaaacaattactgggaaactataagccaaagaatttccagggcttaataaggctggatgaagttccacccacccaaaatggagaaaattcattgaacacctgggacattcaataaagactccagaaagattacaccttggtggtagggctaaaatagacctgctctattaaatattttatttttttatttattttattttaagaatcaggccgggcatggtggctcacgcctgcaatttcagcactttgggaggctgaggtgggcagatcacctgaagtcaggagttcaagaccagcctggccaacatggtgaaaccccatctctactaaaaatacaaaaattagccaggccgtggtagcatgtgtctgtaatctcagctacttggaaggctgaggcagaagaattgctcaaacccaggatgcggaggttgcagtgagccgagatcatgccactgcactccagcctgggcgacagagcgagactccgtctcaaa

SEQ ID NO: 241297 - DNA, 525 bp, Homo sapiens
cgggagagggaagtcagtggtaccagaaggtagatgggctcccttgcaggctccttgttctcctgccatcaccagtagaaccttctggctgacagaccagggacaagtagactgggttcaaagtgacagacctttcactttcaacagctttggctcagcagacatgtacacatacaaagtagagcctacaaggtcaggggcattctgcccccgccacaggactaaagactgccctgcgggaagatggcaggagcagtttctgacctcagttgagtatctgtggccatgagcagaaaaggcaggggtctgcctcctgaccaagcacatcttgaacatcacctgagagcttgaacatcactaaggacctagacactcacttgtctttcaacttgagcccatcactcaccatgtgagttctgttgagggtgggtagaaagcaaataggttcaggttatcccaccagactaactcggtgaatgaaaggatcatgccttcttcacattttaattaaatggatcaagcaca

SEQ ID NO: 241298 - DNA, 394 bp, Homo sapiens
gctatatcaaaactgagttgccataaaatttggggggacgtgttgtcaccaagatggagctgtcgtgatgacaggaaattagaaggtagagctggaaagaaacaccttccagtggagacttgtgaagaatgggaatccccctgagccatcgtcggtgaaatctcaaaggcaccttttgcagagtgccagccatatgcccggcacctcaacccatcattttactttgtctgcacactacccaatggggcagagtaactgcacccattttacaggcaaggaagtggaggctccgagcagtgagcaacttgcccgaggtctcacagccagaaagtggtggagccgggctggactctacgttttgcttgatgttgtcataaacaatcaagaggagaaa

SEQ ID NO: 241299 - DNA, 211 bp, Homo sapiens
acatgcagtttctaatgaattttctttcagtttcctgaatgtgccgacctatttcccacttcagagcctttgcactgctgttccctttgcctggaatgctcttacccctagtcctttcctggcctatattgtatatgcttggtttataaacttaaaaattactttctttggagaacttacacacctccctatctaatgtaaaataggttat

SEQ ID NO: 241300 - DNA, 333 bp, Homo sapiens
aagaagaaggagaatgatcagtaatgcaaacagagaaaagagcaagtgaggagcaaattttggccatgtcttctgccctgtgcacagatgttctatcaccagagagcagaaacctggtcatggggcaggatgtcccattaagggaatgagctcatggggcggccacatcagcctcctcttgctaagagtgcctgctccctgagacgctcctgatggtaatttggcttccacgaagacttgtctgcaaatagagaataagctgtgcagcggagcaaattatctactctgctttgagttcttattgtaaagtaataaattggtattttggttttt

SEQ ID NO: 241301 - DNA, 472 bp, Homo sapiens
tagtttcagctcatggggctttagaaacagggcagattttgttttgagttggagagttgtagccaaatattagaggaaatcaagagaattcaagatctagttcaattgtcttaagttctgggacctgctaggaagtgacaatttttattcattcattgtatgtctaggatcttttgaagccaggaatttgacttttagtcaaagctttggtcatataaacagtatttccaattgtatcctgcttataaggcagatttttactgagcttatataaataaaaataagaatactcataaataatttgtgaattttgaaggaatcaggtagggataaaaagaaaatgtctctacttttgttcataaaagtatgctttaaaaacttgtctgtttttaatgagccctttgacctattatgctattttctggatgggggtataaagcacagtcgtgtcatattaaagcttacttcaaac

SEQ ID NO: 241302 - DNA, 415 bp, Homo sapiens
agtagtgggtttctgttctattggatgactttgagatttgtctttgtttccttttggaattgttcaaatgtttcttttaatgggtggttgaatgaacttcagcattcaaatttatgaatgacagtagtcacacatagtgctgtttatatagtttaggagtaagagtcttgttttttattcagattgggaaatccattccattttgtgaattgggacatagttacagcagtggaataagtattcatttagaaatgtgaatgagcagtaaaactgatgacataaagaaattaaaagatatttaattcttgccttatactcagtctattcggtaaaattttttttaaaaaatgtgcatacctggatttccttggcttctttgagaatgtaagacaaattaaatctgaataaatcattc

SEQ ID NO: 241303 - DNA, 548 bp, Homo sapiens
agggcaggatgctcggtgaggggtggtggagccgtagagcaaacatccttcgagagccaaatgtgcgtgacctttgacctttccccttcaggagtgtacagtgagggaatactcgggtaagcacagaaacacctgcaaaaacaactcacacattcgccagcagggagtcggtcaaaccaaccaggcccaggctgtggaatgttaggcggcggttaaaagtcacgagatacgcaccttcagatgggaaagatggacaccacctgtctcagcgggagaaagacagctgcagaagcttcacacaatttagcccgattcccacgaataaacagaagaaagggcagacaagtttgtaccgacggaggaaggcactgggaccccgcttcagtcgggcacgagtttcccccagagaggggaggaggcaggcagaggacttcactttctatgtaatctttgcctacagagtttgacgttttgtaactgtcctgtataatttgtcatctgaaagcctgaaaaaaatagccaattaaaaagctgccattggtgatgag

SEQ ID NO: 241304 - DNA, 361 bp, Homo sapiens
ttctgggtttaaaagaagctttggggtttgaatctgtagccccaccaaagaaataagaaattgtctttatataaaagatatgtgtatatcattgcagtttaatggtgctttagtacaatgctgtgatttttggccaaactagatgccagatacacagctgcatttaatgtaaatgtaaatcttacataaaattttagtattttatataaaacctagccggccgtggtggcgggcacctatagtcccagctgctcaggaggctgaggcaggagaatcgcttgaacctgggaggcagaggttgcagtgagccaagatcatgccattgcactccagcctgggtgacagagcaagactctatctc

SEQ ID NO: 241305 - DNA, 189 bp, Homo sapiens
tgtaccactttttctttatccattcatctgggttttttgtttgcttgtttgttttaaacttttaagttcaggggtacatgtgcagatttgttacataggtaaacttgtgtcatggggatttgttgtgcagattatttcatcacccaggtattaagcctagtacccattagttatttttcctgatcctct

SEQ ID NO: 241306 - DNA, 497 bp, Homo sapiens
tcttctagaccagatgttcctggctagcagcactgccacctctccctccaggcaccagcagacccttactgcaaagaagactcttgagctgctgctgctgtgttgggtgaggggaaacatgctatgtctctggctggaactcagtttcctacagcacagtacacttatgggcaggtctagcatctgtaccacacttttgaaatggaactccagccggacgcagtggctcatgtctgtaatcccaacactctgggaggccgaggtgggaggatcacctgatgtcaggagttcaagaccagcctggtcaacatggcgaaaccctgtctctactaaaaatacaaaaattagctgggcgtggtgatgggcgcctgtagtcccagctacttggaatgccaagacacgagaatcgcttgaactcagaggcagagtttgcagtgagctgagattgcgccactgcactccagcctgagcgacaaaagggaaactccgtctccaaa

SEQ ID NO: 241307 - DNA, 421 bp, Homo sapiens
tcttgttaaaatgccagttcttattcaatagctctagaatggggcctgagattctgcatttctaacagtctccaagatagtgctcatgctcgtggtccaaggatcacactttgcatactaatgatttgaagcattattttcttaacaagcaagggtgcatgtattacagaataaaatgcaaagtgtgaatttttttagtaaaacactaactaccccgtaaatatcacatgtctagtaaaccatttcaacttacactcttacctcccttaggttttttagaggaatggaataaaaagtagccagacatggtggctacttgggaggctaaggtgggaggatcccttgagcccaggagttgcacaggctgcagtaagctatgatcgctccatttgtactccagcctgtgcaagaccctgtctct

SEQ ID NO: 241308 - DNA, 174 bp, Homo sapiens
tcagccctatccctctctaacttcttggaggagagtaaagctgcagattgtgttaataaccgatcctgactacatgatgacacctccataaaatcctctaaatgatgggattcagagtgcttccatgtttgtgaatgcattcatgtgctgggagagtggtgtatcctaactcca

SEQ ID NO: 241309 - DNA, 488 bp, Homo sapiens
accatgttttgtgtgggcaagccgagttcgggaccctcggggccctggcgtagcacctagagcccgctgggtcaggcgccgccctctcacctgcgcgtctccgccggaggaaaggcggttaatttatttttgaaataacaaaacctaaccggcgggaacgtttttcttgctctgacatttattataataatcctaacactgccgtccgctgtgggctccagcccaggctccacagccgtgggcagcttggagccccagggcttttagatcggccagaggactgacactctggaactggaagaaaaccgcgcaaggccgatggcgtttggattttatcctgacgcaaatcagagccctgagagaattttaagcagggcagggtcagtacccatttgcttttagggttcttcagtggatggtggcagagacagggtatttgccttgtggaggtaggatggacttggtgacttagagtggagaataagaat

SEQ ID NO: 241310 - DNA, 498 bp, Homo sapiens
gctggggatgtgatagcttgcaaaacaactcgaattattcagtgtatcataaaaaatgaattctcaggacaggtagaaacttggtttactcattatttctaacaagtaccaaaaccccctgattcatgtgtgttttcttttcctggcataccaagagttaattggcacatgacattcttctattgcatgaagctgttccaaaacgtccaacctgacaaaatatattatgattgacaacctctggcctagtgagatcgctttgagtcagagatgtgttcctcataatttgtggaatgattatctaggtttctgctggtgtcttgaataattggtgttatggtaactgtatttataatgtagtttattttttgtggccaagagcttacatgataattacttcttcataacaaataccatatttgaaaataatatgcaatacagatttaatttcttctaggacattgagttatgtttcagatttctttccaaaaagatcac

SEQ ID NO: 241311 - DNA, 352 bp, Homo sapiens
tgggattataggtgtgagccaccacactggcccgttaatgacctttaaaaggacatatacttcagggaaaggaaaataatcccagaaaaaaatctaagagataaaatgcagtgctaagcaagtaaattggtaaccataagagtaaatctgaatgaacatttcctgtatgagatatttaattagtatagtttaaaaagccaggacaggccgggatcagtggctgacgcctgtaatcccaaagttatgagattacaggcataagccaacgtgcccagccgcatttcatctttgtttttttttgtttttttgagacagactccagcctgcgcaacatgagcgagactccatctca

SEQ ID NO: 241312 - DNA, 436 bp, Homo sapiens
tgggattataggtgtgagccaccacactggcccgttaatgacctttaaaaggacatatacttcagggaaaggaaaataatcccagaaaaaaatctaagagataaaatgcagtgctaagcaagtaaattggtaaccataagagtaaatctgaatgaacatttcctgtatgagatatttaattagtatagtttaaaaagccaggacaggccgggatcagtggctgacgcctgtaatcccaacactctgggaggctgaggcgggcggatcacctaaggtcaggagtttgagaccagcctggccaacatggcgaaacactgtctttactaaaagtacaaaaattagccgggcctggtggtgggcacctgtaatcccagctacttgggaggccgaggcaggagaatcacttgaacctgggaggcagaggttgcagtgagcc

SEQ ID NO: 241313 - DNA, 327 bp, Homo sapiens
agcccgggggaacagtcagcgggctctgcgtcccgggagctggggacacgcctgcaagggctttccgcctgcacacagtcatttggagaaaatcaagagagttttcaaccttggaaattgtgcaatgttccagccgacttaatgggcttgccttatgcggagaggcagtcctgcaggacagagctaatgtgtggtctcccaggaagctcatcagaacacctcttgtcccttttctttaaaagaaaaaaaatttaaaaagtttttgcttccatctcaatgtccattccattattttgtagctacaataaagaaacatgggcagcagtg

SEQ ID NO: 241314 - DNA, 353 bp, Homo sapiens
gtgtgcaccccggtcacaacagtgatgctcaagggctctccaaaggaggcaggcttgtgtggaccccagagggactcctgatcaggttagaaggacgtggaaagaatactacctgcaagccgacgagagaggcctggagcagatccttccttcacggcactcggaagatgccaagcctgccatcttgattttagacttccagcctccagaactgagagacaacacgttgtttctgttgtttgagccacacagttggtagaactgttaaagtagctccaggaaactaattcagtgactaatgttttcgaacagtctttgtgcattttaaataaacatatttaatatataaaaaa

SEQ ID NO: 241315 - DNA, 383 bp, Homo sapiens
gtcagctatttggtatgcctttatgaataataaaattatggctttcctcccttctaggccttattgtagccaagtggctttagtcattttcatgggacagattttccaatgtctttattattactctaccttcgccatctcatatttttaccactgggccctagatatatatatcatccattgttcagcatgctctacccagtggaataatcatatttagaatggtctataagatgatcattctccattgggtccaatttacaatctgtttctcccttttttctttcgtatgtttttctgctcattcaaattatgatcagaagctaaggcattttcatatccaaatgctctccccatcacttctaataccatcaccatatatt

SEQ ID NO: 241316 - DNA, 250 bp, Homo sapiens
gattccttctttcctagctgtgttctctaacgagaaaccacatgacttcctaagccactacacacactgtctctcaaatgttaccaaccgccctgcctctgcgtggttgatgatgaaagacctctcttctatcagcagttaagctcagaaagtcatggaattgtctgactgggataaaaaattaaaagcagctacaatgttattaccaagaaacacacttacagcaaagtgattaaagaaagggtagaag

SEQ ID NO: 241317 - DNA, 397 bp, Homo sapiens
ctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttt

SEQ ID NO: 241318 - DNA, 598 bp, Homo sapiens
aaggcaaagctcacgtggtggtaaagcacttgtacttcaggattgtgttgctagctgcctcgacacagccactgggaaagccagttcacccggggctcctgctggacctgggcacaggagttgctgcagctcctgccctggcaggtggaatgacatggccttgccaaagacagcggtgcctgtcattataggaggtaaggtgacaaggtggaagctggaactttgcggccatcactggagctgctttacctaggatcagggtagtgggtccccaggggcaggcagggtcaaatggatgtgctggctgggtataaattggatccaacatttttttccttttaaattactgaatgatttgtggggtgtactttgcccctgtaggaatattctattgccctgccacgtttatgtaatggtttcagtatccattgattattcttgcctgtaccatttattacagcaggagatgcaagatatgagggttagttatgttcgttaccactagggtgtcatcgtacgctttttcaggaacacaactaggatgctttatttacatatgtaatgaatatatatataataaaaatatatatataatgaa

SEQ ID NO: 241319 - DNA, 516 bp, Homo sapiens
aattgttctgtcttacatcatctgcaacttagacaattctgttggttttaaggtggaaacagctgccagtctatgtatccctgggattcctctaaccctgctaagcagggttactcatgaattactttacatctatcaatcatctgtcctacaaagaactgggcaaaccttcttggaaggccagaaggttttgcaaaagctttaggaaagggttatggctgaaggcagcctgatcctcttaccttgagttaatagtaaaaagcaaataacaagggaatgtagaggagtttatctaaatagcttgttttctcattgttgtcctaagactgacctttgatcattcgcatgcaggactgctctctctggggagggcgggagaaagggagcagaatctctgtaaaatgtgatgttcaataaccatttgtttttgaaaacatttttgaggttggtagcttagatctggcaatgttctcccatctaataaccatcagacaagaaataaacttgcttagaata

SEQ ID NO: 241320 - DNA, 375 bp, Homo sapiens
atgccctgaaaggaaggtacaaggtatattggaagagggcctgaatagacttgggggattggggaatgattcctgaaggaaatgatagccatatcaagttctgaagagtatgccagacagaaagaagtgaacagtaagtgtgatgtcctgtaggcaacagaaagaaattgagaatggttggatggcacagtcatggggtatcaaatggaagaggtagtaaatgaggttgaagagaaatgtggggaccaaatggtaaaggccctgagaagtcatacgaggagaattgcttgaacctggaaggcggaggttgcagtgagcagggattgcgccattgtaccccagcctgggcaccaagagtgaaactccaactcaaaa

SEQ ID NO: 241321 - DNA, 537 bp, Homo sapiens
attctatcttggttgatttaccctataacctggagcattttcgagaggcaacagaatggaattgtctcaaagtactgacttttcattattttccacgcagatccctgaggataacagaaggaaaggttttgtctgggggagggtaggcttctcccaaaaagagaattctggaagtcaacataattaaacaaagaggaaaatgtgccagacaggagtgggtgggggctgttttctctttgtggttggttgtggtgcgttcaagattcctcgcctaagatgaggttcctgagcttccagtaggcgactgactgcccaagagacccagggctccgcaaggagacggcgcaggtgtcggggctccccgcaggtgaggaggccgacgttccaggaggtccgcccgggcggtccctgagtcctgcctcgcggctgctcgctgggatccgagggcggaacgggacgcgcaggaacccggcccgacgggcgcggctcacacccgtgctcttcctgcgctctcggcctcactttgcggccagagcc

SEQ ID NO: 241322 - DNA, 826 bp, Homo sapiens
ccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaagactttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatgtgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttcccttta

SEQ ID NO: 241323 - DNA, 599 bp, Homo sapiens
gcaatgtcggagtgcttgttgaaattatttggaaaaggcctcccctggtggctttaaacacaggaaatggatgaatggatacccttctcaggcctccaggatattttgttactgtctaaggcctccttttaagttacaaacttatggagttttatgttttaagagtctttttaaccactatactttttatatgcacatagttaaaaacagtcaaatagtatagaagagtataaaatgcaaaaataaaagatgtcccccctccacctcattctagtcttactttccagaggtgaacactttagactatttgtttttagcccttctggtggtttctttcacaagtttatgaacaatatatgaattcatccatttattgattcatcaactgccgatagtgctattagattaatttttatattgttcgtaccagcaagatgttcttgttgggcctttggtaccaacaagctgataacagcaatttcttgatctccctgtgtctccatctacatatcataaaataaggatattggacttgttggtttccaaggccactttctaaaaagtgttaagagaccatttgaactaatttaagtgaagag

SEQ ID NO: 241324 - DNA, 425 bp, Homo sapiens
cttcattttttccctatcttctcttgacactcgtcgttgagccagctactgtttttctccaacctgctaggttttcaataaatttcctgttgtgcattgggatagcagtgttcctggaaaattgcttttcgtaggtgagctgcaccagtatctcccatatacactttttaaaataatttagagacaagtaacaaagtgcttacagtgcaaaaatttactccagaagactccaaaccattcactgacattttacagtttaatcccagcttcaatttcataactggtgctcaaaacagaagaggcgcactgaggtgtacacttgaaaagacatttaaagcctttcatttggagatttcaaaaacattaaccaacatactcaaatgcccttaaaattcatatggagaactaatacactatgttcttta

SEQ ID NO: 241325 - DNA, 457 bp, Homo sapiens
attatacccacagatcccaaagttcattactgagcatatacagaaccctcaagttagaagtataaaaattatactaggggcagggaggagagaatttacctcataaatatgtagtatcctctttcaaatacattgtacaaaactactaaatttttctaacattacgaatatcttggctgggcgcggtggctcacacctgtaatcccagcacttagggaggttgaggcaggtggatcacgaggtcaggagttcgagaccagcctgaccaacatagtgaaaccccgtctctactaaaaaatacaaaaattagatgggtgtggtggtgcgcgcctgtaatcccagctactcaggaggctgtggcaggagaatcgcttgaacccgggaggcagaggttgcagtgagccgagatcacgccactgcactccagcttgggtgacagagcgagactctgtctcca

SEQ ID NO: 241326 - DNA, 312 bp, Homo sapiens
gaaggaatattcctgctttttcttgagaagggacgaagattttcttggaatcaaggagcctcctcttttttgtcctttttcagtctcttccagtcattatcatggtgattgtcaactgtcatggtgcaagtgcgaatgtcatttagcatggaaactggattagaatgaagctagaggtttttcaggggatgaataagctgcctaagaagaaatctatgatcacagacatcctgtttcccaaaattaagcagagttaagctgagtaggaatttacttcgtatatcacatatgccttgcattgggcaacaaaag

SEQ ID NO: 241327 - DNA, 252 bp, Homo sapiens
gcgcatgagatttttttagtggtcgtaggtgacttcaatactgggcagaacgtaatgctgtaacagtggccaaccttcaagctagaccactagttctcaaccaggactgatagcccttccctcccctccccacaggggacatttggcaatgtcttcagacgttttggctcaccataaattgggggagggggaatggggtttaactggcatctcatagatagtggtcagggatgcttctgaacatcctccgtg

SEQ ID NO: 241328 - DNA, 400 bp, Homo sapiens
taatgttcgtttgattgattgtgattctaatacatatataagtttgcttctttattattcatttttatatcacaaactcttttcattattataaattttatggtaataatatgttagataatttccaacctatggtaggaatgtccctagtttatttgacctttatgtggtaaacattcattgtcttttaaagtcttgtgtattacaatgatacgttatttctaatttttatctcccctccatttgtattaatttagcagaaaataaacttccagaaataaaatcaatttgtcaaattttaggaatatttataggctgaaatgtagagcatattgggatgcatatattggttggaatttagagagaagtaaaaataaaataaaaatgattctgattctgt

SEQ ID NO: 241329 - DNA, 344 bp, Homo sapiens
gaaaagaggaagagtgcctgcccaggagaatggcactttagcacttgagagtcacatttaaggacagcaaagccgttcatggtggctcacgcctgtaatcccagcactttgggaggccgaggcaggcggattgcctgaggtcaggagttggagaccaccctgactaacatggtgaaaccctgtctctacaaaaattagccaggcatggtggcacatgcctataatcccagctacttgggaggctgaggcaggagaattgcttgaacccgggaggcggaggttgcagtgagccgaggtcgtgccactacactccagcctgggtgacagagcaagactccatctca

SEQ ID NO: 241330 - DNA, 337 bp, Homo sapiens
taagtatttttctaacataggtcacaaatgaagattctgaaagagaagacagaatcactgagagaaactgggaagaggtaaatagtgttacagaggatactttactagaaaatggataaagaaaagaaataacatggtccttgagaagttgtaaacataaagaaccacatcctttggatataattgcctcaacatgaagatgatgaaaatggagaccttcatcgtgatccacttctaattaatgaataggaggcttgggccgaactgggtgatcagacatcatacacagagaaggagcaagagagagattacacagaggaggaacaaggtgtgcagc

SEQ ID NO: 241331 - DNA, 1629 bp, Homo sapiens
ctcctagtagttttgttaagtcttaccctgtaatttttgcttttaattttgatacctctttatgacttaacaataaaaaggatgtatggtttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagggggcgggcgcgcgcgcgcgttctctctctcctccggggggcgcgcctccaccggaccccgcagatatagaaaagaggccgcccccatgggagtggcgcgctcatttataataaagagaaaggacgggacgcgccgcactatcaaaacacacaccccgtgcgagggagagaacacagcgcgcgaaatcaggcgatccactacagagacagacgccacacccaccacctctggcgcggggagaccaaaacagatgcacccaccactaacacacaacaatgaatatttaagacatccgatgcgagaatcataaaccaaccgcgagcagcgatgaacggtgaggataaaaaaacgtgattcaatatgtcgccttctgagagacaaaaactatcacgccccgagtggattataatttagtacaaaatttatatcaacggagaggaagatgataaaaacaaggaccgataccagccaacgagagaagcaacaacgaagcgaagaagagagacaagaaaagcagggcagaggaaccagacacaggcaagagaaggaaaggagagaggacagggaccgagaaagcgaggcggcacggcagcaaaggaggagacggagaaggggcgaacgaaggcgcgggaggcgagagcgcaacgaaaaaaagaaaagcacgggcacaaaggacaggaaacacgaacacacaagaacagcggaaggcggaggtacggcaagcacagagagaacaacaggcgaaagagcggacaagaagaaggggaaaagacggcgaaaacgaggcgaggcaggcgtagtcgggcaaagcgaggaacccagacgacaagggcaacagaaggcgggaaacagcagggggaaggagagaaaagggagaaacagaagaagagggaagagaagagaagatgaaaggagcagaggaggaggaagcgaaggcggggacagagaagaggaagagtaggagagaggacaggagaagcggggaaggggagaggcagacggcggcagagcggagaggaggagagagggagcgaggggaggagggcaagcagggaacgcgggcgagggggaaggagggagagacagcaagagtggaacgagggacaggagaaggggatgaaccagggaacggggcgagggcagggaggagcaggagaggggagaggagacgagagatgcggaggaagaagcgggcgaggctccacggaaggcaggaagaggagagaaaaggaacaggggcgaaggcagagggagagaggagaagagggagaagagcaggacgggagcgggagagagagggaaagacagggaggagagcgacggagcgggtggcaaagtcactacacaaggaagagaagagaacgcgccagaggaacaaggaaagcaagggacacacgggagagaaggcaagaa

SEQ ID NO: 241332 - DNA, 396 bp, Homo sapiens
ttctttatccaatccaccatatatgggcacctaggttgattccatgtctttgctattgtgaatagcactgtgatgaacatagaagtggattaaatttctttttcttgacagtctcctaatttatgcttgtacatatatttttctctcatgccttgaggtttttaaaagtcctctcctctttctcatggcaatacttttactaaagtacatttcctgggaatccttagggttccccttattttgaataggctgaatattttcatatgtttggtgatttttatcttttaatcctttaataggtttgaaagtctctcttgatatgggtagctcagataggctccatcatagagtctagaaatcatcctatgatttttttttgcccattcctaggttaaa

SEQ ID NO: 241333 - DNA, 401 bp, Homo sapiens
tactccccacccaggcccgctctccccaaatctgtcaggaaaccctcctcatcccacagcactgtgtgacttcctggggagaaaggggacctgtgtgatggtggggggcccaccgggtctgttggggatgaggctctgggatttctggaacagggttgttctggacagagctgcctctccacccaaccacctgctgccctaatcctccctcagaaccttgaccccaggaggccaaaaggatggatgccattgccccaggggccccaagacctgaggagcagcccctgagcaggcctgcagtgaagggcccggaaggcacttcctaaggtccagcctctggcatgtcaggatgctgtggggtagacacgccctgggtcaatccagcccagaagccgggggag

SEQ ID NO: 241334 - DNA, 627 bp, Homo sapiens
gagaggggagagagaagagaacaaagaacccatacctgcattgaaacccaagtctgcaataaaaatgggtacagataaaatgttaatagtttaaaaaaatacctatcttgggtatgatgatagcccttactctacactatgatcaaagaacaacaactctgtgaacaaagaattattacaaggctgtaagccatgtgatggcaaggcccatcagtggaccccaatatttagaactgcaactagcccacctgacacacccaatctctcatccgtgctttatttttgtatttataaccatctactataggcatttttttctctcctctacctgaatccaaaaggacttttgtgattttgttcactgctatattccaactgccttaagacagggtctaccacttggcaagcacataaaaatatttgattaaaaatgcctcgcacagtacatggcaaacagatgctctcaaattctggttaaatacatttatttaacctatagaaatgtaaattagcaataaaaagcctgaaatgataactacttcaaatatgtccaatttcaactcaaattgtattgatactcataattatacttcttactaacctgttatctttaaattgcaataaaat

SEQ ID NO: 241335 - DNA, 330 bp, Homo sapiens
aggccccagcaggagttaaattattttattttcaccatattcactttgacagtatcctctttgtgactggttttccttttataggagtaataagacatggctttttaaaataaatataggtaaggttttaaaaagtgaattgattgcaagagaaatattaaggaaattatggccaggaacagtccgtggctcatgcctgaggtcccagctactccagagctgaggcgggaggatggcttgagcccacgtgttggaggctgcagtgagctatgattgcgccactgcactccagcttgggtgacagaataagaccctgtctctaaaaacata

SEQ ID NO: 241336 - DNA, 622 bp, Homo sapiens
tgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgct

SEQ ID NO: 241337 - DNA, 438 bp, Homo sapiens
atcaaactaattctactcttaaataactcagattaaaaagagaattagaagcaaattataaactatttataagtgagtaattattacactacatatgaaagtttgtggaatattgccaaagcaaaactcaaaagaaaaattagggcgggcgtggtggcttatatctgtaatcccagcactttgggaggtcaaggcgggcagatcacgaggtcaggaattagagaccagtcagtttgagaccagcctggccaacatggtgaaatcccatctctactaaaaatacaaaaattagccaggcgtggtggcacatacctgtaatcccagctacttgggaggctgaggcaggagaattgcttgaacctaggaggtggaggttgcagtgcgccgagattgtgccactgcactccagcccgggtgacagagcaatacttcatctca

SEQ ID NO: 241338 - DNA, 427 bp, Homo sapiens
attgtgttgttcatcagaaaggctgtagtaatttatactcatattggcagaactccggaactccagaacagccttttaccaactcaaagtgagacttgtagagataagtacaatacaggttgaggactttgtctctggggtcttgcacctgattcccttaaaggaaaactgaatgggccaggataacccttgtcttgatgagcgaaaccaattaaggggcacaccaagggataatagagagattaaacttctcctttcaccattttaacacgaacctagtggctttcagacaatatgtttatgtgtcattttgagaatatccggttccaccatttagagaagaaagtctgttcccagaatgaacttatttctaggaagtacagttgttacattaaaaaaaaaatagtcctcccattttgttaaaagc

SEQ ID NO: 241339 - DNA, 475 bp, Homo sapiens
atatatcccagcctcccttgcaattagggaaatgtaaggggaagtttgggggagagacaaatggcgcttcctccagttttctgctgcggatgcagacgcaatggctggagcaccagcagtgttcttgcatcttgaggtgactgtgagggtggaaaccccacttggaggatggcagatcagaaagaaagaaggagccacagtcactgatgatacttgggggcccaggactgctgcttgggtttcttttacatgagacagaaagaaatttgtgtcttgtgttaaatgactgttatttcagttctctgttacttgcagccaagagcaattcctaacaaatacaggagaaaactttattctttatagtttcaaataccatgggcatgggttaatcctctgctgggtttttaccgcttagacaaggtatgaattattaataaaagcactctattaataaagatctcttccaaaaaaagaa

SEQ ID NO: 241340 - DNA, 504 bp, Homo sapiens
ctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaat

SEQ ID NO: 241341 - DNA, 451 bp, Homo sapiens
ctgagagggagtctacctctgtcacccaggctggagtgcagtggcgcgatcttggctcactgcaacctctgcctcccaagttcaagcaattctcctgtctcagtctcccgaagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaat

SEQ ID NO: 241342 - DNA, 434 bp, Homo sapiens
tgatctgcctgccttggcctcctgaagtgctgggattataggtatgagctacctgcctggccttattttctaatattgaaccaccagtcttgtattctcagaataaccactacttggtcatgatatattatccttttatataatgctggacttaatctgcaatattttattgaagatttttgcatccctcttcataaaggatatttttctacagtcttctgtccttgtaatgtctttgatttttggtattaatgtaatgctggcttcatttaatgagttgctattaaataattataattcatattaaagtataatagtgtgatttttaaaagatcttatgttttcaaaataagtattaaaatacttatattattcttagattttcttatcaaatttacttttattaataaaagttatattacttatatatgtat

SEQ ID NO: 241343 - DNA, 492 bp, Homo sapiens
gttcgtggtctcgctgacttcaagaatgaagccgcggaccttcgtggtgagtgttacagctcttaaaggtggcacggacccaaagagtgagcagcagcaagatttattatgaagaccaaaagaacaaagcttccacagcgtggaaggggacccgagcgggttgctgctgctggctggggcggccagcttttattcccttatttgtccctgcccatgtcctgctgattggtccattttacagagtgctgattggtccattttacagagcactgattggtgcattttacaaacctcttgtaagacagaatcttatcaattctgccagctgctactgagcccttgcactgtgctagtttttcccaagcccacacacacactggggagccagacactgaggatacagcaagttcttgccccacaaagcccatgccctttagaggagacagatgccagcatcaacattaccaggtgttaagaaagtacctgggaata

SEQ ID NO: 241344 - DNA, 438 bp, Homo sapiens
ttgggatggctcacccctaaatccttcagcacacatctcacatactgagaaagacattcttctctccagcttcatcctcagtgttaccattactgtgtgttcagttccattgttcaatataaattccacactatgatttcccctgctatgctttatagccatgttttaggacccaggtaagtttctcgcattgcctttggctgttattcctcaaggccttccccagcctggaagagtggtctcacctccctctcaatgcaatgaccctgaatcctctgaggagtccaggcctgtttcctccaggtgcatcacatcaggggctacagtgtccaccctcccactactggtgatgaatagatatttttaaaaacctccctaggagattccaatgtgcagcccccctcttaatactcaccaataaattttacttcctgtcca

SEQ ID NO: 241345 - DNA, 429 bp, Homo sapiens
gaatagttctagaaagagcctagtgctgctaaggcaatagcaatggagtagaagagaacatggatttgagagatatttaggagataaaactgtcagaacttccaaatagatgatgtggaaattgagatggggggaaaatagagtctaggattattctcacatttctggcttaagattaacttatcatgggaaacacagaggcggagtgactattgatggaaaaaataactggttttgagttttatgtaaattaagtattatagatctagagctcaagaaaaagtctggatgagatacagaatgataatctttcatgagagtagtaaataagatcatcttgagagatcatgtagaataagggaagtggaccaagagcaaaactcccaggaaaataaacacttaaggaagaacagaagacaagaagccatt

SEQ ID NO: 241346 - DNA, 474 bp, Homo sapiens
actgctgctgcccaggagagtaggcgcatggattatgtgaattgtgatgattgtaaagtccacttgctgcttgtttcagaaagtcttcttgagatgtaattgccatacattgatctatacatatttaaaatgcgagagcagcaagggcattgacacacgaacacacaggtggaggctttgcctgctgggaaggggacgcatccctcaccctagagactgtctcgcgccctcatactcccatccctgccaactcccactcgctggagaccaccgctccactcgccgtcactgcagattcgtgcccaccttctggagcttcctatcagcagaatcacaaaaggcggctgttgtatccggcgtctttcactcccataactgctgagactcggccgtgtgggcccgttcatttctgtcgtgaggaacagcagcactcgttcagttgccgagcactagcggtactagttcagcggccgc

SEQ ID NO: 241347 - DNA, 475 bp, Homo sapiens
atcagaatctcagcaggctttttgtaaaattcgacaagctgattgtaaaatgtacatggaaaagcaaaagtagagaatagcaaaacaattttgaaacagaagaacaaagttggagaactcactgtctgattttagaacttactagaaagctactataatcaagacagtttgcctactagcagacagataggcaaataaataatggaacagaatagagtccagaaatagatgaataaatacatggtcaactgattttcaataaaggggtcaaggtaatgcaaaggagaaagaattctcaaccaatgatgctggaagagtcagacgttcatatgtaaaaaagcaaaccttgttcgggagctgtagctcacgcctgtaatcctagcactttgggaggccgaggcgtgtggatcacctgaggtcaagagttcgagactagactggccaaaatggtgaagacccttctctactaaaaata

SEQ ID NO: 241348 - DNA, 1836 bp, Homo sapiens
aaatgattcatcccttctgagctggctccttcatctataaagcagggctacttcccctcctgcggagaatggcgaggaggactaaaaagacgagtgaaagtgacaaggacagtgcttggtgtgtgggacgtggttcctctttctttccctttattgtaaaatgctcgttattggtgagctgagaggccctgccgacccaggtaaggggacgctggcacccagggcgtaagggagcgctggcacccagggtgtaaggggacgctggcaccagcagcaaggtcggcatcatacgggcttcttcctgggtcaccctgagcattgaggcctttttttcacttcccctgcctacgggttactgtcataggaagctacttggaaaacaggagtttttcgggatactgaggaatcagatttctatttggaagcatccttctcatcttcagggagggaccaagagttcagcacaccctgatgtgcacagcagccgcccgcagagcggggcggggaaggagaaggggttcactgtcctgtgaggagagactgaggcaccgccctgtgaaaggttagcccttccaccgagactcatcaccacacagagatgacaagaccccactcaagcagctgcagccaaagtcctgctgcaaacagccctcctcagatatggagcacatacagcaaagtgacaagagaccgcctcggctaacaggggcacccatgcagctcaggcaaaggaaaacaagcatcctctgggaagaaaaactatctgtgtgaaggttttgcgggggaaagaaaggatttactctcaaccaaatccatcagagaaccgcacgactcttgagagcgcagtgatgtcccagagaagagaattgggaagcacccaggacaatgcacatgccagtccagggacaccatcgaggacctgggcagcctgctttcagggggaccctcatggtgccccactgcggccactaggcagacatgtcaccttatttccaaacgttatctcgaatgaggggaacatagtcagcaatgaacatgagagcagcagcacctgcaagggaacgggagggctcctgcctccagcccagtgtcgtgggtaagaagcattacagaagagacttcctggacacagtagctgcctgtagaaagactcaccctttcagcagcttgtcctgtgatttgcagaagagatctaagtgtacccctagatttaggaatgctttccaaggggcaaggcagcctctggggtgcttgtgaggagagagaggtctcattctctgtggtacgtgcatctcacacaccatgcattaccaggattctgaaaaatctgcagtctatgcaaatgtgcttcaactagatgtatgtattttttaagaaagctcctaaacataggagggttcctgaagcgaacccagcatgacccttccctcttgttttgggtcagcttcgggtagaatatttttgttttttgtttgttttgttttgagatggagtctcgctctgtcacccaggcgactccctaaaatctgagccaccaagctcagccaggtagaatttcatttttggtttcatgttcactatttcctaagacaatttagtatagatgaatgtcaactgaaagaactccgcatgtagaatgctcaggacatactaataatgctttggaaaaggcaatggtcttgtctatacttgattaaatatctctttaaagaaaagcgcattacatgtcacacactaatcagggggtcacatctgggctcatatgacaagtgttatgtttaacaagagtatgaaagcaaacttaaagtctcaataaagcttcaggtagaaggactc

SEQ ID NO: 241349 - DNA, 920 bp, Homo sapiens
  misc_feature (695)..(695): n is a, c, g, or t
  misc_feature (740)..(740): n is a, c, g, or t
  misc_feature (744)..(744): n is a, c, g, or t
  misc_feature (759)..(759): n is a, c, g, or t
  misc_feature (769)..(769): n is a, c, g, or t
  misc_feature (772)..(772): n is a, c, g, or t
  misc_feature (776)..(776): n is a, c, g, or t
  misc_feature (783)..(783): n is a, c, g, or t
  misc_feature (789)..(789): n is a, c, g, or t
  misc_feature (796)..(796): n is a, c, g, or t
  misc_feature (801)..(802): n is a, c, g, or t
  misc_feature (806)..(806): n is a, c, g, or t
  misc_feature (811)..(811): n is a, c, g, or t
  misc_feature (817)..(817): n is a, c, g, or t
  misc_feature (820)..(820): n is a, c, g, or t
  misc_feature (828)..(828): n is a, c, g, or t
  misc_feature (832)..(832): n is a, c, g, or t
  misc_feature (836)..(836): n is a, c, g, or t
  misc_feature (839)..(839): n is a, c, g, or t
cgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggancctcaggggcggcacgtaaaaacctatgaggtgtctctccgaggnaaanggaattcataagggnccttgcgaanccngganaatgtcngaaagntggaagnttccnntggngaacngcaagnccnagagaccnttgngggnggngccaataatcactatgggacacggagtctaaactaacgttatcacaatgtgtgtaagcaataccctggtatatgcccctcg

SEQ ID NO: 241350 - DNA, 264 bp, Homo sapiens
ttattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggtactggatcaggaagagagagcgagaaactgtgaggttgatgtgataggagttgtttttgctaactggcatg

SEQ ID NO: 241351 - DNA, 376 bp, Homo sapiens
tgaaggagaaagaaaggaaggctgcttcctgcacctgctatgaatcagcaccatgccagtgacttgcagatctttttcagagctaatcttcacggccttcttggaaattcaatattagcgtaatattacctgcaagaagcctggggcacagacagcaaatgattagcctaagggcacacagccagcaatgccagagcagggctgacccccaggccttcctgactcctggctgagctacaccatctttccttcccaactctggagtagcggccccaggacaggttgtctgggtgtagcctgcgattcccaaagcgtaatccttggacaacgcccatgggaagcacctggtgctgaataaaaacagattcctaggctc

SEQ ID NO: 241352 - DNA, 3191 bp, Homo sapiens
  misc_feature (1891)..(1891): n is a, c, g, or t
  misc_feature (2631)..(2631): n is a, c, g, or t
catgtttaattcctactatttattccataaggtactaagaaggtctgtgggaatccttgatacttacctgggcttagtttagctctaaaaaagtagcacaggagcaggagacttgatgagaacttaaaatgaagtgtctggctaagaccaggatagtcgagttgctcatgaaacctctggattcaccgctgggtaaatctggtatcatgattgttttgatcaccatttaaaaatgtcttttctccagttacaaataagatgttttatccaagaatgtgcactagcacaaaaggactttattttgcacaacatcttctctttgataggacacaattttctcaggcctgagttacatgatgggggtggtggctttgaggaacatggagggtctttttgtggcagctaagtcagggagtttcaggataaggatgctgggacatatttctgttaagcaggggattctggtggaaataccaggactttcttttactgcttacataaacactctggatcctctgtgcccactcagaaagtttagggagaaaagctgaaaaggccttgaattaatatctcagatgaaggacagtgccactaacagtctattaaaatacacattaaaaatatgtaactttaaatccctttggtttggtttaaaaaaaattaaagttttataatgatgcctttattcttttatttaaggtacttaaaaaatgtatatattatggccagatgcagtgactcatgtctgtaatcccagcactttggaaggccgaggctgttcttgaactcctgggctcaagtgatcctcccaccttggcctcccaaagtgctggattacaggcatgagccactacacttgttcttattatttatttttaataccagatgatcatctctattaaaaacagaagtgagtgatatgatgtgtacaacagtgcacgtactgtatctttactgagagaatagtggagaaatacccttgtttgagtcatttcctgaacaataggatggggtggtttgtaaaccaaaatttggtctctgctttggtgaagctaagaatgcagttttgatcttaatatgctagtagccaacacaactgaaggtgatgcagcatttttacctcattagcagtgtcttaggcttagctggtaaggcttcaccagcttgcagtgcccaggaagctgacgtaataagcagcaggtcatgggcaacacggatgtcatcttggtccaagatacatccatcctgctgtgtctcatatttgttgtagaatgattcacatagaaaaaccattttgatttttcctgtcttttaaaaacaatacttcagtttgtcttcatgctttctgtaaagttgtatctccaatatgccggtttaattttgtatgaaactggaattttagatgaaaggctttctaatgcacaaaagaacctcagccctttctcagaagcacaacaaacacacacataaacaacaacaatagaagagttccaattaggattttcagaacacaaatacccatttaaatgtacctaacatttctctgctagaagccactttaaattattgttctttttaaaaggaaaatccaatatagttgaaagcttgtgctttataaatatgtgatgcttccctgcattatctgaaagagggagaaaaaccatgtcttgctttttgggatttaacctgttttagctgatcacaaaatctttattaattgcatttattagctatatagcactccaaggtctttgaaattttttggttgcaaaaatctgatgaaaaaattaaattgtatattatcttgtaattttgcaaaaagcatgtgattgagttgtgccctgccaatgacttctagtagcagagcaagcagtggtccttcctcaccatngagagtggcgtcggggagtttcttgcagttacaacaaagcccaaattatggggacggtgaggggagtctttggccacagaataggtttgggtgtgagctgcactttctgccttgctaagtgtcagtttttctggattttacatttgtcttcctatagcttcagcttcccttctttcctttacttcctactgtggccttcattctcttcacttggtggtgatgagtaattttacacaaggccattttctctggacatagactgaggcagtgatgggatggtgaagtaccacggatagtaatcagggggaccacagataatggcagggagccagggtgtctaccctggctctgcactgactggcttggtgatttgtagagttcttagggactgactcatgtgcctgcaaaattcataggctgaaaccctaatcctcaatgtgactgtatttggagggcgggccttgaaggagataattaaggttaaatgaggtcataagggtggggccctaatccagtataactggtgtcattttaagaaggggaagagacatcaggcataagcatgcacagagaaaaggccacatgtgaggacacagataggaggcggccatctgcaagccaaggatagaggcctcaggagaaaccagccttgcttggcaccttgatcttggacttccagcctccagaactgtgagaaaataaatttctgttgttcaagccaccctgtgttattttcttanggcagcaatagcaattgctaaatacaaatataggagaaaaatgaagtctctctaggattccatttcccatcttgaagatggggctagaaatcgtttctacaatagagagttatatgagaataaacaacataatgtaatcaatatagtgcctcaattcatgccttctcatagatggagaatttatgcccacaagcacaggctagtgtccattttctaataactcagctttttgctgagtacttagcattaaaacaaaacaacacaaatcatttatacatgttaagtttcaagtttcccacttcattttgcctggctgatggctcttagaagacacaaacttatggcacagatgacttcttctggttctaacttgtgttatctctttttcaaaagttagttaaattctccatatattttagtgttgttctattggctagaaagacaaaacaaggggaatctggcaatgtaaaaaaaaaaaaaaaatgctcagctgacccagcacgtggaattgcatttactaatttaggctattttatatagtggaataacatatttgcaaa

SEQ ID NO: 241353 - DNA, 2700 bp, Homo sapiens
  misc_feature (1400)..(1400): n is a, c, g, or t
  misc_feature (2140)..(2140): n is a, c, g, or t
tgagatgggatctcactctgtcacccaggctggagtgcagtgggcaataatggctcactgcagccctgaccacctggattcaagcaatcctcccaccacagccttctgagtagctgggactacagtcacacaccaccatgcctggctaattttttttttttttttttggagattgagtctcactctgtcacccaggctggagtacacaggctggagtacaatggcgagactctgtatcagagggaaaaaaatagggtgatgggggtttctatttgttgcccaggctgttcttgaactcctgggctcaagtgatcctcccaccttggcctcccaaagtgctggattacaggcatgagccactacacttgttcttattatttatttttaataccagatgatcatctctattaaaaacagaagtgagtgatatgatgtgtacaacagtgcacgtactgtatctttactgagagaatagtggagaaatacccttgtttgagtcatttcctgaacaataggatggggtggtttgtaaaccaaaatttggtctctgctttggtgaagctaagaatgcagttttgatcttaatatgctagtagccaacacaactgaaggtgatgcagcatttttacctcattagcagtgtcttaggcttagctggtaaggcttcaccagcttgcagtgcccaggaagctgacgtaataagcagcaggtcatgggcaacacggatgtcatcttggtccaagatacatccatcctgctgtgtctcatatttgttgtagaatgattcacatagaaaaaccattttgatttttcctgtcttttaaaaacaatacttcagtttgtcttcatgctttctgtaaagttgtatctccaatatgccggtttaattttgtatgaaactggaattttagatgaaaggctttctaatgcacaaaagaacctcagccctttctcagaagcacaacaaacacacacataaacaacaacaatagaagagttccaattaggattttcagaacacaaatacccatttaaatgtacctaacatttctctgctagaagccactttaaattattgttctttttaaaaggaaaatccaatatagttgaaagcttgtgctttataaatatgtgatgcttccctgcattatctgaaagagggagaaaaaccatgtcttgctttttgggatttaacctgttttagctgatcacaaaatctttattaattgcatttattagctatatagcactccaaggtctttgaaattttttggttgcaaaaatctgatgaaaaaattaaattgtatattatcttgtaattttgcaaaaagcatgtgattgagttgtgccctgccaatgacttctagtagcagagcaagcagtggtccttcctcaccatngagagtggcgtcggggagtttcttgcagttacaacaaagcccaaattatggggacggtgaggggagtctttggccacagaataggtttgggtgtgagctgcactttctgccttgctaagtgtcagtttttctggattttacatttgtcttcctatagcttcagcttcccttctttcctttacttcctactgtggccttcattctcttcacttggtggtgatgagtaattttacacaaggccattttctctggacatagactgaggcagtgatgggatggtgaagtaccacggatagtaatcagggggaccacagataatggcagggagccagggtgtctaccctggctctgcactgactggcttggtgatttgtagagttcttagggactgactcatgtgcctgcaaaattcataggctgaaaccctaatcctcaatgtgactgtatttggagggcgggccttgaaggagataattaaggttaaatgaggtcataagggtggggccctaatccagtataactggtgtcattttaagaaggggaagagacatcaggcataagcatgcacagagaaaaggccacatgtgaggacacagataggaggcggccatctgcaagccaaggatagaggcctcaggagaaaccagccttgcttggcaccttgatcttggacttccagcctccagaactgtgagaaaataaatttctgttgttcaagccaccctgtgttattttcttanggcagcaatagcaattgctaaatacaaatataggagaaaaatgaagtctctctaggattccatttcccatcttgaagatggggctagaaatcgtttctacaatagagagttatatgagaataaacaacataatgtaatcaatatagtgcctcaattcatgccttctcatagatggagaatttatgcccacaagcacaggctagtgtccattttctaataactcagctttttgctgagtacttagcattaaaacaaaacaacacaaatcatttatacatgttaagtttcaagtttcccacttcattttgcctggctgatggctcttagaagacacaaacttatggcacagatgacttcttctggttctaacttgtgttatctctttttcaaaagttagttaaattctccatatattttagtgttgttctattggctagaaagacaaaacaaggggaatctggcaatgtaaaaaaaaaaaaaaaatgctcagctgacccagcacgtggaattgcatttactaatttaggctattttatatagtggaataacatatttgcaaa

SEQ ID NO: 241354 - DNA, 426 bp, Homo sapiens
acattatttcttgatgtgagaagtttcttcataaacttgtatgtaatagtagcaggaataaaaaaataaggttaattgggaaaatactcttccttaatatttattcattatagtttacagagaatagtgcttaaagaatacaacaaaaggccggttagggatcatgcctgtaatcccagcactttgggaggccaaggcgggcagatcacttgagctcaggagatagagaccatcctggccaacatggtgaaaccctgtctctactaaaaatacaaaaattagttgggtgtggtggcgtgtgcctgtaatcccagctactcgggaggctgaggcaggagaatcgcttgaaccagggagtcggagattgcagtgattcgatattgcgccactgcactccagctgggcgacacagtgagactccatctc

SEQ ID NO: 241355 - DNA, 354 bp, Homo sapiens
catcaagtgatccaccttggcctcccaaacctctgggattacaggtgctatccactatgcccagcctcatgtttgctttacatgtttcaggatgctgcttggtacacacatagttatactttttatatcttattgatggaacgaccctttattcatatatagtatccttctttgtcccttgtaacagcttatgacttaatctattttgggtgaaattagtatagccaccccagttcccttttggtggctattttcatggaatatcttttatcagcctttcagttttaatttatttgtgtctttggatctaaagtcagtttgttttggacaatgtgtagtttgatcatgatttta

SEQ ID NO: 241356 - DNA, 631 bp, Homo sapiens
gcttcttgacaagataaatctaaaaagtggcactgaaaattgagagaacagctgaataacaaaacctgactagtaaagtacttggtcctcattttgcattccccgtttttgaagaattcaaatcaggaaatttccgttatctaaatcacaggtttcaataggattaagagaagaaataagagaagcaacaaggtgcacagaaagccagctctgacctttgttatttcatattgaagctcttactttgagatggaccagtagatgaagagagccattattcagaggagctgctcttgctcttcaaatttcagttaatatgaccacgttagaattattttatttttaaacttcagtaacaaggctctctttcctgttttcaacacacatgtttagaataatcagtggaaactctgcaaatggatgaaacaagcaaatcccccaggactgttttgtgactgattttcttacttctcacctatctaatatgaacggtttagattttgctaagctcaatcataaactcaactctagggggaagaaagtctcaagcatatggttcaaccaactgaaaatgctatacaatcaaaaggaagtataggctagaggtttaccattggctgcttgtacattc

SEQ ID NO: 241357 - DNA, 577 bp, Homo sapiens
gcttcttgacaagataaatctaaaaagtggcactgaaaattgagagaacagctgaataacaaaacctgactagtaaagtacttggtcctcattttgcattccccgtttttgaagaattcaaatcaggaaatttccgttatctaaatcacaggtttcaataggattaagagaagaaataagagaagcaacaaggtgcacagaaagccagctctgacctttgttatttcatattgaagctcttactttgagatggaccagtagatgaagagagccattattcagagatttttaaacttcagtaacaaggctctctttcctgttttcaacacacatgtttagaataatcagtggaaactctgcaaatggatgaaacaagcaaatcccccaggactgttttgtgactgattttcttacttctcacctatctaatatgaacggtttagattttgctaagctcaatcataaactcaactctagggggaagaaagtctcaagcatatggttcaaccaactgaaaatgctatacaatcaaaaggaagtataggctagaggtttaccattggctgcttgtacattc

SEQ ID NO: 241358 - DNA, 668 bp, Homo sapiens
gttgggggagaatgaaagaaaagaaaatctattttagaaacaaaaatgtatctgtgcagctttgttttctcatggaagacaaaggttctttccaataggacagaatgacagttccacttatcttggctgcacagaaattagatcagtaacatattttctgttgaagaagaaaccttatcttagtggctccatttcagaatcaatcatctgcatttcagtcctgccccttctcacaagcagggaacattatacaatttgtatgtttcaattagtttgccataaaaaataagtagctcaagggcattagtttattactggtatccagccatgttttcttttgctaaatgacattctgaaagcctccattctgagcataatcaccttagggtacccacagaatgtggccccaaatgattcaattacagctagaagttgttctcttcccaaagcacgagtcttttgcattcacaggatattttttctttcataaacattcctgcgagaatgtaagtgcggatgaagattgtgttctgtcttcttcttgtcttttttctgtttactctgattttattttataaattattttattcaaatgagaaaattttccgctagaaccaatagtaaaggatggtgagtttccagctgacccacaatgacgtatttaactc

SEQ ID NO: 241359 - DNA, 776 bp, Homo sapiens
attgtcaacaagagggagtggcaattcagaagcatatttaagccaagtcctcaagactagaaagcatgaagcaggggaggcgttttgaaagcgtaagaacgatagaccatgggcatggatggccgagtctggggatcagcatcgtaatttgttgagaaggaggccgtgctgtgctgccagttattaattggtttaatcggttgatacacagccctactggcctaaccagtagcccagggccctggaggatttgcaggtcgtgtcagaatttgattgcagttccctccacttggcataaggagacactatcagcctgattgggagggtgatggtgggatggagccggccgaggtggcggcgctgagctgaccacaccaccagccatagagtgggagcctttcctgccggcttaactgcagctaatatcaaaagcactggtatgggctgtctatctgtgctggaacctgagtttatctttgtctgcaattacgattcttctcggtttattttgccagctcattatccagcctcctggaatcaggcctcccaaatttagcaggtgctggggaggaccctagggagtggtttatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttattttt

SEQ ID NO: 241360 - DNA, 623 bp, Homo sapiens
ggatggttaagcaaaggctataaaactgtctgaagtagttcaaagtttatgtagaggaagtagttaagataactataaatggatgagggcaaatggacatagaggtgaggtttctatgcttaacttgaagtggtaaaatgacatcagtagactgtaagttacgtgccaagaacagccagtaaaaaacaacctatactaagagatacattggaacacactattgacaaatcaaaatggaattctaaaacacttacataacccataggaaagcaggttgggaaaaacaaagaaatcagaaacagaacagatgggaagaagtaaaatgaccgactgtatattcaatgtaaatggtctaaataagccaattaagagataaagattggccaggtgcagtggctcactcctgtaatgtcagcactttgggagctgaggcaggtgtatcacttgaagtcaggagttcaaaatcagcctggccatcatggcaaaaccctctttactaaaaatacaacaattagccaggcatggtggtgcatgcctgtaatcccagctactcgggaagctgaggctacagtgacccaagacatgccactgcactccagcctgtgcgacacaagaccctatct

SEQ ID NO: 241361 - DNA, 825 bp, Homo sapiens
  misc_feature (32)..(32): n is a, c, g, or t
  misc_feature (53)..(53): n is a, c, g, or t
  misc_feature (94)..(94): n is a, c, g, or t
  misc_feature (117)..(117): n is a, c, g, or t
  misc_feature (138)..(138): n is a, c, g, or t
  misc_feature (181)..(181): n is a, c, g, or t
  misc_feature (202)..(202): n is a, c, g, or t
  misc_feature (281)..(281): n is a, c, g, or t
gatgtatctgagtgttgtgatgtgaataactntcccctggactccttggatgntttccatgaaaatagtgtccttatttatccctatttccctncttaatatgtcattgcggaggancttaaaaattggtccaaggtntgaggtattttcagtctgatccttcatgatgtaaatattttanccagtaccagttatttatgantaatcagcttccttttatatatttatcatgttggatcaagcattaaataaaaatcaatatattctatatgctaaatgtnttatgtgcatttcattatttaactttcgtgccactttatgtagatactattcctattttataaatgagacattaaggcttagagaggtgtataacttgccccggagtgtatacatctatacatatatgtatagtatacatatatgtatactatacgtatagtatacatatatgtatactatatgtatacatctagtaattggcaggagttgaaatttaaatcccaggaatcccaagctcttaacagctctatgaacaaaattttgcatggaattacagaatcatgaatagttgatactatttgatatggagtttgggggtttgttttaaaactttgtttgatttttgtagtccattgattaaaatatcaactcactttgtttccatttttatgtagagagccttgggattttaaaagaccagcctcactcagcttttaccttagaaaagaaagtcatcaaaacagaccctgaagattcaagatagctgtgattctctcaccgttctctggaaatggcatcagatttaaggataatactccatca

SEQ ID NO: 241362 - DNA, 361 bp, Homo sapiens
taaaaccatgaaaaccttgggttacttaacttatcctagtttactgaccattacctagggacctgacttctctaacagttgacaaaggaaaacagtatttacacaacaaatcccaacttcctggtttcatccaaaaagggctgtttgaagtctccaaagggccaagggcctaaaacgaaacaaattccgccctacacagaaaagcaaagtcaacatcatcctgttacgaccttactagcgacgacaagggccaccggcgaccgtgcagctgtgcccttaacgctgcgcagctgccgcgcgcctcggccgggtgtttatggcacacgaggggtggagagcgccccgccatgggggcggccgc

SEQ ID NO: 241363 - DNA, 375 bp, Homo sapiens
cctctgtaaaatgaggtgaaacaatatggttaaaaaaagaaatctgtgtataaatgttgatgagagaaatgcttcaaagggtaaaaactaaagtgatgacaaagtggctcatttaccaaagaatctcattagtgtaacatatggatttccatgcactgcctacgacctcataataagatatttcttaaaataacttacaatattttaacaaaatttctttggttaatgaattcagttgatagcagatagcaacagaatgcccacagctagcacatgtgggcaaagcattggcataagaaatctgataaaatcaatctattagtgtctttaactaactaaaacattacctacctcccagccagtactctgtataat

SEQ ID NO: 241364 - DNA, 340 bp, Homo sapiens
agttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatgtttttaaaaaagaatatttgtac

SEQ ID NO: 241365 - DNA, 422 bp, Homo sapiens
acagattaattcaaagtcctaggattagtgtgatgttggtgtggtctagaagtgaattgtggatggaaatgttctcagccaagtgtattcactttgggagagcttcaaagaacagaatgattttgaaataagaatatataatatatagtcttactggaacctatgaaaaactcatgtgttatctactactcaagccaaaaaaataattttttatgcttatgttgttaaggatttacttgcatcacttcattaattagcaatttgtattgtatcaagtgggtctaatccttttaatagattccaaacaggctacttggctattaaattctagtttgttttatatttattcatgagaagaaaatgccatagaaagattccatgaaggaaaatgtttgctttgcattcagtctttcaacaataaa

SEQ ID NO: 241366 - DNA, 484 bp, Homo sapiens
ccaataagatcactaaagtacctcagatcagatttcaaatcagcctactcatcaggtccactctaccatgccagaccaggcatccaagttataaagatgagattccaaattacccagctgccataaagctcgcgttcccgtgtgaatcctgaactctggctgacgacatctggagtccactgcaatcatgtgttccctcaatgactgaaaaacctgagcataatgactacctaagattcatatctgtacatacccaaaatgtttattaaatagaaataaagataaaataatgtgtaggtttatggctgtatttttgcttttatggcatttgggtcacttctatgattatctctgttccatctttgatcacaaatgcaagctctattgttcctttaaggaaatacaaaatctttcatgacaatctcttttaggatgtgtctttctaggaacactctgaaaaataactagaattggcaatgctaag

SEQ ID NO: 241367 - DNA, 442 bp, Homo sapiens
ctagaagagaggattttgaatgttttcttcactaagaaatgataaatgaatgaggtgatggatatacaacttattatacaatgtatatatgtatcaaaacatcacactgtaccccataagtatatacaattattgtgtcaattaagcataaataaaaaggttcatcgatttaaatcgttcatctatttgaacagtttaaattggcttatctgttaaatatttctcataaaattgaagatttacttctcttgatgtatttctccatagatgctgtaaaaaattgctcacaattctccagaaggaaaaaggccacattattatttagagctttgtaataatgaagaactgaaacaattaattgttcaatagccaataactagataaacagaagttaatttatttatgtaattctatcctgcaataaaaaaggaataaactgtat

SEQ ID NO: 241368 - DNA, 313 bp, Homo sapiens
tcatgtgccatatttgctgttggaaatcattatacaatgaaaaatatgtacaaagttcagtatgtcacataaaccaaatattgtagaataattcaaattggaagagttgcaactattaaatgggatgaagaaagtttattgtaccatcattagtctttagcattgtacttgttattttacaaaatatctgtttatatagctttcaatccaagttgatcatacattcagggaaggcagaaattgtgttactcacttttgaaccatcaacatacagtgcaatttataaaaaccactaataaataattgctgaatg

SEQ ID NO: 241369 - DNA, 365 bp, Homo sapiens
catgattattaagcattttctccaaagtctgaactacagtttgttgaggtttcattgaaaatgatactaaaacaaatttgcttaaaagtaaaatggagttattggcatcacaaagatcatagtcaccttcttaagaattgcataacctttaatgactgtaaaggatttttaaagacgatccttgcgactagttattaatacatttttttgaggctgtggaaatcagataatttgggccgggcacattggctcacgcctgtaatcccagcattttgggaggctgaggcgggcggagcacctgaagttgggagttcaagaccagcctgaccaacatggagaaaccttgtctctactaaaaaaaaaaa

SEQ ID NO: 241370 - DNA, 339 bp, Homo sapiens
atttcttcactcttgttgctgtgatgttttataccatataattacacccactacttatctattctattgctgttagacatgtgaatcgtttcaaatttggggctattatgaatagtgttgcttggaaaattctcaaacttgtcctttagcactcatgtggacccagtttctattgactatttaactaggagaactgttgggttatatggtatgggtatgctcagcttcagaagcataagtattttttattatttttttaaagaaatgggtgcaaactatttgctgcatcaaccatatttaatctatctgtatgcattttttttttctagatggagtttc

SEQ ID NO: 241371 - DNA, 877 bp, Homo sapiens
tggatcggttgacaggattgggtgtgtgtatacatttataaattgggtggatgcatgtattcatggatggttggatccgttcagtgatggagggtcaggtgcatgtatggatgggtggatgaatgcatggatggatggatggatggatgtgtgggtgtctaggtagatggatgtataagtgaaaggatgggtgagtagatgcatgaatgcatggattagtagatgggtgggtaaatgggtttatggatggatagatgaattgatgggtggatgggtaagtggatgagtgggtgaatggatggttggatggatgagtgggtggatgggtagctaaacagagggatggctgggtaagcataaaacagtcacctaagtttgacaactggtgcatattatatgcccagtggcatggctcagaaagtttatgatttaggaaagcagaaaaacttatggtccccaggagatgtggaacttggtgccaatgactggaagagaccctctgaagtagtgcacaaccctgggacaccaatatatcactgctaaaaggaagaccatgaactgatcagaagacccatcagaagactaggccttgtcctacagccccagcactcctgagcagcaggacacacccgtagggcaaaggaattttgtttccgagggaaagagcatttggtctctgtggacccttcatcaagggtcatgttgctatgagggaggggagcagaggtacagtcatgtgagcctggtgcagccttgctgcagcatgaggaacttagggcagatgtagtaaggacttcgggctatgaggatgattaagtagaggaggaggctgtgactcagtcctgcaggctgtgggagcagagctgtttctcatggt

SEQ ID NO: 241372 - DNA, 949 bp, Homo sapiens
aggatcctacaggacattcaatcatcacgtctccttaggcccctctcaactgtggcagtttctcagacttcgttgtttttgctctttctctttcacgtggggagagtgtggaacggctcagtttctccagcaaggaatcctcctgtcctgtctaaaaggcaacctgcatcctaggagcaaagagagggaaaagcactgaggagtacggccatgccataggcagatttgcaattaattctctcgcttgcagccctatgactaattctgggccaggccgtgcatattgtctccaaatcctgaggctcttgcctcccattctccaaagaataatcagcctcctgcctgggggggtgattacacagctgctagggttctatgcctgagccgtaagtgaggtacacagactgtttcccatgttaacatattcttcagtttattcccacactctctgctgtactggattcctcagtttcggagcttctccaggagtctacaggactaacttattgtctccttgttagtaccaacttcttgcttgtcctttaagatatgatatcctcaatctggttatatcagacacctttcctacattcctttcctgtcttttgaaatatgattgaaatatttcatcaattaatgtcttctctcctattctctttgtacttgcaagcttaagcctcttttatcttttcaaatattttagcaggctctctgaaaggagaggctataaacttctatgtctattcttctatctttaaattcaacaagaggcagaacactttcatggttaagttaggcctgcatttaaatcctgcctctgtcacatacttttctaagacttagcaatttgctaacctctggaaaccttgacctcctttctgtaaaatgagaacctacctcattgggttgttgtgaggatcaaataaaatatgtatggttggcacgtact

SEQ ID NO: 241373 - DNA, 314 bp, Homo sapiens
gatgcttcttccagggtcctgcccagaagatggattgtgacatctcactggaccagcacccacccaggaggcattgcagcatatatgtgaggccagatcaaaggctgaataatgacccttgtacctggagccaggatgtgcaggatggtgattctcctccctgaacctttttacagtgtcctcagaagagatcataacatattgctggattcatcatctaggttatgtgtctctcctctcccgcctgaacactgattacagtgaagattgtagcatttctctgcactgcatccaaatgacatgattctgttgca

SEQ ID NO: 241374 - DNA, 499 bp, Homo sapiens
ttaattgttatacattcatttttgacttatttttatcattataaaatgttgtttgctcagaattttttagtctgttaataatattgataccttttttattttgctggatatctcttctctccttttttaaatattaagtatgttattttaaatatgatatgtctctcccaaagagcaaagctgagccaagctgaatttcattatttgactaaatattagagactttacctttttaactgaggagtttaatacatttatatttcttgtggtaatggatgtgcctgattttaattattttgtactttctatttttgcttctttaatttttttctttttgattgatttccttccctcttgcactagtttttgttcaaattttattgaccttttttccttctagtattctagaaaatgtacatatggtttctaattatagtgatttgagatacaaatatgttcgtatcagatcagatatatttctgttgaatgcaaaaataaa

SEQ ID NO: 241375 - DNA, 471 bp, Homo sapiens
aaggtcagttttcttaatggagaaaatcccaaagagaaagaggcaaatccccatctttcatgttgtaactatcaaagttccagacatgctttgtctgtatcttccttcaggacaaatccatttacttctactggtgagaggctggacttggtcagctgtgcgggaggaacctgtgctgtctgtaggtaaattccagccacgctcctcagccctcaccgcttgggcttcctcttcttcctgactcactgtccctgtgacgtgtgttcatcagcacagtccatctctttttttctgcctcccccaccccttggaacagaaatgtattggctgcatacaaaaattagccgggcgtggtggcgggcgcctgtagtcccagctacttgggaggctgaggcaggagaatggccgtgaacctgggaggcggaggttgcagtgagccaagatcacgccactgcactccagcctgggcga

SEQ ID NO: 241376 - DNA, 1338 bp, Homo sapiens
  misc_feature (71)..(71): n is a, c, g, or t
  misc_feature (143)..(143): n is a, c, g, or t
  misc_feature (187)..(187): n is a, c, g, or t
  misc_feature (230)..(230): n is a, c, g, or t
  misc_feature (655)..(655): n is a, c, g, or t
  misc_feature (724)..(724): n is a, c, g, or t
tttcctgcccaaagtttggggttgggagggaattcccaggggttcccaggacttgggctcgcctcccagancccgcaacctttgcgtgcctagcctcggcaatgaccgcccatctgccacgagggggcggcagcgcaccgttnagacgctgcgcccctggtgcattatgggtcgcgtagtctcaaangtggcataagcatcctggaacgcaaacggcatttcccagaaanctacgcgacaatctgagcctggtcttgcccagagctggaagctgaggtctcgcccctgccggcgttgcgggggattgtgggatgtaggcatttggctccgcgctccgcgaagggcggtgcagcgcaggcgcgggcatccggtacagacagccgagcttaatctgaggcggggaaccagcgtcccgggggaggcgccgaagctgactttctggccgcagtggaagtgaggcgagcgagctcccttagtggctggagccggctgggcctccttcctgtcctcctgctttcctgcatctctacttgtccctttccccgggctcctggtccgctcccaagcctgttcaagcacgaggcgtttccatctaaaaaaagaaaagaaatctcttttgccgggcgagatgtcagagccccgggagcgaaagtgntggtaatgttagacagaatgagttcctcttcaaaaatctaacttccttgtcctttgctctatgaactgnccttcctgcagaaactgcccttaccggggaaactgcccctccccgccgctgcaacccataccccgcctctattagaaataggcaatcggaatcagcttagattgtgaggtccaaccctagccaacgggggttaaaaacccctgctctcctttattaggtgtgcttttggtacaggtctgggcagcacgcttctgcagaagtaaactttgccttgctaagaaacttttctccgagtgctggtctctctctgtggcaccaagaacttatttctaacagtaagaagaatttactgaggacagcgtaggcttgaaaaagaaaagttttactagaaagaatgctgccgggcactcacgcctgtaatcccagcactttgggaggccgaggcaggtggattgcctgagctcaggagttcgagaccaacctgggcaatacagtgaaaccccatctctactaaaatacaaaaaactaactgggcatgccagcatgtgcctgtagtcccagctacttgggaggctgaggcaggagaattgcttgaacccaggaggtggaggttgcagtgagctgacatcatgccactgcattccagcttgggtgacagaatgagactccatctc

SEQ ID NO: 241377 - DNA, 568 bp, Homo sapiens
ctacgtcttctctgaaatttaatgatctctatggtttttgctttaaaatatgtaccccagtttctgatcactattaaaatttttgatagtatataaattaatattaagtaaatttcattctagatgaccaaaatgctttctgtatagtgataaaatgcatacggttttctagtctataatcaaatgaagcaaagatcataataaataaaaactaagattttccagattcacttatttctaagacactttatcacagaaatcatatttgctactataagattaattgggccgggcacagtggctcacgcctgtaatcccagcactttgggaggccaaggcgggcagatctcctgagctcaggagttcgagaccaccctgggcaacatggtgaaacaccctgtctctactaaaaatacaaaaattagccggatgtggtgcatgcctgtagtcccagctactcgggaggctgaggcacgagaatcacttgagccctggaggtggaggttgcagtgagctgtgatcatgccactgcattccagcttgggctaaagagtgagactccatctca

SEQ ID NO: 241378 - DNA, 782 bp, Homo sapiens
gtgagtcagacagcaagggcatgtccttgataaaaggctgcacagtctcatcagcctggccaggcctgtctcagggtgtggtttcaggagcagaaggactggttgacctaccaaggctggggacagggatgtgagaagaatccttttcttgttctggtctgaaacctgcaaataacttgatgggagttgagacaaagtggtcctcagcttctctccagctttccagactgccatatctggcagaggttctatgtgcggagaggcccaagagtaaactgaaagcaaaaacaattgagctagctggtggattttgaaggcctctaatcatttaattaccttgcaagaagcttttgcatttctgctttttctttcttgtttgctcttcttgtaccaaatttctttcttttaagtatagaagaggagcctccttctgttgctcagaaagagggaaaaagaaccagaagggaataaaataaggccaggcgtggtagtaccagcactttggcaggccaaggtgggaggatcacttgagtccaggagttcaagaccagtcaggacaacatagtaaactctccccaatagaaaaatatttttatttttctacaaaaaataaaagtaagtaagtaagtaagtaagctgggcatggcgatgcctgtctgtagtcccagctacttgagaggctgagatgggaggattgcttgagcctgggagattgaggctgcagtgagccatgagcaagccactacactctagcctgggcaacagagcaagatcctgtctca

SEQ ID NO: 241379 - DNA, 524 bp, Homo sapiens
caaagagatcttctcaagtgcttaggattacctctcaacacacagcaagcatgtccctgcctcccaaagttctgggattacaggcgttgagttatcgtgcccagcccataagtgtcttaatgccatgaaatcctagtgagaagaaacttcaggacacatttgaagcagatcaatggtccccctcaaaagacattcttatcctaccaaaatctttaaataagggtatgtgtacaaggctgatcattgcaatggtgtttgcggagatttttacaatgaataagggaattgttgattacagtgttatgtcaatacactggtgcaagtaaaaagaattaggtggttttatcattaagcttttttgctaaatcaacaaatacttattaaatgcttactgtgtgccaggcactttgtttggtgctgggaccacagagggggaccaaatagacacattcccggctccattccattcaactcctagttgatctgacagcaaggaggatttgtgtcctttcattcattcagtg

SEQ ID NO: 241380 - DNA, 346 bp, Homo sapiens
gacaccagcctggggccagaggagatgagaggagccccagtcactggagtccagggaccagaaagttgtagagtaagtggggacctgtgtgggcctgttcagagggagtaagggcattgatctgaaagcaaacagggctaaaaccaggactgaaatccaggccactcgttctctcctcaacacccatccatacccttctactgccacttaaccctcacacagctttgcctgacatggacaagtttccagcataggccaaacccagccacagcgtcggggagcaggagccgtccaatgtcccacagggcagctcccaggctgggctggtgacaggagaggagcttgg

SEQ ID NO: 241381 - DNA, 303 bp, Homo sapiens
tattggtttagctgctatattgtttggtgtgtacagtttttattccttttcctgtaaattgtatcttctgtgccattgtgtaacattactttgtctcattcagtacatttaactttaaattccactttttcagagaggaatattgccactcttgcttttcatgtgtttgtttgtatttggctgggattgctttgcccagctctttatttttaaatcatttgaaaacctcagcctctgtctcttaatggtagaatttggttcaaacatttggtgtaataatcgacaatattattttactccttc

SEQ ID NO: 241382 - DNA, 439 bp, Homo sapiens
  misc_feature (8)..(8): n is a, c, g, or t
  misc_feature (18)..(18): n is a, c, g, or t
gggcgaantagacctagnggatcccccgggctgtatgaattcggcactaggcctaatccagtccaaatcgtgaagatttgtgcttatgattttttggagttttgcgccttcctctctttccagtaggttttggtccatattgagtcagcgtttgcatgtgatgtaaggtaagggcctgccttcactcctgcacgtgcagacccagttttctcaggaccatgtgttgaaaacactgtattttgccagttggcatcctcttggtgcccttgctgaaaatcgattgaccgtaaacctaaaagctcatttctggatcctcagtttggcttagtgactgcatgacagtcctggtgcccgttccacgctgttcaggacactgaagcttcgcagtcagttttgaaatcaggaactgtgagtcctctaactgctctctttcaaaagt

SEQ ID NO: 241383 - DNA, 436 bp, Homo sapiens
agcccggggttagggcatttcgttgtcacctggcgacggtgaagcctagtttcctccagagagattatgctgctctccatccaagtgaagtggcaatggtgccagcctgagatttctgccctgagttttaagtacgagagtgtgggctgacaataaactcctttattctaccctcttctgttctcataaggagaaatttaaattctggaagagatgaagcttgcatttacccaggcctgttaatgaagaatgttggactaaattttgagaattcagactgcttaagaaatttgcttcagaatccccaaaggattctgcaaggagctagaaagaacattttctaacatcagttacttgttttaataaactccttcggggtaagattttgattcccaccactgatcatatcattaaaaagtgtattctctgcactaac

SEQ ID NO: 241384 - DNA, 363 bp, Homo sapiens
caagacaggaaaaaaagaaaatatctttctcctatatcatcatacaagtggcaagtaggtattaataataaaataggactgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctca

SEQ ID NO: 241385 - DNA, 493 bp, Homo sapiens
ccagtgaaaagaaaatgaaattgtccagatttgggcacagaagaggcaatttagaagaatgacaatttagtattgaactatttttagagtaaagagcccagagaccctgaccagctttacagcacgctcaagagcatcctccagcaggtgaaggatgcaaaatttttccaagggatgtgcatctgcagacagttttaagggactattgtcaagaactgtgaaggatctgagcttacaagttagcctgcttcagttttatggatgttggcagaagacacataactgtttggtcagagacagaaagacttccattatttgcagtacagcacagagttgcacgagcttcatctttgctctggttcctgttttccctcaagtttactggagatgatgacaaggagttcaagttgatgctacacacagtttgtgtcacagatgaagaactccaagtaaaggaaacttaaatctttaataaatgagcagtaagcacaaa

SEQ ID NO: 241386 - DNA, 417 bp, Homo sapiens
ccttaaaccattctcctgcttggcctcccaaagtgttaggattacaggcatgagaccactgcacctggcctcagtgttcttttgcctggaaattagcaaaccttcttcaactatcactgacagatgtcattataaagcatacttttaaacattactccttacaagtgaaaatcctaaatgattcctattgccgagtggggttctaaccctttagcctggtgtccaaggctctctaccctctaatgccagccttatctcctgcctatgcccttggtgaaccttatattccatctagccaagaacacaagttttcagcatgccctgcacttccccccatgacccaagtctttgttcttgctattgcttctctctgtaattccctttcttccctatctaaccccccttctcatatgtgtc

SEQ ID NO: 241387 - DNA, 510 bp, Homo sapiens
ttaattttgtgtaatcagtgcagcagggatagaaagaagcaagacagttagctggactggtctggagagagaggactgaatgaaagagaattgagtgagtgctgatttcctagtatgtcacagagatgacaattctgagaattattggcaatcttgcactgcattcgaaataaaaggggtgaacaaacacattacaattctcagggcttttgctatagaaacttattgtcagaatagggacttattgccaaatgcctgaagcatcttcataataaaagacagtaaccttgatgaaccaattattaacaatgtattacagaaagctgaagggaattatgattgagtaaccataggttagtggttgaattttaacactttaacagttggtgaatgaggatggagagtatagtaagaaatgactgtgtatgtcaggccaggaaaggagatttctttctattctctctgtttctaatcctattttggaaccaatctagtgagtctgatgctaaa

SEQ ID NO: 241388 - DNA, 2903 bp, Homo sapiens
  misc_feature (15)..(15): n is a, c, g, or t
  misc_feature (372)..(372): n is a, c, g, or t
  misc_feature (432)..(432): n is a, c, g, or t
  misc_feature (665)..(665): n is a, c, g, or t
  misc_feature (809)..(809): n is a, c, g, or t
  misc_feature (1195)..(1195): n is a, c, g, or t
  misc_feature (2478)..(2478): n is a, c, g, or t
aaaaaaaaaattcantattagctttgactatagccaattttgaatttggtccttatggagcaatatttttcttcagacctcactataaagcagaatagaatggttctagacaataacttttcatggagggtatagccagtcatcatcaatggccatggataaaatcctaactaaaaattccactttgacaaacatggtctcctaaatatgtctaccaggatgcattagctgcaaagtgcatccatccatgggttacagggtaaactgaccttctctatggagttctcttataattcaccagttatattggaaactatgctgaaaacaatgcctgcacttagctaatgctcagtctaattcctggaaataaanaatcacccaaattattttccttttcccccaacatctttttcttcgtattatactaattcntgttcattgaggaaaaattagaaaatggagaagaaaaaaaaatcacaactctatcatgtaaagaaacaatactaacattttactcatgctgtcaaatattttcctacccacatatattttgcctgtgtctgtctttaagctataagttgtgttgatcctgcttcttacaacctactttagatcagctttacttccatcctacaccatatggaagtgcattctccaagattccnggaattccccagagattcatatttatctttgtctctttgtcaacattggttatgacatctcatttctttcattttgtagctatttccttttctccacttcgcaaatagctccattctccccaaacacatacaatatcactcacnaggtagctctaagttctttggccactgactaccttgttcctatgctctttctctgttccttctctcttctctccttcccacatccgaaattcctgtttatttcttatttatggtaccttaggaacatgccttgatgagatagttcagaatatgagggcctgggtgggaaagaggcaaagaccctaaaagaaaccatagtgatagctagtaaaatactttttttttttctcacaccacatcatgtacttgacttaaagaaggaaaatagagtcatatgactttggcatacaacttctccattggtcaggctgaagctttcttggaaccccactctaatctgagactcttcccacttgatcttccttccttcctcgactcttttcaantgttagaactttattatgatcttaagcttcttcttgccttcttcagctccttctccttgtccttcttgaatattctaccaataaatcttctgcaataattctgtcttggcatctgcttctctgaagaacccaaaataatacacacacacacatttaccaagtgaccataaagagtcacaaaacctgttcttgcaaaacttggtgatgtgccaagctcgtttcttttaggtacttgaagttcctttcatgacaagtttactagaggcagacactaaaatattctagtgctaactgctcttgcggtttctatcatactcctattaatgcaagagcagatgtgcttgtacatttttccaacaataaaatattttgagtatctcttttgctagttagcaaacccgatactgatggagttagttctcattgaagcacttgcagtagctgcttctaaagcacagatttgtggagtgcttgctctgaataggattcttcagatatcaactaaccatccctgtggagcagattcgccccgtgcatgcatgtacatatcacatagcctatgcatatttgaaataaatttcagtataatgtcgactttacccatgacagtaaacaacagcatgtcatgactgcataatggtcaattgcatgaatatcccacttattttaataaattctgcaagataggttattttgggctcctaagttttcactgtttctgatttagcaaatctgtatactttgcagtgtccaacttttcatagactatttcctagaagaattattggcttaaaaagcatggccaattttaaggtttttgatatttgttgccaagaagtcagccaggaagtttgttccaatttacacttgaaccatttctatatgagtaggcttatttcttttccttttattttctgcatgtgaaattatgtgtaaaatgtacagtccaaagaacaacagaaaaaaacctaacccttgaatcctccaccaaggttatgaaatagaatttattaagttggtgcaaaagcaattgcggtttttgtcatgacttttaatggcaaagaccacgattacttttgcaccaacctaatagaatcctcctgcatttgctgattctcatcatacttcttcatgcctcccctcttcacaggtaaatcatctagaatttagggttatgcattcccttggttttcttcatagttttcatagttaaatgatagagtgtgtgtgtatatataactatttgtagtcctaaatattatatagattttttaaatgtgggnggcaaatacaaagctagttgtgtgaggagggtatggtcaccgctgttaggtaaagttgtctaggacaagatgaacttgcagtcttctgcatcctgggactttataagggggctttctggtatattcagagggagagaccatgaagctcaccacagtccatacatttgcaaggactgtaatgcaaagcaggtactaaccacgtgatcagtgggagtggcatgaattaccctgggtttcttgctgctaagcttgttccagctcgcagaagtcagtgataacagaacactttggcagaatgaataaatgtccacagttgatttaggcagcaggacctggaagaaagaataaggaatttattagcaaattgtcaagatcactagattcgtatccgggccagtctcaccagaacatttctccaggtgttt

SEQ ID NO: 241389 - DNA, 551 bp, Homo sapiens
ataattcaaagataacagagacctactccctttctgtgcaatattacaaataaattggagggaaataggaagtgaaaaatcactctaatcccacaaccatgatttcaacagtatgccgctgtcaagtattattttttgtaaggagtgttaaaatactttgcatttatatagcactttacatttttaagtgttttgggctgtatattaatttcattctaataataatcatgtacatttagtatatgtttcttgctctatccagaaataattttctctgggcatatttccatactgaatagcaaatagatattattattactgcaagagaaacttgtaggaagctgattgtatggggaagattgttaggcgtgtgagtgtatggagttttttatatgtaaaggtgatatgaatcagccaggtttgtgtttacttttgcctccacctggccatagaatcactgataatacctatcttgcattgttactgagaagtttgagtgaaatcgtgcatataactcacatagcatgttgcctggcacctagtaaattgtc

SEQ ID NO: 241390 - DNA, 342 bp, Homo sapiens
gcacacagggcagaaccacagagtgattacatacaccctaaaggggttcaggagctcagaagcttatatacgatcttgaggttaaaaaagaatgggaggccgaggcgggtggatcacctgaggtcaggagtttgagaccagactgaccaacatggcgaaaccccgtctctattaaaattacaaaaaaaaatctagccaggtatggtgacgtgtgcctgtaatcccagctacttgggaggctgagacaggagaatagcttgaacccaggagatggagattgcagtgagctgagatcatgccacttcactccagcctaggcgacagagcaagactctagctcaa

SEQ ID NO: 241391 - DNA, 546 bp, Homo sapiens
ctcaattagatagaaggaatatgtttgactttttttagatctattacacaacatggtgaatacagctaataattaagcactgtatgtacatttcaatactgttgagagtacatttcaaatgttttcatcacaaaatatgtcaaatatttgaggtgatggatagattagctttatttaatcatcccacattatattcaaaaatcataatgccacttcgtacctcataagtatatacaactataatttgatatataataaaaaatttttaaaggtagtctcctaacaatcatatgaggattatcctaaaatgtcctttagtaactgtcatggactgaaaagtatcccatgaagagacaatgtctactcagaacatgtgaatacaaacttacttggaacatgggtctttgtaaacataattaagggtctccagacacaatcaccctagatcagggtgggccctacattcaaagacactgtccttaaaaggtaatgaaaagacagagggaaaggccgtgtgaacgcagaggcagagactggagtgaagat

SEQ ID NO: 241392 - DNA, 593 bp, Homo sapiens
aagtgtcatagtaacatactaggaacaaccaagtcagttttgaaaaagcaagagtatgtgctttatcaaataccaagatacattataaatctataataattttatcagcataggattgctacagtaactagaaacaccgatggaagagaataaaaatctcaaaatgcaccactgatctaagaattgggcagctgacagaggcacattatttataatgaaagaagaatacacagttcaataaatgatgctagaacaattgaccaattgaaaattggtcaactgaacaatagaaaatggtatgcaaacatcacaccatgcaaaaaaattaagcctagagaagtcaaagacctaaacagaaaaagcaaaattttaaacactcttgaagtacacatagaagagtataagactttgggatagagaataagttactaaagagtgagaaaaaatactgataaaactttctacattaaaattgcactttttgaaaaaatcaaaaagcagccaaagttaaaatataagccacagattgggaagtaaatttttattatgtataataaacaaaaaatgaacatccggaacatattatgcattcc

SEQ ID NO: 241393 - DNA, 282 bp, Homo sapiens
attctgtggccatttgccaagttttcttaagagccgttcagctgttgtgtgattcattgaattatgattcatcgaggtttccatttaactcactcagccttggtgaatctagtgccggtggttgagagtttcttctgcaccgggaggtgatggtgttgggggaggggcgtctgtctcattcactgagctgagcttcctctctcctccttccctttccagcacattgctattgagcgccattcactgagtccctctgattcactgggggtcccgtttagtgca

SEQ ID NO: 241394 - DNA, 280 bp, Homo sapiens
ttttttttgtggaatgctcacagcctcttcagtgttttcgatcccaacaaccagcacataaacatctttcaatgtatgattaatgttaagcatatttccttaactgaaaaagaggctaaataatcacattggctaacattttagcaggtaataaccccatgcttgtaagccctttacatgaattaactcacttaaatgcagagcaactctatgaagtaggtacttttttttatagtcatagagaggttaagtaacttgtccaaagtaatacagagtatta

SEQ ID NO: 241395 - DNA, 2543 bp, Homo sapiens
  misc_feature (1454)..(1454): n is a, c, g, or t
  misc_feature (1681)..(1681): n is a, c, g, or t
  misc_feature (1685)..(1685): n is a, c, g, or t
  misc_feature (2429)..(2429): n is a, c, g, or t
agagtttgggggtgtgctgggagacagctgcagggattaggactctaccaggtgctgagtcagaggctggttggaaatcctcctcctccaactccgcccctcgccagctgtttgactgctgccaagtcccccaactgtgggaaccccaggccttcatctgtgaaatggccattcctgtgtttctgacaaggctgttggaagacttcattgaagacactgtattggtttttcagcactttaacatctctggactcaagttgtgtcataaaattgatcacaagccatagtttaattgacggcatttttttttttctcccttagtggtttataaaatgatgctggtctaaggtttgatgatgtcttagacttgaagaacatgaacctgtttttgcaaaagttttagagtttggcattttccaacaaaaaggcagttgctggacttttgaattggtcaacgaaattccacttgttaccagaagatttactagttgcatttctagagttgttggcctctcttttctgatttgattcagtggtcagatcatccagggttcttgtgttcagagacccagagtgctataatgcttccgaaataagcctgacctaagactgagacagaaggtgagtatggcagagaccaccagctgtccaccaaagggccctgcttcccttccaccacctcaagtatctgtcggaggctccatgatagttcccacatggaatgtgggtggcaatgtgtgtcgcttcccggcagcactaattaagaaacaagtgtgccttgctcagtttttctcctgttgactgtcagctggatgtggaaaatccagcagagaatgcctaggtgctaggggaggattctgagtgcctgaatcactctgtggagcagagttgcccattaggaacatgagcctgatgttcttgtgatttagaaatcaaattctaatgtgttgagctgatacacaattttaggcttgtttgttaaagcagacaatgtgaacgtaagtagtacagtgagttgggtagttccaacccgccgctgccccctccctgtcctacacttgcttgggttagatagaaagcagcgccgtctcccattcaccagcctaaatgaacctcatggcttcacttcactcattcttgctcatttattcactgagtcctgtagattctgcccctcccttctgcccttgtttgggggcctcacacctacccaaatggcatccacctaaacactttgggttcggctaggtgcccttaaagcctgattttcaaacgttggagaagtttagaagcaagtcgggctgtaaaattgcagcaatgacctggcatggtgtggcagccatgaagacgctcctgatcttctgcttctgggaatgtgagtgactggtggccccagctgctacgttctgaatcccgcagtggaaatccagcatggcgttcccagacagcctgcnctctgcgggctgctcccagccggggacagcaggtgaagactcctcctccccagcctcctgccttccctgccatctcatctgcatctgctgtcagacttgcgtctccctctgcctccccgcctgtctgcctccccaagaagtctcttccagagctgatcgtgtcttggcttcggtttttggaagagccgagccaacacacatcgtatttgagatacagtgggtcggangcgntacccagggattttctccagcttggacagcgagccctttgccctctctgggtggcagggtgcctccctctaaaatgagggggcgatgcttggcagtttctagaacctgttcagatcaaggcaacctgggagttagagttccgctagtcttgtctggcagtacagtcggtctctaaatatgcttttattgtaccttccccaccatctgggtgaagcatcagtaatgaaaatggagtggaggctgcattgaccttttccagtgtccacgcactatattttaactgggaagttgcatgtattttctatacttaatactttaaaagcttcttgggcctcttgagaggcttgtaagtgcagcccacgtgtgacttgagctgggaacgcaacttcagattgagaagtcccacttttataggacacagcatttaacagcagctgcgtccaagtcgtgtggcatttggcagcgtgtttccaagtggacctgtggtaatcactttgctcttggggaaccgtggccaagggctgccctgcctccaaagaggctcagcaagggaaggctagaagtcctgtgggctggccaggcatggtggctcacacctgtaatccctgcatttttgggtggcagaggtgcgtggatcacctgaggtcaggagttcgagaccagcctgaccaatatgatgaaaccccatctgtactaaaaatacaaaaattagctgggcatggtggtgtgcgtctgtaatcccanctacttgggagactgaggcaggagaatcacttgaacctgggaggcagaggttgcagtgagccgagatcatgctattacactccagcctgggcaacaagagtgaaactctgtctc

SEQ ID NO: 241396 - DNA, 454 bp, Homo sapiens
caagtcattttcaaatcaattctgaaatacacctggtttgggtgagacagcaccacacaagacattcaagccaattcatcgtcttagaggaaacatccaaaatacatttgagcctcctgctctcctgcgagaagccatgcgactcctacgctgttattgccaccagtgtaacagtccgtaccggggctgcttactcttcatttaaggcacggagggccgccacagcaggatttctcaacctcggcactactaacattttgagccgagtattttctcgtggggctgctctgtgcattgtgggatgtttagcagctctagatgcccactagatgactacagcaaccctggtccccttcatgacaatcaaagactccagacatttccaaaagtcccctggggggcaaaatctccactggctaagaacagctgctccagagtacgagaaaagaaaaaa

SEQ ID NO: 241397 - DNA, 819 bp, Homo sapiens
agcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttgggtccacgaggctggtgtcagacctattgggagaccctctgcgttagtgagaaaaacggcaagaaatgggagcacgcggaaacctccaagactagagccaccagatgccaccgacagcacgcagctggaccagcacgggggagggccttcgtgggtcgagagctcgctcgggagatagttggtgcttttctttcaggagaagaatccctggcggagtctgaccgttctctggcgcacagccccgggggtgggcacagcagccgcccctgctgaagggactgacgcctccgacgaccagcagccaagttaaacgcactgttccgtgagcagctttgttggagacagcgcggttcacattctcttccaacggagccgctgactgcggagctgggaggggacgtgacagaacccagccatccaacgtccccccacccctccccagctgggacctccggctgcttccgggctgcgctgggtggcgtcaaggagccgcccctctgggccgcgtctctccctcacgccctgcacactggccctgtgtggccggcggggcgcctaaaagggcggaaggatgcaggggcggagggggctcgggattgcacgcctagctcagaccc

SEQ ID NO: 241398 - DNA, 779 bp, Homo sapiens
agcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttggaggcagaggttgcagtgagctgagattttgcgactacactccaacctgggcaacagagcgggactccattccaaaaaaataagaaaaacagaaaaataataattacatctgcaaagaccttatttccaggctcaagcagagtcttcctcctggtgttccagaaggagttcaaggtcctgctccatatgggacagctagattctgagggcaatgttgagatcctcatctccagaaggtgctggtgccagaaatatgacaaaaggctgattgacgggccaggcgcggtggctcacgcctgtattcccagcactttgggaggccaaggcgggtggatcatgaggtcaagagttcgagaccatcctggccaatatggtgaaaccctgtctctactaaaaatacaaaaaattagctgggcgtggtggcacgcatctgtagtcccaactacttgggaggctgaggcaggagaattgcttgaaccgggaggaggaggttgcagtgagcagagatcgtgccactgctctccagcctgggcggcagactgagtgagattctgtctaaaaaaaaagaggcctggtg

SEQ ID NO: 241399 - DNA, 528 bp, Homo sapiens
agcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttggaggcagaggttgcagtgagctgagattttgcgactacactccaacctgggcaacagagcgggactccattccaaaaaaataagaaaaacagaaaaataataattacatctgcaaagaccttatttccagagacagagttttgctgtgttgccaggctgatcaactcctgagcttatgcaatccactcacctcagcctcccaaagtgccaggattacaggcgtgagccaccttgcccggccaagatgagcaggcaagaagaatctgttggatgattacaacattgctggattgatagcagcctcacctgccaggctcaaactccag

SEQ ID NO: 241400 - DNA, 757 bp, Homo sapiens
agcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttggaggcagaggttgcagtgagctgagattttgcgactacactccaacctgggcaacagagcgggactccattccaaaaaaataagaaaaacagaaaaataataattacatctgcaaagaccttatttccaggctcaagcagagtcttcctcctggtgttccagaaggagttcaaggtcctgctccatatgggacagctagattctgagggcaatgttgagatcctcatctccagaaggtgctggtgccagaaatatgacaaaaggctgattgacgggccaggcgcggtggctcacgcctgtattcccagcactttgggaggccaaggcgggtggatcatgaggtcaagagttcgagaccatcctggccaatatggtgaaaccctgtctctactaaaaatacaaaaaattagctgggcgtggtggcacgcatctgtagtcccaactacttgggaggctgaggcaggagaatcgcttgaacccagagtgtggaagttgcagtgaaccaagatcatgccacttcactccaacctgggcgaaagagcaaaacttcatctc

SEQ ID NO: 241401 - DNA, 364 bp, Homo sapiens
ttttgaagagatgtggtgtcgctgtcacccaggctggagtgcagtggcgaacatggctcactgcagccttgacctcttaggctcgagcaatcctcctgcctcagtcccccaagtaacttggactataggcacccaccaccacacccagctaatgtttatatttttcgtagagacagagttttgctgtgttgccaggctgatcaactcctgagcttatgcaatccactcacctcagcctcccaaagtgccaggattacaggcgtgagccaccttgcccggccaagatgaggtattattacatcattattgtaaggtactgttgggccctctttctattttgttattttgtatgtgatcatcattg

SEQ ID NO: 241402 - DNA, 405 bp, Homo sapiens
cggaagtggcggcgaccccgccggaagcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttggtgagtggcctccaggcggcatctcttgctctcagcccggagggggttttggggacccaggctgtggggctgcctcttcccatgccttcagttcaccccgatatggggtgaaaaaccctagagaccctcgggtgtcggtccaccaagggaggtccagactccccaggaatgttgcctg

SEQ ID NO: 241403 - DNA, 523 bp, Homo sapiens
cgatctttatgaaatttcatctgtggcatcttttccctgaagccttttcgttggtttctcactgccctccagaagctgcccaggctccctgtgaagtaatttcaaaaatcatggaaagtcgtaagtgagcctgtaattgcagcattttgggaggctaaggcgggagcatcatgtgaggccaggtgttgagataagcctgggcaacatagtgagaccccatttctacaaaaaatagaaaaattaggccagcgcggtgcttcactcctgtaatcccagcactatgggaggccaaggcgggcagatcacgaggtcaggagttcgagaccagcctaaccaacgtggtgaaacccccccgctgctaaaaatacaaaaagtagccaggcatggtagcacgcgcctgtaatcccagctactcaggaggctgaggcagaagaatcgcttgaacgctggaggcagaggttgcagtgagccaagatcgcgccattgcaccctagcctaggcaagagagtgagacgccgtctca

SEQ ID NO: 241404 - DNA, 561 bp, Homo sapiens
tgagacggagtctcgctctgtcgccccggctggagtgcagaggcacaatcttggctcactgcaagctctgcctcctgggttcatgccattcttctgcctcagcctcctgagtgagtagctgggactacaggtgcctgccaccatgactggctatttttttttgtatttttagtagagacggggtttcaccgtgttagccagggtggtctctatctcctgacctcgtgatccgcccacctcggcctcccaaagtgcgggattacaggtgtgagccactgcacccggcccacattttcttagacaagaaccaattcactggctaaagctctcagtttccaacttttgcaacatcgtcacatttcttcttgcctgtggattttaaaagttcatctctcacttatttacttacccattcatcaaaatataattgtcatccattagcatgcttagtgtctggccattttagggggatacagtggttaaaagtaaacctagtctctggctccatgaaaattttggttagtgatgaagacaggccttttacaaataagataagctgtc

SEQ ID NO: 241405 - DNA, 671 bp, Homo sapiens
ggtatcaaagccctcatttccactaccctgaaaggcagggaaacccctcgtcaacctcaagatgagactggaattttattttctgaagagataaagacagagtttctgaattgaaggacatgagtcaaaatagatcacaaggctgccacacagaaaacaggaaataaaggcaattttatgagctgcatattgagactgccccagccctcttcacctgcagaggacaggtagacagatctgtagctttcaggtacagattcaaggattctgctctgggaaatctgatcagcccaagagaagacacctgatatggtttggctgtgtccacccacaaatctcatcttgaattgtagctcccataattcctgagtgttgtgggagggacccagtgggatagagttgaatcatgggggcagttcccctatactgttctcatggtagtgactaagtctcatgagatctgatgattttataaggggaaaccccttccgctcatctctcattctctcttgtctgccgccatgtaagacatgcctttcaccttccgccatgatcgtgaggcctccccagctacatggaactgtgagttcattaaacttcttttcttttataaattacccagtctcgggtatgtctttatcagcagcatgaaaatgggctaatacaacacc

SEQ ID NO: 241406 - DNA, 633 bp, Homo sapiens
tctgagacggagtttcactcctgttgcccaggctggagtgcccaggcacaatctcggctcactgcaacctctgcctcccgggtgcaggagaattgcttgaacccaggagcagatgttgcagtgagccaagattgcactactgcactccagcttgggcgacagagtgagactctatctcagaaaaacaaaaaacaaacaaaaactgtttaggtggctggtcatggtggctcatgcctgtaatcccagctctttgggaggctaaggcaggaggatcacttgagctcaggagtttgagaccagcctgggcaacataatgggaccttgtctctacaaaatttttaaaaattagctgcccgtggtggcatgcacctgtaatcccagctacttgggagacttaggtgagtggattgattgagcccaggaggtggaggctgcagtgagccatgatcacaccactgcactccagcctaggcaacagagtgagaccctatctcaaaaaaaaaaaaaaaaactgtttaggtgattgaggtgattgttgtgcccgctgaagtatgagaaagattttcttgggggggaaaagtttctagaggaaaaggatttattgctgcctccctgcttgcttcctccttgaga

SEQ ID NO: 241407 - DNA, 520 bp, Homo sapiens
gcagcattagttctagtgaaactgtattattgattaagcaaatgccatttaagcttaattaaaaaataaaaaagacccggttactggtagccgttttgagctgctgagaaggacctttcacttatgtcttctagagtaaccgccatttggatacacagcccagaaaaagagggcctgctcaagttttcgcgggtagtgtgagagttactaggaatccaacaacctggcttcctagttcactgttccttccaccaatcaatctgcatctccagcagagaatggataaaatagcaaacagttctggggttttgtatcaatctctgactgcaaccattgggaaagactggcttagctgaagttctaaccttcctacctttcaatgcccagaaagaaaaagccaagtgagtctgtgccaacctctcctacaagagcctctgtttgcaccttgctttatttgctacctgctaacttccctcaaaagacgggaattaactttggagaaaataaggtgtttgcgatt

SEQ ID NO: 241408 - DNA, 420 bp, Homo sapiens
gcggatattgctcgccacagtatcttatcaattaattgcattcttggatgtgctgggagtcagcttgcacaagttaaatccttgaggaaggggctgccagtgaaagagccgagatggagtctgtctggctcttagctaagggagagtcaattcaggtggaaccaaggctaggtgattaaaggaaagagggagagtctaaaaacagggttagtgaaaacaagcttggggattacagtactaagcactgggccacacgctgcctccactttgctctgccgcatgtcttcatacttttcttgccccagttaaattttttttttaagacagtcttgctctgtcacccaggctggagtgcagtggcacaatctcagctgactgcaacctccgcctcctgggttcaagcgattctcatgccttagc

SEQ ID NO: 241409 - DNA, 648 bp, Homo sapiens
caggtggatcacttgaggtcaggagttcaagaccaacctggtcaacattgtgaagccccgtctctactagaactacaaaattatccaggcctggtggtggcacatgcctgtaatcccagatacttgggaggctaaggcaggaaaatggtttgaacctgggaggtggaggttgcagtgagccaaggttgcaccattgcactccagcctgggcaagagagcaaaactccatctcaaaaaaaaaaaaaaattattaaacatggaacatatgtgtaagagagagagagagagagtgtgtgtgtgtgtgtatgtgtgtgtgtgtgtgtgtgtgtcttcctatttgatgtggagggaaggcaaacttagactaaaagtgtagagcttggggaatgatggtgcagagccaggaaggccaggctaacaaaggacatatccaaaagcaatttaataaaaagatattgtacaccagccatgtgcctactttatgctatgtcccgtgaagaagacagaagtaaatatgatagttatgagttaaatggataagcagaagaaaaaaaaaaaacacataatacagagcgtggccattatatccaaggcttttaccactttaggcgggcaccaaccgggatacaaatcatttcctagccaaac

SEQ ID NO: 241410 - DNA, 451 bp, Homo sapiens
ccccttcccccgccccagtgctgggcttccttcctgcaaatggttcagagctattggtccagattcaaagctgcccgttccacagacactgggtgtctccatggaaatgtttagcttggacgcatcctcccagaggctggggatgtctgcggagacagaagccccgctgggtgtgatgaagcggggtgccagcgccctgccattttctaatctgagctgggaaacaacgctgtgaagttaagtggcagagaacagggtgagctttgtttggccccagcccgtggggcattgtgtctggagcgacttctgactgggtggctacttacaggcctgtacttctctgcgttctccatgaggaagcaagcccggggccttcaggaaccacgacgcctaatgagcttccacccagatggtcccgaaacccgagggacgcaggggaggcgcccaggtc

SEQ ID NO: 241411 - DNA, 477 bp, Homo sapiens
aagatcattaacaaaggcaggttgacaaaaccaggggtgcataacaaaagatggtctcagatgtcactggatcaaacagtgtcacttcctgaatagatatgtcaattaaacagtaataaattaggtatttattctatgttcatcactgtgttgagcatgacgagaaacagataattaaaatacatcatcactggtcttaaaatctaaccaagaaatctgaaggtaaaagacaaaactattgaaaataataatagctacaataatttaagggatacatagtacaaaaagatgtaaattgtgacaccaaacacataaaatgttattgggggtggactataaaagtgcagactttttgtttttttgtttgtgactgagttttgccctgttgcctaggctggagtgcaatggcatgatctcggctcactgcaacctctgcctcctgggttcaagtgattctcctgtctcagcctcccaagt

SEQ ID NO: 241412 - DNA, 423 bp, Homo sapiens
aagatcattaacaaaggcaggttgacaaaaccaggggtgcataacaaaagatggtctcagatgtcactggatcaaacagtgtcacttcctgaatagatatgtcaattaaacagtaataaattaggtatttattctatgttcatcactgtgttgagcatgacgagaaacagataattaaaatacatcatcactggtcttaaaatctaaccaagaaatctgaaggtaaaagacaaaactattgaaaataataatagctacaataatttaagggatacatagtacaaaaagatgtaaattgtgacaccaaacacataaaatgttattgggggtggactataagctggagtgcaatggcatgatctcggctcactgcaacctctgcctcctgggttcaagtgattctcctgtctcagcctcccaagt

SEQ ID NO: 241413 - DNA, 457 bp, Homo sapiens
gaccagtatgtggtcctttttcatccatcccaaccataatttcctctttcctgtagaattaaaagaaaattgcaaagaggatatgaacttttctggtaagaaaacctcctgggtatagtgctcccagttatgagatttatgcagattgttatataaagtttttttaaatcaagcaccttaggacaaactattaaaaagactgctaaaagcgttgtgacacaacaaaagtctctaaattctgtagcttaaaaagttttaacaaagtacttatcttttgcaagctaattgctacaagtctataactaaaacatgtattgactgatgtcttaggtctccctaaaatatataaaaccaagttgtaaaccaatcaccttggacacatgttctcaggacctctggagactgtgccttgggccatggtcactcatatttggctgagaataaaattttaaaaata

SEQ ID NO: 241414 - DNA, 372 bp, Homo sapiens
tgtccatttctgtttcccaagaaaattataaaagtatgcagaaggctctagagagggaaatgaagtatctagaagagaagggaagaaaaaagttaaatcaagaggagggtgcttaagatgaagctaaaagatgagtaccagggaagataaatagtatctgaaggcgggggaattgtgagataactggtagctacaaattgaattcctgattgcttggtgaattgggaatgtgacaggaggtaaggctgcccttctgtaagggcagatcaagagttgtcatgctagggagactattctgcctaaaattctggggtactattttgtgtttaagtatgctatgtatattaaaagggtacatatttgaagtgttcg

SEQ ID NO: 241415 - DNA, 426 bp, Homo sapiens
ttaaaacccttgttgctcaagggtctgctatatttttatattcaatgacattaattatggaaaacaaaccttataaaaatatttctcattaaaattcactttgtaaaactcctaaacccagaaagaaagcaatttttgtcttactctttcttttgtcaaaactgaattttgaaacactttcccaaccccgttaacagtgccatcctttccaactggtatttctttgtttgttttatctaaaacactaaagaaattattggggatgggtggggactttcctgcgtctttatcatgcctatgaaaattttacaaacttggtatccctcttaatctcaatcctctagtaccccttaaagtgtaactttgaaagagtaattttagagatactgagcttgaaaaggcttttgaaatatttcatttctgagc

SEQ ID NO: 241416 - DNA, 407 bp, Homo sapiens
aaactcctgacctcaggtgatctccctgcctcagcctcccaaagtgctggattacaggtgtgagccactgcgcccagcaaatgtttataattatatcagaagaagatttgttattgtattggggctggagaaaacatttctatgcaaaattagagcttgtgagcttttagggaaataattacagattactctctataaaaaatttaaatttctataggttgaaagacacttaaagacagttaaaaggcaggtggcaggctgaaagaaactatctgcctggtgtataacaatatacagaatatataaagagaactcacaaatcaataagaaaaattgcaatgacctaagaggaaaaagtgagcaaaaactatgaacagatatttcatagaaatggaagtctaaataat

SEQ ID NO: 241417 - DNA, 464 bp, Homo sapiens
  misc_feature (295)..(295): n is a, c, g, or t
gaattcggcacgagtagaagcagagttaggaaagttgcttaataattggtctgctcaaacgtgtgagctgtttgcactcagccaaaccttaaagtacttacagcatcagaaaggagccatctataccaattctaagttaatatggactgaacgaggtcttattaatagcaaagaataattgaaatcccaaacttacaaggtttttgacaaaagtaaagcttgctaaaagttaacagtgtaacatgtattatcctaacttctaatcttgaggaaatcactcgtgccgaattcggcnggggtttttgttatattaaattttcaccactggttcttttgccaaagttttcccagggatctcttaattagatgaagcttatctgctagtaggttcctcaggaatgtcttatgtgtacagtagtctctaaatttttgcattaaaattttttcctgtaatcttcatactt

SEQ ID NO: 241418 - DNA, 293 bp, Homo sapiens
agccgagtcgcaccagcgccccctccacgcgccgcgcccagcaagcgagtggtggtaactcgatggcggtcccggaggcgcggacactttcctcagccctttcgttctctgtggcgtttcgaatggctatttaacgagagaaggtgcgggccgcgctctgcctttcaccccgagcagcgggtctgaaaaccagaggtctgtggagccgactttgcatttttccttcaactcttgcgactttcttggtctgcctgtgtggttttaataaaatacagcatccgttgtgaccgctt

SEQ ID NO: 241419 - DNA, 377 bp, Homo sapiens
taaaatttccttccatgttatagagctgatttttatcctgaccacggatgcttacactgttcacataaaacttaacattcattgttaccagtaaggtgtgtgatcaacatcttgagctgtggtttactgcgtttgaataagcaacaatagctgataactgatgttagtagtttatgaatttcttttaatccttagggttaaggaagtagctttagtgactgattgtacctttcctaaatcctagttttatgcctaggagatcatattttaataacaaaataatatagttcaataagtcctatccatgttgcactaaaagatgtaagaatttaagctaaaagttatcactgtcagtttggattattgggacttaaatt

SEQ ID NO: 241420 - DNA, 1917 bp, Homo sapiens
ctgagagtcagggcggacctggactcggcgcgcctagctcctcggctccctttgcggggactccaggagtctgcccgctcgcgccgtttcgtcctgtcaccccggcaacgggaccctctaagaggcttgttccaaaaatgttcacaatggggtttttaaaaacggttttgttagggacaagtgcttgtgtgagtcctccgacaatgcctgctttcttctctctgcccgcggagcggaggctccaggcctggccccagtccgaggcgcctctgtcggtgtcgtcctgcttccaaaaccggcctccagaacccgcctccttccagaacctccgtccagaacccgcctccctccagaacctccgtacagaacccacatccttctagcacctgcctctggaacccacgtgctttcagaactacctgtttgtagaacttgtttccagaacgaacctgctttccgaatctctttacttccagagcttgtttcctggactgacctattttcagaacctactttcaaaaccagcttgcctccaggaccacctgcttggagaactggcctgcagccccaggactggacgacctgagactgcacagctccctgcggggctcacccggctgtgtgtgtccttccgggccttccatacttccctaggtgtctggtgactccggagcccgctcggatttcgtgtgggtctcgcctcagctcagaacacaccctttgaagagcaggaaggccagggcacaggcggtaaccacggctcctggtcatcaagttcctctgaagcccaggtcttgtccacgttcactgccccaccacaggcccagcggagccttggagctgagccctgggatcattctggtgcctgtgctcccggctccgcaacaagcacacaggagcctgtcatccccagatctaaatcctgaaggctaagctccgtggtctgccgcagccatctgcagcaggcccctcccagcaacagccttctcataaggcccctgccagccacgtgaaacctcctggctagggcctgtcttccactcctggccttttgagacagggcctcactctgttccccaggccggagtgcagtggtacgatcacagctcactgcagcctccacctcctgggctcatgtgatcctcccacctcagcctcctgaatagctgggactacaggcttgcaccaccacacccggctaatttttgtatattttgtagagacagggtttcgccacattgcccaggcccaggctggtctcaaacttctgggctcaagcaattcatctgcctcaacctcccaaaagtgctggattacagggatgagccaccatacccggcttttttttttctttctcctggccttttggggcccttgaagtgtctgctccctgggagcccttcagcttgtcgtccacttggtgggttcccacccgtccttctcacttctgcctgaatcacacaggctacatgagaccttcacccacccccttcgccagcagctctgtggttcaagtttcctcaagggcaggggctcctggccatcttacctgtgggcctgagcatgggccgatgcttccaaagttcacactgggtgcacttgtgtggggacttccatgtgagtcatctccttgcaggctgccaaggtcctgtacagcagagacccaaaccctcttagcagtcttcagagtcagctatgtgtacaggaggcattaccatatcagtgactgtcagcaagcatgtgtgactgaaatggtatccagttcttacgtatttgttttgcaggcttcttggttcagcagacagaggccattgggaagttaagagaggctctcaaactttgagggtcataagacttcccctccctgcagggtgctgtttcctgaaggaaaatattcaattactattttctttattt

SEQ ID NO: 241421 - DNA, 352 bp, Homo sapiens
gcaaagaatcattaatttttcagaagcttgtcaaaatagccctgggtttacatgaacacgtcagactcatttacaagaatgctagattgtgcatatgtggcatgttaataagtaacctttggtagaactattatgatggattcaatacaatccatctatggtgcaaatcaatgataaagaactctcatgcgtctaccatgtatgactgtagaattgctggtgtaagcagaactatagcagagcaaatttcaacatgcccttggccacctgggttgtaggggacactttactttttgcattgtgctgtgaccatttcatgcataatcttggatcttcatactatttgacaacc

SEQ ID NO: 241422 - DNA, 531 bp, Homo sapiens
agaactgcatttttggtattatactgcatccatatgtgttacatattgtgcatagaatttcgtttggtggggagaagagctcactcgccgctaaactcttgaagcttctggtgcacttgagttctaaggtcctctgcactccagctctctgagagcagtgaaatgagctcctttctgtttccatccccgagcatacgggcatctagctggcactggggcctgtcaccagcctagaaagcactccgtggcttggcagggtttggggattgggctggcacatagcacctcttggaaagggcttggcaggtttctcccttgcagcataatctccatgacacaatgaggcaaattttgggtttagtgtttcactggctgccggttgataagctactatttataaagtagaacgagcagggtttctgcccaccttcttttttgctgagactatttaaaattaactattttataaattaaaaataaaacttttaaataaacttattttaattaaaaatttgtaaaataaaaatatca

SEQ ID NO: 241423 - DNA, 925 bp, Homo sapiens
gcatgcaaagaataacttgcacaatggatagaatatatattgattaaggtttagggtcaagaggtatttctctaatctggtagaaaagttttctcctcaggatgtaatctttggggcatgagggaagaccagtttggttcaaatgatttaagaccctgatgtggtagcacaactttcttaaatatggttaacatctcagcacacagatatacaccatcttgtgttgttaactgaagggtacatggccaccctctaagaagcaggtcaaaagggatggctcatcctctccttccttaaaaaataggagaagaaagtcagtactttttaataatcaggtattgatatgataggatcactctctggtgtctttctccaatctgctgcttctcattatatgaatatatttggtaaattttaatttgcattgatagcatgttgggcattgtttttggaagctaaggttttccttgttcttcaagaaaacctctgatttgtggaatattgatataaaaataacttattctgtgtctacctcggtgaaagtactggaattataggactactcacttttcatatactttagatttgggaagaccatgatgaaataagatgaattacatatacttagccatgtatttcctccatttcttctgaatattacttacacatttaagttaaatattagaattatacattattctcttgaattgggaaggtttattttttaatgcatttcttcttatagccaaaggcaaatatttataagactgtatgttcacataaggtgattatatcaggttttgtcactagctttaaatcctcaatagagtatataaagaatactttccaaataatgttctaagtattatcattaataaatatggttcttgggtaattaaaaaaatattttacatccaaaaaaaaa

SEQ ID NO: 241424 - DNA, 557 bp, Homo sapiens
ttttgagatggagtttcactcttgttgcccaggctgtagtgcaatggtatgatctcggctcaccacaacctccgcctcccaggttcaagcaattctcctgtctcagcctcccaagtagctgggattacaggcatgcgccaccacgcccagctaattttgtatttttagtagagatggggtttctccatgttggtcaggctgatctcaaactcccgacctcaggtgatccgcctgccttggcctcccaaagtgctgggattacaggcatgagccaccctgcccagcctccagtgcattcttagcttcagatatgtttttaaatcttggaatgtctatttgattatttgtatagatttccaattctgttgaaatgctccatgtattcatccattttgtcctttatctttccttttttaaaaacttattaaccataattattttcaagttggctccttgccagtcaagctgctttgaacaccctagatatgccaagtggtttctctcactggttcttgacatttcagccatctgtatttttgaaagtttacatttctctt

SEQ ID NO: 241425 - DNA, 338 bp, Homo sapiens
gcattctgggttgtgatgttatcatccacattctcttacctggtactcatggctctgggcatgttttgtatgttgtttggttggaggggcttggtagccccaacataaagaaaaaggcctagtttctccctttgtctcaggagcacattactctatcctgggaagttctggctgttaagaaagctctttgggttgggcgtggtggttcacacctgtagtcccagctactcgggaggctgaggcacaagaatcacttgaatctggaaggcagaagttgctgtgagctgagatcctgccactgcactccagcctgggcaatagagaaagacttagtatta

SEQ ID NO: 241426 - DNA, 414 bp, Homo sapiens
agatacagcatttaacatactctgtttggaaacattaatatgttatatttattgtcagtatgatgatttatatgttatatttattgtcactatgatgcagaaagttgtctgaattatatgcctccataggtcctctgagttctttctaatgtcagatatgaaggtgtttctttaagaattagattggaaggtcgttaagcattctaacatgaacccttagtaaaactgtatcctgtaaaatattcagtaattttgcaaaagtgtgtgttttctcttttaaccttgtgttaaagactagaaaatgtggcaaaaatattaagttttgaatctgggaagtagatatatggggattaacgatactattctttctactttcttatatatttaaaattattataataaaaaataaaaata

SEQ ID NO: 241427 - DNA, 492 bp, Homo sapiens
gtcagatgtatcatctcttatcatctccgggatatcgatcctcagatttcatacatgtgtctcttagcttgatgaccggtgctctaaacaccctcagtattgatagacacacccatacctttgcatacccatttctctgtctggtgagccaacctgtatggaccacatcagagatgccttgttcgcttttgctaatgcaaagccccagcagaagacagacaggaggaaggagagtgaattataccattccccttttcctccctgtgctcatcttggcctggctgtgtccctggcctgcaaccactgctcctctcaagaaggccacctctagccaactctctcctgtgctttggtaactggtcttcttcttgtctcttcaagtctaagggtggtaatagctctcttgttgtttggagtaactgtgttattccttgcagttcccctacatactgctctcccctttttaaaataaagcctccttttattattcta

SEQ ID NO: 241428 - DNA, 460 bp, Homo sapiens
gtgtatgtataggtgtctgtatgtgtgtgtttgtggcatctttgactatgaaaaatgaggaaagtaattattcatttataactggtagacacggtcctttaaaatggtgattttgagactttttggtgttaaggttttaaaaacatggttgcatagaggctaccaacatcataagttggttgtttttcatttcaatgcccttttgaaatctttaactatattgtgatgctcagaaataatatgcagaattttttatttgtgtcctaaaatggtatgtgagtggttatacactttacatacctttctgccactttctttggtgtattttgtattatattttccagatgtacccacattgatatgattatctctggtttaattcattttacacttttcattgtattctcttataccactttaccacatttagttagactctcctgttgctgataaatgaaga

SEQ ID NO: 241429 - DNA, 407 bp, Homo sapiens
gctggatttttcaaacacaatttcaaaaactaagtgaatgactctgacatggtaaattaaagcttgagcctaatgactgcaagctaaggttaattttgagccagcagacggaggttattaaaggcccagttagttccttctggaaagcctttcctgcagatgtcccagcctgcttaccgcagccatggaagaagcctctatagtgagagaagctacagagccctggaaagctggggccccacaggcagatgcagttaaggttaagatagaagaggtttgggggtgtcttacggaaccctaaacctaaccctaaactgaaccctagccctaaattgttaaacagtaaattgttactgttttgaggcagattcgagaggttttaaaataaaccagttagacgtacatta

SEQ ID NO: 241430 - DNA, 171 bp, Homo sapiens
ccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaa

SEQ ID NO: 241431 - DNA, 393 bp, Homo sapiens
tgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtt

SEQ ID NO: 241432 - DNA, 904 bp, Homo sapiens
ggcactgggcatgggctggacgggaccccggccaccatctccttcgagcctactcgtggccggtgaagaaagccaggcatgagaggagcaggaagcgagtcgctcaagggcgcaccgagtcatatcccaagatctttgaaggaggtccagggatccgcggagccaccgtgagaatacagctcggcagagaggccgaggtccctgcggggaggccggtcccttcctcctcggccccgcggtccgggcgccccgtgggcctagctcccgcccaccggccgggagtcctcggggctcgggctccgacggaggagtccccagggccgggggcggagggcagacgacttccaggaggtcacctggatttcctgcgcgacgtggaaggagaaatgaattcagctgcggccgaacgtggcgcaaagagaaggctgagcgcggcgcccccgggaaggaggccgcccgctcgcgccggcctccgccaagcatttgcaatttaattgacattggcggcaggaagccaatcagtctaagtcaattgacgttccgagataaaactaatcggcggccggcgctgcccccgccggcgcggccgcggcggggcccggggcgcagcgtggaggcggcggcgcgccctgcaggtcccagcgctggcgcgtggctcggcccgctgattgccgcgcggcccgcggcggccaggagaggcccgtaatgaatgactttatttgccggggccccgctgagaacaattgagtttgttatgctaacaacggatgccagctttccggggccccggggggcgcgggcgcggcggcagccgggagctgggcagcggagcagatgatgcgcgccggggcgagggcgccggacgggggtgccgggcgggggtcggacggagctggcgtcggga

SEQ ID NO: 241433 - DNA, 431 bp, Homo sapiens
tctttggtcgtccagatcctgcccacatctaaacagaagccctggggaagaagtgaaactcctccaaaggcggctcaggttcgtcaaacctaagggatcacgggcatctatggctcactccagccaacaagtgctctggggagctcagatggacaagggggaaaatgactgccaccaacctgttagtacctgcctagcaagtcgggaaagggctcttaagatccagtggtgaagcccaataatcccaaccagcaactaggctgcttggaccactggggcagacagcaatctcttaaggtaagaccctgaggtccacaaaagtagaaatctcattttccactttatctcccgtgtctagcatcacaactagcacatagcaggtgctcaataaatacttgtcaaataaaatgaacaaacactacaagcgtggc

SEQ ID NO: 241434 - DNA, 422 bp, Homo sapiens
tctcctcaggcccctgccaataaggcaaagcccagagcgaacacatctcaccaggaggaaaagcagaatgtgatggactgagggcagtgggagtgaaggttctcaggaagactgaaatctctccaccccagcccttggtctataaatgatgaaatgctgttgactcaaaagggggccaaggcaaatactatagggataattcaggatgtgaagcttctgggccacctccacaagagggccagcatcaccccctgctcagtcctgctttatatctgtgtgctgatttgcacgggtgacagtaaagcaatggactgctatgggtggctcttggtaagttttcctttacaaaacttcagcagtgctttgtgatagtggacactaaagtacatggactgatgtattaaaacaaaaccaaaacaaac

SEQ ID NO: 241435 - DNA, 430 bp, Homo sapiens
gaaaggaactgaaaacgagacagacgttggcctctcccctcctggtgtccctagtcaagagtcgagtctacttcctcctggtctgtgaacatagctgagtgtccagtatttggagccctcatgaagcttccagaagccccctcctctctaatgggtgggtggagactccaggctcacaaatcctcccatagaccctggtggggtctgtggagggccatgagggagtgctggcatccaagtttcccagggcctgatggaatgtggacggaccagcctgctactcccggcccgctgcctcttcccctcccatggcctctaatcctgagtcgcatcgcacattcctccttattccagccccttttccccacagcccccaccttctcccacacttctgacctctgcaaaaaaacgctgatttagccacttgata

SEQ ID NO: 241436 - DNA, 386 bp, Homo sapiens
cgattagcatagcttttgagaagtcttaattcaggtcaaagatctttcctgtttctcaaggaaagggaagaggttaggcaagaatcctattaacagttcatccaggccgggcgcggtggctcacgcctgtaatcccagcactttgggaggccgaggtgggtggatcacgaggtcaggagatcaagaccatcctgattaacacggtgaaaccccgtctccactaaaaacacaaacaattagctgggtatggtggtgggtgcctgtagtcccagctaatcaggaggctgaggcgggagaatggcgtgaacccaggaggcagagcttgcagtgagctgagattgggccactgcactccagcctgggcgacagagcaagactctgtctca

SEQ ID NO: 241437 - DNA, 407 bp, Homo sapiens
gtgtgatgttgattcaatgacattttttgagacttgtgttatggccacgtacaaagtgaattcttacacatgttttattcttagatattttggaaaatattatgctatattgttgagagtaaagttctatatatgtccatcaaatcaaaccattgttcaaatcttctataccttaaagactttattatttgatctttcagttaccaaaaaattgtattaaaatctctcaatctgattataaatttgtcattttaaaaaatttgttgtttcttcttatatcttcagtttctggtgaagtttttttttgacatgttgagactatgttattaaatgtttagaagttttaaattgttttatcttcccagtaaactgtaccatttaccattaaaattaccattagcattaaa

SEQ ID NO: 241438 - DNA, 810 bp, Homo sapiens
gacggagtctcgttctgtcacccaggttggagtgcagtggcatgatatcggctcactgcagcctccacctcccaggttcaagcgattctcctgtctcagcctcccgagtagctgggattacaggattacaggcgtgtgccaccacgcccagctaatttttgtatttttagtagagacggggtttcacttgaactcaggaagcagaggttgcggtgagctgagattgcaccactgcactccagcctgggtgacagagccagactctgtctcaaaaaaaagaaaaaagaaaatatgcaaacaatctcaacattcaccaacaggaaaacagtcaaaaaatgtccagaatgtccacgaaaccctgctgcatagtcatggggcagaccaagctgctgacaaactacagagccaaagggaacggcctcattttaaatagtgttgttataacagggggcttactttcttatttgtgtgtttttattttatcaactttcaaaacttatttttaaagaaatcacttatgcgtgtgggtagtcatatcaccgcatttctcttcaagcgtcattaggccctgtactctcctcgttcctccacgtcctcctccttgctcaggttcccctcgccccaccccacccattgtcagcagtaattgttagtggaggtagatgatagaaaatgagccacaccttgtcatccgagttctcatgtcatagttgtctgactaaatagatcttctgataacaagccagtgcgaaagcttgtattccgactactttgactgtcttggatggcatctcttttgatgagtgacac

SEQ ID NO: 241439 - DNA, 756 bp, Homo sapiens
gacggagtctcgttctgtcacccaggttggagtgcagtggcatgatatcggctcactgcagcctccacctcccaggttcaagcgattctcctgtctcagcctcccgagtagctgggattacaggattacaggcgtgtgccaccacgcccagctaatttttgtatttttagtagagacggggtttcacttgaactcaggaagcagaggttgcggtgagctgagattgcaccactgcactccagcctgggtgacagagccagactctgtctcaaaaaaaagaaaaaagaaaatatgcaaacaatctcaacattcaccaacaggaaaacagtcaaaaaatgtccagaatgtccacgaaaccctgctgcatagtcataaatagtgttgttataacagggggcttactttcttatttgtgtgtttttattttatcaactttcaaaacttatttttaaagaaatcacttatgcgtgtgggtagtcatatcaccgcatttctcttcaagcgtcattaggccctgtactctcctcgttcctccacgtcctcctccttgctcaggttcccctcgccccaccccacccattgtcagcagtaattgttagtggaggtagatgatagaaaatgagccacaccttgtcatccgagttctcatgtcatagttgtctgactaaatagatcttctgataacaagccagtgcgaaagcttgtattccgactactttgactgtcttggatggcatctcttttgatgagtgacac

SEQ ID NO: 241440 - DNA, 351 bp, Homo sapiens
ttgtctcaaagagcctgccaaattataggagtcactacattcagggatgtccagatacaactttctatttgatttacagttctccaagtccagatgcaatttactattcaggtgtcacttttattatgattatctaaggtcagtggttctcagtcaggatattttaccaacaggggaaatctggcaatgtttagaaacagttttgactgttacagctagagattgtacctggcctctaggaagtcaaagccagggatgttgttaaatatcctacacaggatagtcccctatagcaaagaattacccagtccaaatcgtcaataattccaaggtttaaaaactctgctatag

SEQ ID NO: 241441 - DNA, 337 bp, Homo sapiens
ctttaactaaatgtggcacatcaacttaatgaattattaaaaagcaactgaaggccaggcacagtggctcatgcctgtcatcccagcactttgggaggccaaggcggatggatcacaaggtcaggagctcaagacgagcctggccaagatggtgaaaccccgtctatactaaaaatacaaaagttagccgggcatggtggtgggcacctataatcccagctactcgggaggctgaggcaggagaactgcttgaacccaggaggcagaggttgcagtgagccgagatgatgccaatgcactctagcctgggtgacagagcaagactccgtctcaaaaa

SEQ ID NO: 241442 - DNA, 453 bp, Homo sapiens
tttcctatattgaattattgtttaatcttctaatattccaatggaaaaaaaatgactaaatctttgttattttcacacaactttcctcccaatgcatttattttaaaatctcatttatttatatattttcaactaggtattggttagaaagaagcatttaaaaaatgcagtagttactagggccatttactggcagcaactgtgatgggcttacttaaatgcgtgacactgaggatctcactgactgagcagtgttatgggatcacaaccctcttcaagactttgcttttatgcccttttgatagcaacaaaacgcatttcactgatatatgtatgcatttcacattatcttttctcttgtataatcagttactttaaatggattttatgctcctatgttgattctcatctgatatatctttgggttgaattaaacccagatgtttataagat

SEQ ID NO: 241443 - DNA, 383 bp, Homo sapiens
gccagctgtggtggctcacacctgtaatcccagcactttgaaaggctgaggaggatggatcaccggaggtcaggggttcaagaccagcctggccaacatggggaagccccgtctctactaaaaatacaaaattagccaggcttgatggtgggcacctgtaatcccagctgcttgggaggctgaggcaggagaattgcttgaacccaggaggcagaggttgcagcgagctgagatcacatcactgcactccagcctgggcaacaagagcgaaactctgtcgggaaggggagaggaggggaggggaggggagaaggaaggaaggatcgaaagaaagacaaagaaggaagggagagagagagggggaaagaaagaaagaaaagaga

SEQ ID NO: 241444 - DNA, 517 bp, Homo sapiens
tcaaagctctccaaatttccacttgcagtttctgcaaaaagagtgtttcaaaactgctcaatgaaatgttatgttcaactctgtgagttgaatacaaatatcacaaagaagtttctgagaatccttctgtctagtttctatgggaagatatttccttttccaccttgggcctcaaagcgctccaaatgtccacttgcagattctacaaaaagagtgtttcaaacctgctctctcaaaagaaagtttcaactctgtgagttgaaggcacacatcacaaagaagtttgtgagaatgcttctgtctagtgtttatgtgaatatatttccgtttcaaacgaaggcctcaaagcagtaaaaatatccacttgaaaattctccaaaagactgtttcaaaactgctctatcaaaagaaaggttcaactctgtgagttgaatgtacacatcgcaaagaagttaatgagaatgctgctgtctaatttttatgtaaatatattcccgtttccaacgaaggcctcaaa

SEQ ID NO: 241445 - DNA, 510 bp, Homo sapiens
agataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatg

SEQ ID NO: 241446 - DNA, 507 bp, Homo sapiens
tggtgggcaccatctaatcagctgccagcgaatatacagcaggaagaaaaaggtgaaaaggcaagactggcctagcctcccagcctacatctttctcccatgctggatgcttcctgcccttgaacatcagactccaagttcttcagttttgagacttggactggctctccttgctcctcaagcttgcagacagcctattgtgggaccttgtgatcatgtaagttaatacttaataaactcccttatatatatatatatatcctattagttctgtccatctagagaaccctaacacaagtgttttcttcattttccttcatatttatgaagtgtgctttcttgccatcctttccagactcatcaccttatgttattagttgactttttaaaaatcattattattatttgagatggagtctcgctctgtcacccagactggagtgagccaagatcgtgccattgcagtccagcctgggtgatgagcaaaactccatttcaacaacaaca

SEQ ID NO: 241447 - DNA, 298 bp, Homo sapiens
tgccaagaacagtagaggatgaactcatgtggatgggtatgcaggagtatttcccacagtcctttgatttgagaccaccggctgctgtcatatttggagtaattgtggtgtaaggcacactggactgagagtcaggagacctgggtgtgactcatggttttgctgctaatgatctgtgtgaccttgggggaagtcacttaacttctccagacctcagtttcttcatctacaaaataagggaattactaacactctttcagttctggaattctaattctaaagtaaatcttctgcagag

SEQ ID NO: 241448 - DNA, 324 bp, Homo sapiens
aatggttaacaattaatgtattcttgtagaattttctatgtacatatttaaagataatgtttcctaatgttttattttgaaatttccgaaacacgtagaaattttgaaagagaccaccctggccaacatggtgaaaccccatctctactaaaaatacaaaaagaatagccaggcagggtggcgcacacctgtactcccagctacctctcgggaggctgaggtaggagaatcacttgaacccgggaggcagaggttgcagtgagccaagatcgcaccactgcactccagcctgggtgacagagtgagactccgtctcaaaaaaaa

SEQ ID NO: 241449 - DNA, 208 bp, Homo sapiens
catccctagagatttatggagtactatctgcatctctacattgtcacagatacagatataaaattaggctcctagacttgaagaaattgcaaccaaagctagaaacaagatatgataatatgaaacttaatcatgaagtacgtaaaaacagttaacatcaatgttatacatatgactcattgcttaattaaaattgttgtagttctct

SEQ ID NO: 241450 - DNA, 488 bp, Homo sapiens
aagaccaaatgaccacgaagaaagttaaaagctttaaaagcctaagcagggggaacttcatcatctctgttacttttaacagaaggtaaaatgagaacagagaagtttccattgcattggcaataaagaagtatttactgatcattggggtaacatcagtagagaagtgaggaggaaagcaaagttgtagtaatttaaagagtaaatgggagatatactagtagtatatagaaaacattttcaaaaaggccttcttatagagagataaacatgtggagtgatagaggaggatgtaagcttaagaaaaactgcattggtgatccaaaaatagagggaataaagttcttaagaaaattagaagtccgggcgcggtggctcacgcctgtaatcccagcactttgtgaggccgaggcgcgcagatcacgtggtcaggagatcaagaccatcctggttaacacggtgaaaccccgtctctactaaaactacac

SEQ ID NO: 241451 - DNA, 424 bp, Homo sapiens
gtaatgtggcaaacaaattatgttttgcacagaaagtcatgatttttacttttaggaaggatatgatctaagtgagctagcaaaataataaaagacatttataaacatttagcagttagttaaaggccactggaatattgagtaattgctaagtagtcaactataatttatctaatcttctccaatcatcatgtccctattcacttaaaaattatttggagggctctatggatatgaaaaataattatgtttacccttgagttttaggggttgtggggacaatcagaagatcagaagatctttaattgtctttaatactattcaagcccaccacccatttctcaaccctaacataaattatctgcttttgtcaaataggccctaagccattttttcttgttcttcccctccccttcttttactc

SEQ ID NO: 241452 - DNA, 844 bp, Homo sapiens
ccaggataaaatacttggtccaaatatctttccttttgtccacttcctattacactcccaccagcatctgtatgcttgaaataatgtgccaagaagctttgaattttgttgaagagggaaaagaaagttggatggttttcttttgtttgggagatccaacttgcgacgatgagaatgtaaaggctcaaagggtggcatggtgtctatgcttactggacactgaactggtttggagcttctagacagctgaagatgaaaatggtgtttttatgagggaattaataaaacacttgacaggaattgtgctgccgtagggcccagatggcaacacagcagagggtaaaattgaaggccatttttcaccagttgtgcacagaatgtagcaggactctggcagcccaagagttgatgactttgagagcatcaggagatagtgtcagcataaaatagtacatagtagcaagagtaaaggcattccagttgactataaaggcagaagtcatggacaaattaaatcggactgttagagaaagaatggcctatggtggtcctatgaaagagactggcttgcaaaccatccctttagagagtttaagaaacaccttgaactttccaggatgctggaagtctcatgttctgaggtgcaaataaaagtaggaatttatgagttattttgatatcgagaggcttctgaggcctaacaaggtttcaatcacaagagtaattatggaagagattatttagatataattaagataaacatttacttaccaacagtaagtttcaaagtgtttgaaaatagtgcatgaactataggattatgtagctgatttcagttatcttg

SEQ ID NO: 241453 - DNA, 790 bp, Homo sapiens
ccaggataaaatacttggtccaaatatctttccttttgtccacttcctattacactcccaccagcatctgtatgcttgaaataatgtgccaagaagctttgaattttgttgaagagggaaaagaaagttggatggttttcttttgtttgggagatccaacttgcgacgatgagaatgtaaaggctcaaagggtggcatggtgtctatgcttactggacactgaactggtttggagcttctagacagctgaagatgaaaatggtgtttttatgagggaattaataaaacacttgacaggaattgtgctgccgtagggcccagatggcaacacagcagagggtaaaattgaaggccatttttcaccagttgtgcacagaatgtagcaggactctggcagcccaagagttgatgactttgagagcatcaggagatagtgtcagcatagtcatggacaaattaaatcggactgttagagaaagaatggcctatggtggtcctatgaaagagactggcttgcaaaccatccctttagagagtttaagaaacaccttgaactttccaggatgctggaagtctcatgttctgaggtgcaaataaaagtaggaatttatgagttattttgatatcgagaggcttctgaggcctaacaaggtttcaatcacaagagtaattatggaagagattatttagatataattaagataaacatttacttaccaacagtaagtttcaaagtgtttgaaaatagtgcatgaactataggattatgtagctgatttcagttatcttg

SEQ ID NO: 241454 - DNA, 463 bp, Homo sapiens
ttagagcaattaggcaagagaaaaaaataagatatccaaatcagaaagaagttaaactgtccctgtttacagatgaaataatcttgcgtacagaaaactaaatattctacacacaaaaaactgttggaactaataaatttagaaaagtcataaataaaaatcaacacataaaaatcaacagtgtttctatacacaaacaatgaaatatctgaaaataagacaacaattccattcatgatagctacgaaaaaataaaatgtagaaatacatttaaccaaggagttaaagacctgtgcattgaaaactataaaacactgaaaggagttgaaaatacaaataagtgaggccaggcgcagtggctcacacctgtaatcccagcactttgggaggccgaggcaggtggatcatgaggtcaggagattgagaccatcctggctaacacagcgaaaccccgtctctacta

SEQ ID NO: 241455 - DNA, 451 bp, Homo sapiens
tcatcctttattcaatgatttattcgtttcagaaaagtttattgagtatctactgtgagcccagaactgtgccaggtactgggaggtctagtttaaaggcagcttgcccacaaggacagggatttccgccaagaatgttctgtcctcattgctatagtgtaagaagcagctggattcccaagtcagccttgacattcagcagaacttagcgtgtctgcctctaaaagcacaaacctgtttgctagactgttcttgtcattgccaatgtatttactattgtgtaaaagtcacgttttgaatataaatttttgtcgtatcttgaagaagcagtacaaagccctaagaaacagttcatagaaaatagttttaagtaattcgaagaaagtacctgtaaatgtagagtaattgcgaagctgtcaggaataaacaagatcttgtaaagctatagaaa

SEQ ID NO: 241456 - DNA, 835 bp, Homo sapiens
gtgttatgaattgtgatggggctgtagtctgggtgtactttaacagtgttgagaaggatctcagttgtctgtccagccatcactgggtgcctttaggctccatgccaggtcaaggggaacattggcacccaaagatacctaaggctgcccatgagatacagagactccacaaagaaaagcaagttgcagtgtcacccagcatcatccaagaacattcctagagactcgcagagttccttatgataaaaaaaaggttttgttgtggccaggtgcagtggctcacgcctgtaatccagcactttgggaggccgaggcgggcagatcacaaagtcaggagatcgagaccatcctggctgacagggtgaaaccccgtgtctactaaaaatacaaaaaaattagccgggtgtggtggcgggtgcctatagtcccagctactcgggaggctgaggcaggagaatggcgtgaacctggaggcggagcttgcagtgagccgagatcgcgccactgcactccagcctgggtgacagagcgagcctccgtctcaaaagaaaaaaaaaaagaaaggttttgttgctccaaaaataggaaagttcaatgtgtgtatctatctacccagtaatgttgttacaagatgtataaaggagtatacattacagatacacaagaagaaatagacaagtccacagttgcagtgggagattttagaatttttatctcatgttatttaaatagtagagaaaaatgaagataggatgtacatttgcgagagatgagcacactgcctaatttacctgtccagtgttgtgtctgctaaatgaaggaaatcacagggtgc

SEQ ID NO: 241457 - DNA, 701 bp, Homo sapiens
ctgttccagacagaggctgcttggactacagtagattaaacacagtgtagagaactatttttttttaagcattaacagttttagttagttaaactaaacatgttagtactactttagttaaacatgttggtagtggaataagactgtgtgaagacagttttaatggaaattgtattatgttctaatatagtgtggtggtaattacctaattcctaattcagattttactagatcatatttccattgttctttctaagccaggtgatgggaatggattaacagtgtggggagcaggatagaggaagggcattacagggaactgcaggagcaaatacctagcaatgaataactcttctgaggatgggtagtagtctagtcttgaaaataatgactagtgtggagaaaagggaacccctgtgcacttttggtgggaatgaaaattaatacaatcatcatggaaaccagtatggagatttgtcagaaaaccgaaaatagaattagcatacagttcagtaatctcacttctaaaaatgtatccaaagaaatttgatctgaatgtagaagagatatgtgcactcccatgtttattgtgtccttattcacaatagctcagatatggaaacaacctaggagtccattatcagatgaatggataaagaaaatatggcatatacacactatgcaatactattcacccttta

SEQ ID NO: 241458 - DNA, 672 bp, Homo sapiens
ggttttatccttactaaatatgtcagtggtaggtcttgatataagattttaacttaggttgctatcataagctctgtcttttggttgcaaaaaccaggtcactctcactcaacaaaagggttcaagatatagatctcctgagacctcaggttgggaactggcttcagtccagtacttgctttctgtggcagacttggcccatgatgattgtcctgagcttaagtgttcctcttgacctttcaccatgacatctaactggcaagttcctttagggtttcttgattctagttcctgcagcacaaatacctagcaatgaataactcttctgaggatgggtagtagtctagtcttgaaaataatgactagtgtggagaaaagggaacccctgtgcacttttggtgggaatgaaaattaatacaatcatcatggaaaccagtatggagatttgtcagaaaaccgaaaatagaattagcatacagttcagtaatctcacttctaaaaatgtatccaaagaaatttgatctgaatgtagaagagatatgtgcactcccatgtttattgtgtccttattcacaatagctcagatatggaaacaacctaggagtccattatcagatgaatggataaagaaaatatggcatatacacactatgcaatactattcacccttta

SEQ ID NO: 241459 - DNA, 444 bp, Homo sapiens
taggagaacagatgttcgggcaggcaggcctgggacccgctggagggagtcaagaagacactacctcctaattaataggcggtaaatgtctgaggaacagactcctgtcccatttcttcaaacatctggggttccggacacttaggccctctgccaggagacatgaatctggggattaaaagtttctgtgcttttcttcaaacagaacaatcctaaaaccacatactctgaaagtatcattgaaactgaccgagaagagaatcctcagccagattttccatggagaaccagacctgtctaaaccagtatgagctttcattacagtaaagtaatggcaaaagaagcctcggggcagacaattccagattcactatttaagtggccttaggtgactggattcacctctctgagcctccatttttctcatatgaaagacaggaagag

SEQ ID NO: 241460 - DNA, 311 bp, Homo sapiens
acctcccccctctgttcattctaggagacatgaatctggggattaaaagtttctgtgcttttcttcaaacagaacaatcctaaaaccacatactctgaaagtatcattgaaactgaccgagaagagaatcctcagccagattttccatggagaaccagacctgtctaaaccagtatgagctttcattacagtaaagtaatggcaaaagaagcctcggggcagacaattccagattcactatttaagtggccttaggtgactggattcacctctctgagcctccatttttctcatatgaaagacaggaagag

SEQ ID NO: 241461 - DNA, 283 bp, Homo sapiens
taggagaacagatgttcgggcaggcaggcctgggacccgctggagggagtcaagaagacactacctcctaattaataggcggtaaatgtctgaggaacagactcctgtcccatttcttcaaacatctggggttccggacacttaggccctctgccaggaaactcaggcattgttctgctggaaggagagaaggccaggaggcaaccctcaaaacctgggtgtgtttggccaaggccaagtagagatttaagggtcttcgagtaaagcattcaggattcttact

SEQ ID NO: 241462 - DNA, 463 bp, Homo sapiens
tttgttctttttgcttaggattgtcttggttatgtgggctctttttttggcttcatatgaattttaaagtagtttttttctgagataaaataattttctgaactaagcatgggcttttcagttaggctgactttggattttgctgtttgatcatgggcaaagcacttaacatgtctgctatggtttgaatgtgtcccccaaaggtcatgtgttagaaatttgatccccaatatggagatgttgggaggtgggatctttaagatatgtttgggtcatgagggctctgccctcatgaatggattaatgcagttattgtgggagcgggttcatgacaacaggaaaagtttaaccccatcttaagtgtgctttagcacctgcacagtatgcaggttaattctcttggcaagaatcttgcccttaactggtttgtttacaacaatgccaacagcgtgcagggtaacat

SEQ ID NO: 241463 - DNA, 349 bp, Homo sapiens
tgtgcctcctgattttcttaaatagacagacaaatacttatctctgacatttttgtcactagcctgagaaaaaaagtgtttatggccaggctcacacctgtaatcccagcactttgggaggccgaggtgggtggattactaggagttcaagaccagactggccaacatggagaaagcccatctttactaaaaatacaaaaattagctgggtgtgatggcgcgtacctgtaatcccagctactcgggaggctgaggcaggagaatcgcttgagcccaggaggctgacattgcagtgagccgagatcacgccactgcactccagcctgggggacagagcaagactctgtct

SEQ ID NO: 241464 - DNA, 533 bp, Homo sapiens
caatactaaggttcgagtgaagataccattgttgtattagtggagacggtataatatattctcagtaaagacctcagtctttactcagttctcatgctccttgatgtcttagcatttgatatattagatttgccatgtactagatactctgagctttggtttttgtatcacaacattgtcctacttctctattgttcattcattcttttgtttaaagaatggccagactatgctgctgaacaagacagacacagcccttgccccttggagcctgtgagcatcctttcttcctctcctatagcctcttttcatgttttctctgtggatattagtccttagctaattgctttgtttcttttagtcttgatttgccttctgtaagaactgttttattctcctagcttaagttgcaaattctaatgccaacaacttacacatctttctctacttctgatctttaccctgaattttattcacttagccatttaataaattttttttttttttttgggcgacagagcgagactcttgtt

SEQ ID NO: 241465 - DNA, 413 bp, Homo sapiens
ctactactactaatactaaattcgcggccgcgtcgacggtttttgtatcacaacattgtcctacttctctattgttcattcattcttttgtttaaagaatggccagactatgctgctgaacaagacagacacagcccttgccccttggagcctgtgagcatcctttcttcctctcctatagcctcttttcatgttttctctgtggatattagtccttagctaattgctttgtttcttttagtcttgatttgccttctgtaagaactgttttattctcctagcttaagttgcaaattctaatgccaacaacttacacatctttctctacttctgatctttaccctgaattttattcacttagccatttaataaattttttttttttttttgggcgacagagcgagactcttgtt

SEQ ID NO: 241466 - DNA, 430 bp, Homo sapiens
atctaagaccttaaataaggaaaattctacaagaaaacattggggaaactctccaggacattggtgtgggcaaagacttctttttatgttgttgttcttgtttttgttttctttcaaacaagataggctttatttagatcaccaaaactaacattttacagaaaggtagccataacattacacagcaaagtatagctgtaaaatctcaaacaagaaacacaatgctttctttagatcaccaaaaataatgtttcatagagagggaactgttagaagcaaacgtgtagctgcaaattttcttttgccgtcaatatcgagtccctctaaaatactttgagactactttgtggtttccaagtacaaactaaaccttgttggacagagttgctcagcttcatcaaaagaatgaaaccaatttgcaaaaaaaaaa

SEQ ID NO: 241467 - DNA, 665 bp, Homo sapiens
ccgggaggcggagcttgcagtgagccgagatcgcgccactgcgctccagcctgggcgacagagcgagactccatctcaaaaaaaaaaaaaaaaaaaaaaaaaaaaagagggaaaaggtatgcaattagaaccagattggcattttggcaggtatttatttttccaggatgaacgtgctttcaaaaattgccagtagttgctaggcagacttcaacaaacacaaaagacatttcccaagcatctaacctggctggtttctccatttatattttgtgatcctggctcgcagtgtagtaaaccctattactatttgaactcgaaatacagaatacttctgccagcagtcccattggcattttgcggcagtcatgaagttaaattttcttcgccaggaggccagttgactaactttaaacgaaggcacattgtccaagattgtgggcagatcatttgaactgccttgaagttgaatagaaactatataaagaaaacaactccatcttgccagaagcagttgcctttttatttggtgttctcctttctgatcactgaattttcctgctgagtttatgcttattgtatctttctctttcctctggcaaatgaacagaaccctcacatacgcagttatggtcagtcctttacttaaataactttgctggatg

SEQ ID NO: 241468 - DNA, 152 bp, Homo sapiens
gttattttttaatgttttttaaaaaatattttcaatccacagttggttgaatccacaaatgtggaacccatggatacagagggctaactgtatacttaatgatttgtatacttttctacacatatgttgtactccaataaaatgttcattta

SEQ ID NO: 241469 - DNA, 253 bp, Homo sapiens
aaaataataaaaggatattaagaattattactacaaaaataaaatacaagtgagcaattatttttgtctttaggaatggtaaggtgtaggcacgccttcacagaattaagaaagaatcatgcttcagatatccttttgagatccaagcaaattaaaaaccaaagaagtcactttgggaggccaaggcgggcagatcacaaggtcaggagatcgagaccatcctggctaacacggtgaaactctgtctctacca

SEQ ID NO: 241470 - DNA, 380 bp, Homo sapiens
aagtgtcagctgtcaaatgaaatgatggggactgacagttcagaattttaaaagttcagctcctttcaaatgcattaaatgaacaagagctgcctaatttgggctgaagaaaaagcaacaaaaatcccctgtaagtatgcaaggttttattctacttttgcatgcttagtatgcatagagaatgttaaatacttttcagctggatacactgttaattctatgagtgagaaagatttcattaggtgagcttcaggcaagactaggctacaaatggaattcccttttattttctgaaattcacagtatatgacccatatccagtgataaatggtctataaattctcttgctgtatttaattgcataaacttccattatattc

SEQ ID NO: 241471 - DNA, 272 bp, Homo sapiens
tctctcagggtaagacctagacatcagtagtcatttacaaactcctcaggagctagagaccagcctgagcaacatagtgagacctcatctctacaaaaaaaaaaaaaaaatttttttttttttttttaattagctgtgtttgatggcggacacgtgtagtcccagatactggggagggtaaggtgggaggatcacttcagcccaggagatcaaggctgccctaaggtgtgattgtgtcactgcactccaacctgggctacagagcctatctc

SEQ ID NO: 241472 - DNA, 547 bp, Homo sapiens
tttaatatcatggaggcactggatggactgctaaagttcataaaatttcacaaagattgggatgatatcttggatggaacttatttcagtgccttactcttagaaagggctcagtaaacaccattgtggttgctggtacaatctgaagtctaggtacaacagcaaaccccagggaacttaagctgtggtcccttgagcatttgctctgcctctctgagctttatttttcttatctactcagtggagataacagctataagcctcaaaataacctatattttagcatgacaatttttaaagagttactacctattatttccttttagcttcacaagaccatgaaatagaacacttactccggttcccattttgcagatttagggaaaaaacactaaaaggcagaatgatttgcagttacattgattcagcaaacatactctaaattgtgaggatagatacagagaagaaaggtcgagtttctgtcctccaggaactctcagtttagtgagtgagtcatagttagtcttgcttgctctaagcaagacag

SEQ ID NO: 241473 - DNA, 316 bp, Homo sapiens
caggagctggagtgggtgccacgccagttaccatagtctcccgggtcctggaattgtgctacaggagtccaaatgggattctccagctctgcaaactcaggagtcacagtttcggttcatagtgttgatatttctggtctctgtataagaaatatattttgttgaactatgtgactaatcaagttgtaatgttttttaaatgaaagaagaattcctatcatagtcatcactttgatttgtgaggatgaacacttcgttctctttagaagagataaaagattacatgaggaaaaaagtatgtaactagagttatata

SEQ ID NO: 241474 - DNA, 475 bp, Homo sapiens
aaggagagggtcatgtagatctctggggacaagagcctttcaggcagagggaccacctgtgtggaagtccaagggtcttgagtgttcaggtatggtcacagccaatgtggcgggcagggcacgagagaaggaagagtgaaggaggaggtgaggttagaggggaggtgacagggtccaggactttggcttttctctgagtgaaatgggagcctggagtggcagtgatctgactcacattttaaaggactactaacctgctgtgttaaaatgacaccaagtctggggaggaaggtgtagtgttataagcaaagagatcaattaggtgacaagcaggggtggctacagctggagtggtaagtgtggacagagtgaaagaaacaggacgtgatgtgaagtagatttgctaatgggttgtatgtggtgtcagagaaagagtcaaggatgaatgtgtggaaaagttaaaatacagataagc

SEQ ID NO: 241475 - DNA, 312 bp, Homo sapiens
tattcaacaaatactgattgaacactttgattccatgtgtcagtgtttaaactacttgctgcgtctttagctctatctcttctgctgaataagaaattgtagagagatatttcagattttgctaaatcagtttacaagctttgttctttatttatcattccaaattaagccagaataaaatatgttttttaattgcattgacataaactaagaaaccaatgggagtgatttagattttgagaaataggaaattaaaatagaaacttggactcattttcatcaaccttactggttctagggaagtcattgtca

SEQ ID NO: 241476 - DNA, 359 bp, Homo sapiens
gagatggagtctcgctctgtcacccaggctggagtgcaatggcgcgatctcggctcactgcaacctccacctccccggttcaagcgattctcctgctttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacc

SEQ ID NO: 241477 - DNA, 342 bp, Homo sapiens
catgaaaggtgtttccctcctggggaagccagggtgaacacggtcttgcccacacagggcatacgattcgggaggttcaatgaggataatataaaaaatgtaccacaacttaagggccatgaaggaaacaatgccttctttcacttgtgatattagctacttttgaggaaaatctggctaatatatgtttcttggctacctgcctccttaaatagggtgtaagggggatattctaatcttaactggaggactcagcattgcaactggtcccataaagtctgacacttgcttctttataatgatttccaagaggtgtatgaacctttttatgatcacgttaaa

SEQ ID NO: 241478 - DNA, 1308 bp, Homo sapiens
  misc_feature (670)..(670): n is a, c, g, or t
  misc_feature (801)..(801): n is a, c, g, or t
atgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgacgaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgngccacctgggcctgaaggggatccggtctgccttgaagaggcctgtagagcagcccctgggggagattcctgagaaatccctccactccattgctgtctcctccatccagaaagccaagggctatcagctnctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatgaagtgacgcc

SEQ ID NO: 241479 - DNA, 456 bp, Homo sapiens
ctagcctgtcatgccatgacctgacccacactcagagcagagggtaccctaatgtggccacagcaaattccaggcagtagggagctgttttaaggtgaataagacacagtcttctccatcattaacccccaaagtctggtgagagatacagactgacatagtatgagaggtgttgagatggagcacagagaccacagagagaaggctggccatgtggaacagacctcagagaagctgcttacaggaggcaacatctaagttaattttgaagaattagaaacagttttccagatggagagactggaaaacacatgctacagagaaagaatgtgctcaaagatccaggattgcaagaaacacttaaaacctcttcatcttgaagccccatctcattttaaaccgaatataaatacatacatagcacatctcacattaaaattttaagtttcaaatgtg

SEQ ID NO: 241480 - DNA, 401 bp, Homo sapiens
attttggtgagaaaaattgttataaagacaggagacaggaggacatatttttgttacaaagtgattcaaaattatttaaaagttgtttcaaaatatggatttaagaatgaaatagggctgggcgcagtggctcacactttgtaatcccagcaatttgggagaccgaggtgggtgcatcacctgaggtcacgagtttgagaacagcctggccaacatggcaaaacaccgtctttactcaaaatacaaaaaattagccaggcatggtggtgagcacctgtaatcccagctactagggaggctgaagcaggagaatcacttgaacccgggaggcagaggttgtagtgaggcaacatcgtgccactgcactccagcctgggtgacagagagagactctctgtcta

SEQ ID NO: 241481 - DNA, 435 bp, Homo sapiens
ttgcatagtagttgtttttagagacagatgcttcactaactgaatacttagtggaaatggcatattcctggaaatgactgtgtgtcatttgggtagaattgtgtggtttggattcagtgtaagagttaatagattgcaaataggaatttcctattaaaaaggattaggtattgctatactttctgtaactcatcacagcccacatcctccagttagggaatacagcctttcttcttcaaagtcagttgttacctgtttgaaacgatctcctatatccaagcaaagccctgagtgcttagagccataggtcttccaccattttctatgctcatgatgatatttagttactgtaccagtattctgtgttacagaaaattagtactaaatgaaataggccaaacaccagtaaataaaataaattttaaagtaattgta

SEQ ID NO: 241482 - DNA, 330 bp, Homo sapiens
ttttttttaggataaatttctaggaatgaatatctttagagctcttgataattattacctctggtaccacattgttctccaaaaggattttagtggtgaaaaaaaacctaaagtttataactataaaagtttgttatttttcttagaaaaataacacgaaaagacttctggactgaaattctccttttcctcaaaattaattatgcaaacaaaaattagttttcaaaaaactgccagcaagtaaatgcggatagaggaatagtcaaataccttaaactttgaaaagtacatcaaagaaagagagagagattggaaaggaaaaagaaagaa

SEQ ID NO: 241483 - DNA, 274 bp, Homo sapiens
caggcaggctcaagtggctggagtaggccccgcctgcctcccctctgccctctgcggctgttttgtatcctgccagattcctgaagtgtcaggcctcattacagccccgtgccccagtgagcatggagaggcagttgacaggtatacaatctgaccgcggctcccttcaaatcatcaagttgtcttcaggcaggaacgtgccgggaagctgggcagaggcccctggcttggctgcataatctgatgcacattaaaaacatctttcggatgcctt

SEQ ID NO: 241484 - DNA, 389 bp, Homo sapiens
tttatccattgccctattactagtcatttataacaattttttaatagtgtgtaaatagtattgccatccattgaccagcaattgtgtttctataaatctgtcttatgggccggatgtggtggctcacgcctataatcccaacactttgggaggccgaggtgggtggatcatgaagtcaggagatcgagaccatcctggctaacatggtgaaaccctgtctctgctaaaaatgcaaaaaattagccgggcgtggtggcgggcgcctgtagccccctactcaggaggctaaggcaggagaatggcgtgaacctgggaggcggagcttgcagtgagctgagatcgcgccactgcactccagcctgggtgacagagcgagactccgtcccaag

SEQ ID NO: 241485 - DNA, 506 bp, Homo sapiens
ctgatattcactttgttgatttcaggaggtcctggtataattcctctaggacatgttcactgctgaagcattacttctgcttgtgtgggtcggggtcccaacatgcattaatgctgatgactagggggatgtatgagacctaggtaatacactttgcaatataacagacatgcattgtgctgtatgtatggtctcatttcagccaccacccaagtggttcagcccaaaaatattgaaaagaaatttcatgtttttgtgtatcttcacaggcattaaagaggatcaaatccataatttctggcaacactgctcttttccacttccccttgcaacttccttgtggacttgtgaaacttcactgtggacctgaggctcctactgtcctggaagtccccttgtggactttctggggattttttttgccaaaacttgtcccctcccaacacactcctttttgttctttttttatgtagaatgactgaattcgtggaggtgaaaccttttct

SEQ ID NO: 241486 - DNA, 619 bp, Homo sapiens
tagccaggcttggtggcgggcacctgtagtcccagctacttgggaggctgaggcaggagaatggcatgaacccgggaggcagagcttgcagtgagctgagatcgtatgtggcacctccctcctctctctcttcctgctgccctggccatgtgaagttcctcactccccctttgccttcctccatgattgtaagtttcctgaggcctccccagccatgctgcctgtacagcctgcagaactgtgagtcaattaaacctcttttctttatgaattacccagtctcagatgtttctttatagcagtgtgagaatggagtaatacaaacggtaagttggagaatgaatggaacgtgaagagcgagctagtaatgagtatagactactaaggagtttaactgtgaatggaaggttaaaggggttcatatgtagaggaaaatgtagaatgaaggagaggctttgtttttagcctgtgaagaaggagctatcagagaaatgttgccatggctagaaagaaagggaatgatttttaaaagcaacaacctaattagagcccaggtagaaggattagcctttgttttcaagctgggaagtggtgggaaatgagtgtgcgtggatggcct

SEQ ID NO: 241487 - DNA, 524 bp, Homo sapiens
gatctcagctcactgcaacctctgcctcccaggttcaagtgattctcctgcctcagcctcctgagtagctggcattacaggtggatgtcaccacgcccggctaattttttttttttttcttttttgtagagaagagttttcgccttgttgcccaggctggtctagaacttctgcgctcaaacaatctgtccacctcagcctcacaaagtgctgggactacaggcgtgagtcaccatgcttggttgactgcccttctcgcatcaagtccacctttagtggtccccaagacccccgtcaaggttcagtaatttgctagattcacagcagttactgaaagctttttgttttgagatggaatcttgctctgttgcccaggctggagtgcattggcacaatcctagctcactgcaaccttgaactcctgggctcaaatagtcctctcaccttggcctctcagagtgttggcattagaggcatgagccactgtgcttggccccgaaaaatggacattttcctctccccct

SEQ ID NO: 241488 - DNA, 559 bp, Homo sapiens
gtttcacagttgaggaggagaagctgggactagcaggcttcacgagaaacacaaaggtatagccttgctcactgcatatccactgacctgacccatagtacaactccagtaggaattgttggacagatgactgaatgaggagactgaactgtagccagctctagagattaaaaaaagtcatggagattcagaaagacaggaagttactgcatataaaggttaacacccaccctcaccttctacaaacagcctcagctaaagatacctgggaggagcttgtagaagatgccactctctgcaatccagaggaaaatgtctttccctttgagcggatcatttctaccaaggtcaaactcatattttacattgagtttgtatgaaaaaaaaatcagatgtttaatttttcatgtaatcaaagaacaataacaaaagcaaaccttcacttgaggactgactctggactggttctggaagctgtacaagggacatccccagccacgtggtaactggcatgagcccacaattaatatgcattaaatcagtcactcctcaagtcaaa

SEQ ID NO: 241489 - DNA, 429 bp, Homo sapiens
tatttgctctctcttgacatggtagcttcacgagaaacacaaaggtatagccttgctcactgcatatccactgacctgacccatagtacaactccagtaggaattgttggacagatgactgaatgaggagactgaactgtagccagctctagagattaaaagtgagtatagggataattatatctgtaagtagctattattacatctctttttctgcaatcactagtaatgttagtattaataatttgtcagtgcttgaaaggttgcaaagactttgtatttgggaatcagcaaagattgttctccaactcctccatctgagattcctgaccagtggggagtggcccagagcagctggtttgagggaggtgatggagacggtgcagtctggtgactccaccagcattccccaccagcacccgccactgg

SEQ ID NO: 241490 - DNA, 354 bp, Homo sapiens
gtcatgccagtggccccaggtgggctgcatagccctgaagaagggacacaggctccgactctaacagaatcggctgtgaaccctgactctgccctcttaaaaatgaagggcagtagaataggccgccccaacacatgccgctttggcgtaaggattattctgagctcagggcacttgaaaaccagcaggtgcaagaaggagaccctgactttcctttttcttcctgtaagcaagagatgaaaccctgtgtgaaagatgccccccctccaccaggagaaaggaagagatccttgtcatcagagtcaaagcccagggtgctctacaaacaaaccttgtgaagccaacacttacctt

SEQ ID NO: 241491 - DNA, 460 bp, Homo sapiens
tgcaaatttaaaaggtgaatgtagtgagggggatggcaagtggctggtacaggctgtggtgattccttttactcaagggtttttgtggagtatagggagaaggggttgatatttatggacacctatgtgtcaggcactgtgcatcattttatccttacaggatgttgtgaggtaggtattattgttttcatttttacaggtgaagaaagcaggtctcagagggactaaaatcctgcccaaggttagtggtagagctgggatccaaaaatctgtcagaatcctgagactgcgctgttccactgtgccacgcagacagttcattcagtttagatgtcacatagtcaagagggaactctatgcatcctttaattttttagactatgatattctttttaaaaattagcctttattttctaactaccaaaagaaatatgaaagcattacagaaacactggaaaat

SEQ ID NO: 241492 - DNA, 561 bp, Homo sapiens
gcaagcttttacttcttcccaagtcagcaaataattcctcctcctcacttaatagttgactatgaagagcaagccattttgattttgcctccaatgagctttcacatttcattcctccttccactcccatgactaccaaaccaatgtaggttctcctcacttcactctaagacaacagcgtggccctcaactactgtcacactcttctaggctctgtgagcacaatgtgtctcatattctcttctgctgtcaccagatttactttacaatagtttctttactgtcactcccctgtttctcaaccagttatacagaaagatgaatagccagggtgatagtctacttagcagaggggaaaaaaaaaaaaaaagatctgtggccagtccacagacctgtttaagtacaagatattacatcagcactatttcctaaaactcttctacatgagtcctaccctccttgtgttatagctcaaactggtctggtatactctgagtatctcattctctttcctagataactgattgtgtttacttttcacctatgtaaatcattttcctt

SEQ ID NO: 241493 - DNA, 569 bp, Homo sapiens
ttgagatagggtctggctctgtcacccaggctggagtgcagtggcacgatctcagctcactgcaacttctgcctccagtgttcaaatgattctcgtgccttagcttcctgagtagctgggactacaggcgggaaccaccatgtctggctcattttttgtgctttttgtagaaatggggtttcgccatgttggccaggctggtctcgaactcctgggctcaagcaatctgccaagcttggcctcccaaagtactgggattacaggcatgagccaccatgcccagccaactggtgagtttttataatgttctgaaaaaaagtgcattttaaaagccagcgtgttcacagtgtataaagaaagtattgcttaagaagtacttagatgggaagcgacatgaaaatcttaactaaaaaaactcttacaagcccaaaatataatgtaataaaaacgctcccaagcaaggcaaacttctagattccccaagtgcatacaggtaatggggaagccctgagcctttactggcatgaggtgctctgaagagaacagggggaaccctcttctcctcatac

SEQ ID NO: 241494 - DNA, 542 bp, Homo sapiens
ccaagttttcagtgagttagactttcagggtaatcccggtttgccttgcaaagctgaggaaatgaggaatgtcatgggtatcaatatctttcctgagaactgaaatttaccagtagcacattcctatcgggcatttatcaaaacaaacatataggtcaaatgaccgtttactcagcagccacctgtcagtgccttgggacgtcagcagtcccggggatgcccgtcaaagcagctgagtgatctcggccctgaacattgccaacttcccgcctgatgccctggagctgaggctccagcttgaggcttcccagtgctttggataaaaagatgggtctgcacctgagagccatatacatctcgctctggggagaaaacccaggcagggctttcacacagaggaagagtgaggccaggatttatactcagagaggatgggcaaatagcattcacgcgtgtgtcctccagggtggaatctgccaggctgacttacagtgcaggaattttgccagtcagtggaggtagatgtgtttatagataacgtt

SEQ ID NO: 241495 - DNA, 386 bp, Homo sapiens
gcaagataatctatttaatcattcccatatatgaagatattttattattcctatttacttataaacaaaaccatgttaacatcatgtaagaacatatttgtatacttctctgattatttccttagaataaatccacttttttggaattgctaggtcaaagagaacagacacttgagttttgaggtacattgtggacttcccatctggaaagagtatattagattaaactctaactatatatatatttccctaaagctatgtcaatatattatgattaaaaatacattttccaatttgagagacaaaagtcatctctcattttctgtaactttattttatgacaaaaataatgtgttcattacagaaaacataaaaaatctagacac

SEQ ID NO: 241496 - DNA, 471 bp, Homo sapiens
gaattcaagcaattcttctgtttcagcctcctgagtagctgggatcacaagcgcatgccaccacgcccggctaatttttgtattcttagtagagatggagtttcaccatgttggtcaggctggtctcgaacttctgacctcgtggtctgcctgccttggcctttcaaagtgctgggattacaggcgtgagccaccgtgcccggcctacatggttttttattcataacagattcttccatatgtgttactaaaactaattaaaaactaggctattgaatatcaggttatttgatattaactttgcctaactttattattatcatagaacatggatgttccatgttctgttaagataatagcacttttctgcctttaaattgtgatcatagttgttgtttttgccttttaagaatgtgtgttattatccatgtgcaacttatgcttactgtagaaaattaggtgtgataagca

SEQ ID NO: 241497 - DNA, 475 bp, Homo sapiens
tgaagatattccatgtagaagtctgatttcaggctgccatggactgagctgagtcctctgaaaattcatattttgaagctttaacccacaatgggactgcatttaaagatggggtctataaggaggtaataaatgctaaatgagattacagagttctaatctgatacaactgacattcttataagaaaaggaagcaacataagagctcactctctccatgtgctcacagagaagaagccgcgtaaggacacagtaagaaggaagctgtctgcaagccaggaagagagccctcaccagaaactaaccctgagggtgccttcatcttagacttttggccttcagaactatgagaaaatatgccactcaggctatggtattttgttatggcagcccaagcagatgaaagtgcagaccctcctctgcaatgtatcatttgtaccaaaagtaaacaccaataaaagtatgattcctaacc

SEQ ID NO: 241498 - DNA, 676 bp, Homo sapiens
cttcatccataaagtgcattgtcttaaaatcaaggcattatcttaggtaaccacacacacagtaccattattaaacctaagagaactaatatcatctaatatcagctctatttcagtttttcaagctgtccccaaaatggctgttacagctttgtttttcaaacgaggatctaatcaagtttactcattgcattttgttctctccctttcatctcttttaaggtggaccagttcccgtggtttgttttgtttgtttagactttttagagtctaagccagttgtcctgaagaggatgcaattgttctatcaattttggggtgtcagacttcagtttctccagaactgttaggaaattaagttgttaatgtgttactgagtttgatcagggctgaagaagcacagccaacctttgagagcttattgcttgaaatgatggcatccttggaccttttcatggcatgttccttctgaagtctctaggtctgggcctagacaaactttctactggcagatcataaggagatgcaaatgaagaggtagtatctgaccatgagacatttaccgtctaacaacttgagatattttttccctcctgggaagtagatttctgttttaggctcagattaaggagggggatagaaattgagacacttaattttacagcccccttggcta

SEQ ID NO: 241499 - DNA, 412 bp, Homo sapiens
ttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagt

SEQ ID NO: 241500 - DNA, 346 bp, Homo sapiens
aatgatttcccgtgcctggttctataccctaggtgcgcagatgaatttcagctactctcttaacctagcccacacaaatcatctcagtgcttccattttaaccagtcatccaacaaaacagatttacttttttccttggcttttccctgttgctttgggatagaaggtctttactcctcagtgaacttatctatcatggctcaagtccatagagaaattggccgggcacagtggctcacgcctgtaatcccagctactttgggaggccaaggtgggcagatcacaaggtaaggagttcgagaccagcctgaccaacttagtgaaaaccgtctctactaaaaatacc

SEQ ID NO: 241501 - DNA, 367 bp, Homo sapiens
aatgatttcccgtgcctggttctataccctaggtgcgcagatgaatttcagctactctcttaacctagcccacacaaatcatctcagtgcttccattttaaccagtcatccaacaaaacagatttacttttttccttggcttttccctgttgctttgggatagaaggtctttactcctcagtgaacttatctatcatggctcaagtccatagagaaattggccgggcacagtggctcacgcctgtaatcccagctctcaggaggctgaggcaggagagtcacttgaacccaggaggcggaggttgcagtgagctggagatcgcgccactgcactccagcataggggacagaacaagactccgtctag

SEQ ID NO: 241502 - DNA, 441 bp, Homo sapiens
tgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 241503 - DNA, 423 bp, Homo sapiens
aaagcttaaaggaatacccactgaattccagctgctgaaggttgtcctgccctttccttgtggtctccaaacacaagcttgttttatgtcacattattttctcccctctttatgggccagattcaatttgtcactacttggatattgaacactttttgcaaattaaagagaaagtcacctcaggcaactttcaaatagaggcttattggggacttgatgatactgcaaatcattaaagaacttaggttctgtacctctgccctcactgatcaaatagaggccactcctttgaagccagcaaggacccatgggactgacctaatgctttttgccttcagcttctgaagcttatcacattactaatgtttgagtctctaatccagctggctagtttaatcatcttgaagtaaaacaatactatta

SEQ ID NO: 241504 - DNA, 298 bp, Homo sapiens
aaaggaaaactatttaaagtttggggaacacataaattagtctgccattgtattccggagccaccatttcaatccagggaagagagccatcctacagtggtgtccaggaaaggacaatcttggaaacaaagattttcaagggaggcatttccagcaatgcctaacctcttcaggagagtgtccatttaatattcatttcaaaatatttgctcttcctatttgtgactgccctttgtgagataatgtattagcatagtcattttcaatttgcagggggacagtgggcagcaccaatatt

SEQ ID NO: 241505 - DNA, 433 bp, Homo sapiens
tatgaggaaaaatcttgtaacaagtgggaaagagaaaaaaaaaagcccttatgaatcattgtaacctctaaactgggtttcattagaaaatcatcaccttaaagtggatacatgctggtatttactctatgtattattagtgttaaattattgatggcaaccaacatcatatctgtgtttatgtacttgactttcttgtaaagacgaaaatgattatcagaggtttttgaatggttgtagaatctgtgatgatcttgtttatcatcatggagaaatctaacaaatatgagttttctaacttgtagaaacttattcctttaagcacagatggaaatctctttaacatgttaccttctgtcctacattaaaaacagaaagatatgttcctttctttatccctattctagggaacttggaaaaaatacagaagagt

SEQ ID NO: 241506 - DNA, 393 bp, Homo sapiens
gcatttgttgttttttaagatgagagatggccgggctcagtggctcacgcctgtaatcccagcacttcaggaggccaaggcaggcggatcacaaggtcaggagatccagaacatcctggctaaaactgtgaaaccctgtctctactaaaaatacaaaaaaattagctgggcatggtgacgggcgcctgtagtcccagctactcaggaggctgaggcaggagaatggcatgaaccggggaggcggatgttgcagtgagccgagaccgcaccactgcactccagcctgggcgacagagtgagactccttctcaaaacaacaacaacaacaacaacaaaaaaaaacgatgagagatgagcctggtgcagtggctcatgcctgtaatccctgtgctt

SEQ ID NO: 241507 - DNA, 464 bp, Homo sapiens
actattggggttgatttgctaatattttgttgacaattgttatacatatgttcatgagagatattggtctgtagtttttctttcttgaaatatatttatttgatttgggtattaagataatgctggccacatataatgagttaggaagtatttctccaacctatatttcctgggagatattgtagagaattgtatatttctttcttaaatgtttggtagaatttaccagtgaacccatctaagcctagtgctttcattttgggaaagttattaactattgatccaatggatatagacctgtttaaattgtcagtttctcctggtatgagtttgagtagagggtgtctttcaaggaactagttcatttcacctgggttatcaagtttacaggcaaagagttgttcatgatagttctttattattcttttaatgtattcttgatacagatatcatacagatattag

SEQ ID NO: 241508 - DNA, 456 bp, Homo sapiens
catagaagatctgtcaccagatcatgttggctctgtcttcaaaatgagagaatccaaccacttctcaccacctccacagccaccatcttggttcaaaccgctgtcttctcttgcctaaatttttgcagtagcctccccttgtttcttttcttgctcccctgcagtttatcctcacagagcagccattaaaccctccagtgcttctcctgtcattcagagtactttgctgacctcatctcctggtcctttttcccttactctgctccaggcactctggtctgccttcacttccttgaatgtgactataccaggcattcctgtctcaaggcctttgcacttttcgtttcacctgcctggaacactcttccccagatagcttcaagactttctctcacttccttcaggtttttgttcaaatgtaatcttctcagtgaacctcctcttatttgtcatgtc

SEQ ID NO: 241509 - DNA, 1213 bp, Homo sapiens
  misc_feature (714)..(714): n is a, c, g, or t
cgggtgcggtggctcatgcctgtaatcctagcacttcgggaggcgaaggtgggcagatcacttgagatcaggagtccaagaccaacttggccaacatagtgaaaccccaactctactaaaaatacaaaaaactagccaggcatggaggcacacacctgtagtcccagctattcaggaggctgaggcaggataattgcttgaacctgggaggcagaggttgcagtgagctgaaatcatgccactgcactccagcctgggtgacaggtttttctgagactccatctcaaaaaaaaaaaaagtattgtgcaaacaattgcttacactgctaccaaagtaaatttgacaagtgaaatagttataactcgccaagttagaaaagtaaatggattccacattaactaaatatttaaagttaagatttttaaaatatggaagatagttacattttcacaataagtaactaaagaatatgtattttttaggattctttttagtatgtcctttgagtatgtccttttgttaacattcaccacacaaattactattaaaagtagtccaaacaagcctgggcaaatggcgtaactctgtctctaaaaaaaaatacaaaaattagctgggtgtggtagcacatgcctatagtcccagctactcagggggcctgaggtgggaggatcaattgagcccgggaggagacctgttcaacaaaaaaaaacngaaaaaatggcctatttgccatttgcttaaaggagccgatcaaatcatggccggctttaaaaggtgggatggaaaacctgggttaccaactaatgcttggagaaatcccttttgccacgggcgaaagaaaggccccaccaaggttttcaaagtgccacttgagggaatggaattgagggaaatttgttaaaccggcaaattgtgaaacgctcttttacacaggcgcaatgtccttataatcgaaacccccctaaaggttggttgtccttccacaggcctttatacagggccttccatagggcccctctgagcgggccttccgagcacccctacaacttttgtggggcgtctcctacgtctatgggcctctatcgtcgggtctccactatcggcctccgctactccactctctcagtctgtctgctgccgctgggcgtctcgactccgccttcccctcttaccgcctctctacttgttccctcttcgtctccttctcctc

SEQ ID NO: 241510 - DNA, 1179 bp, Homo sapiens
cgggtgcggtggctcatgcctgtaatcctagcacttcgggaggcgaaggtgggcagatcacttgagatcaggagtccaagaccaacttggccaacatagtgaaaccccaactctactaaaaatacaaaaaactagccaggcatggaggcacacacctgtagtcccagctattcaggaggctgaggcaggataattgcttgaacctgggaggcagaggttgcagtgagctgaaatcatgccactgcactccagcctgggtgacaggtttttctgagactccatctcaaaaaaaaaaaaagtattgtgcaaacaattgcttacactgctaccaaagtaaatttgacaagtgaaatagttataactcgccaagttagaaaagtaaatggattccacattaactaaatatttaaagttaagatttttaaaatatggaagatagttacattttcacaataagtaactaaagaatatgtattttttaggattctttttagtatgtcctttgagtatgtccttttgttaacattcaccacacaaattactattaaaagtagtccaaacaagcctgggcaaatggcgtaactctgtctctaaaaaaaaatacaaaaattagctgggtgtggtagcacatgcctatagtcccagctactcagggggcctgaggtgggaggatcaattgagcccgggagggtaagttgcagtgagccgagatcatgccactgcactcaagcctgggcaacagagcgagaccttgtctcaaaaaaaaaaaaatgcggccgattcgggctcattggccaattgccctttggggggcggttacaattaattggccggctttaaacacggtggactgggaaaaccctggggtcccaattaaagcgttgggaaaaacccttttcacggttgggaaatagaaagggccccccgttcgcctttcaaacgtgggcaccttaaatggcataggaaatgcagggccaatattggtaaaaccggggaaaatttgttaaaaaggtctttttaaccacaggcccatatggcgaaaccctcatatcaacaaaaacaccccctaagcgcgcgcgtgtccctttggcaaaggcccttttcaagacggggctccctctcaggcgtcctttagggtgcgccacttggctcccccctgattttgtggggggccaccct

SEQ ID NO: 241511 - DNA, 756 bp, Homo sapiens
cgggtgcggtggctcatgcctgtaatcctagcacttcgggaggcgaaggtgggcagatcacttgagatcaggagtccaagaccaacttggccaacatagtgaaaccccaactctactaaaaatacaaaaaactagccaggcatggaggcacacacctgtagtcccagctattcaggaggctgaggcaggataattgcttgaacctgggaggcagaggttgcagtgagctgaaatcatgccactgcactccagcctgggtgacaggtttttctgagactccatctcaaaaaaaaaaaaagtattgtgcaaacaattgcttacactgctaccaaagtaaatttgacaagtgaaatagttataactcgccaagttagaaaagtaaatggattccacattaactaaatatttaaagttaagatttttaaaatatggaagatagttacattttcacaataagtaactaaagaatatgtattttttaggattctttttagtatgtcctttgagtatgtccttttgttaacattcaccacacaaattactattaaaagtagtccaaacaagcctgggcaaatggcgtaactctgtctctaaaaaaaaatacaaaaattagctgggtgtggtagcacatgcctatagtcccagctactcagggggctgaagggggagggacaaataaccccggaggggggaaatttcaataggccaaaaaatgccactggctccaactcggggacaaaaggagaacccttttta

SEQ ID NO: 241512 - DNA, 1119 bp, Homo sapiens
cgggtgcggtggctcatgcctgtaatcctagcacttcgggaggcgaaggtgggcagatcacttgagatcaggagtccaagaccaacttggccaacatagtgaaaccccaactctactaaaaatacaaaaaactagccaggcatggaggcacacacctgtagtcccagctattcaggaggctgaggcaggataattgcttgaacctgggaggcagaggttgcagtgagctgaaatcatgccactgcactccagcctgggtgacaggtttttctgagactccatctcaaaaaaaaaaaaagtattgtgcaaacaattgcttacactgctaccaaagtaaatttgacaagtgaaatagttataactcgccaagttagaaaagtaaatggattccacattaactaaatatttaaagttaagatttttaaaatatggaagatagttacattttcacaataagtaactaaagaatatgtattttttaggattctttttagtatgtcctttgagtatgtccttttgttaacattcaccacacaaattactattaaaagtagtccaaacaagcctgggcaaatggcgtaactctgtctctaggggcctgaggtgggaggatcaattgagcccgggagggtaagttgcagtgagccgagatcatgccactgcactcaagcctgggcaacagagcgagaccttgtctcaaaaaaaaaaaaatgcggccgattcgggctcattggccaattgccctttggggggcggttacaattaattggccggctttaaacacggtggactgggaaaaccctggggtcccaattaaagcgttgggaaaaacccttttcacggttgggaaatagaaagggccccccgttcgcctttcaaacgtgggcaccttaaatggcataggaaatgcagggccaatattggtaaaaccggggaaaatttgttaaaaaggtctttttaaccacaggcccatatggcgaaaccctcatatcaacaaaaacaccccctaagcgcgcgcgtgtccctttggcaaaggcccttttcaagacggggctccctctcaggcgtcctttagggtgcgccacttggctcccccctgattttgtggggggccaccct

SEQ ID NO: 241513 - DNA, 1120 bp, Homo sapiens
cgggtgcggtggctcatgcctgtaatcctagcacttcgggaggcgaaggtgggcagatcacttgagatcaggagtccaagaccaacttggccaacatagtgaaaccccaactctactaaaaatacaaaaaactagccaggcatggaggcacacacctgtagtcccagctattcaggaggctgaggcaggataattgcttgaacctgggaggcagaggttgcagtgagctgaaatcatgccactgcactccagcctgggtgacaggtttttctgagactccatctcaaatgaaatagttataactcgccaagttagaaaagtaaatggattccacattaactaaatatttaaagttaagatttttaaaatatggaagatagttacattttcacaataagtaactaaagaatatgtattttttaggattctttttagtatgtcctttgagtatgtccttttgttaacattcaccacacaaattactattaaaagtagtccaaacaagcctgggcaaatggcgtaactctgtctctaaaaaaaaatacaaaaattagctgggtgtggtagcacatgcctatagtcccagctactcagggggcctgaggtgggaggatcaattgagcccgggagggtaagttgcagtgagccgagatcatgccactgcactcaagcctgggcaacagagcgagaccttgtctcaaaaaaaaaaaaatgcggccgattcgggctcattggccaattgccctttggggggcggttacaattaattggccggctttaaacacggtggactgggaaaaccctggggtcccaattaaagcgttgggaaaaacccttttcacggttgggaaatagaaagggccccccgttcgcctttcaaacgtgggcaccttaaatggcataggaaatgcagggccaatattggtaaaaccggggaaaatttgttaaaaaggtctttttaaccacaggcccatatggcgaaaccctcatatcaacaaaaacaccccctaagcgcgcgcgtgtccctttggcaaaggcccttttcaagacggggctccctctcaggcgtcctttagggtgcgccacttggctcccccctgattttgtggggggccaccct

SEQ ID NO: 241514 - DNA, 417 bp, Homo sapiens
gctgagtgatttcattctgggagacatattcatacaagaggatgataaactggcctaattttgaatgaatggatgagactctgataatatgccaatacctctttactgttacaatcctttttcctgtaaaagatatgtggtcaaagaaaagtgggcaatctgagttatcacaaaaacatttagtctttgtccctggtttctcctaaaaaccttagactctcttgagtgataagagtgtctttagagtactgatgagaagactcttggctgagtggatcctggatatcttaagaacggtggctagctgccagagacacatacctgtgatgcgagggttatctttttccattttgtgttgctataaagaaatgtctgagactgactaatttatataaacgaggttcatgtggctcaaga

SEQ ID NO: 241515 - DNA, 439 bp, Homo sapiens
  misc_feature (28)..(29): n is a, c, g, or t
actactactactactaaattcgcggccnntcgaccccactgactttcttctggataaagtatcatcagattcttgtgtttcatcagaagacttggtttttgtacttttccctatccctttaatcatttggttatgatttagttttttggaatcttttattttgaaatttctttggaatttgttctttggaaagttttcaaattattttgaccaagattgaatgtaataccagtagttgcttaactagtgcttgtttgttttcttgtttttgctaatctatcaagatactctcttacctgtgtctttaaatactacagttaacacaaagtttatatttattcatacagatataaaatcatgctcatgcactttcttgtgtttggatttgtgaaaggaagtctttggttttttttttttttttttttgagaacgcccaggt

SEQ ID NO: 241516 - DNA, 252 bp, Homo sapiens
caaacattattggaataaaaccattgggaggggagggatgaggatactgccctgggctgacatcccctcaacttggccttggccttcctgccgcttctcaacagaaatacgaataaaaaaaccagaagtttggtcttcatttttccgattctccaaatttgttataatttgcaatttgtttcaaggactctgttttcatttcaactaaatccctaccaaaaaaaaaaaccataccaacacaaaaaaacatgt

SEQ ID NO: 241517 - DNA, 555 bp, Homo sapiens
aatcatatttattttaactgaggaattcacttaataggcctttgcttgacagcctacatgccaccacctaaagaacagatagataaagatcagttttacccttgaaaacctgtttcttatggaggagacaaatctgtaaaatagacacctgcatttcacaaattaggaattatttcaatgaatggaaagctcttaaatatgcatgaccaattttaaaaaaatcacattttagtaaaatgaacataatcattatgtaacacaatgtttttaatgattctgaaacccctttaagataccatactgccccagaatcattctaaaaaatcatcaatgatatgcagacatacgtatatgttaaaactatgtcctcgggccaggcgtggtggcacacacctgtaaacccagcactttgggaggccgaggcgggtggatcatgaggtcaggagatcaagaccatcctggctaacacagtgaaaccccgtctctactaaaaatacaaaaaattagccgggcgtggtagcaggtgcctatagtgccagctactcgggaggctga

SEQ ID NO: 241518 - DNA, 327 bp, Homo sapiens
aatggtgtattttaaaaatatttttataggaaagggaggtttttaaaaaatatctttataagtaagggaggtataaaatggtgcattgttctggaacatttactgaaaataagtttatattagtgtaaagtgaacgaaaacaatttttatctgcctgtttcacgttgcggattgacattttatgggtaagttttatagtgatttaaaatagattcccaatggaagattttaatcttatttaataaaattatgctagcatttaattatattgtgaattgtttgaatgacttaattccatccctcccttaaagtaacaatatgttcatt

SEQ ID NO: 241519 - DNA, 123 bp, Homo sapiens
agtgatgtggggagacagagagacccaaggagacttttggtagaggacacccccagtagatgctaaaaaagacttgatccacacatgcctctaacttgttgaacaaataaatatgtatcaagc

SEQ ID NO: 241520 - DNA, 433 bp, Homo sapiens
tattattctttggtagaaatgtactggaacagctgcctgctccctgctgttctgcatggaattatttcctggtactatccccaccgtgaaacgaatttcactacagcatctccagacaaaataaagaaatggagccctcgagaagttaagcagtttgcccaagatcatacagctgcaatttgtattgcaacaaaatttgtgacctgcctaaattttcaccatcattcatatttctgtcacactctggatcctccatctaccaaaaatgaatatagtgacatggccacgcacctgaggaatccttttacttcccacaggaggaagagaattcctcaaatcccacaaaggcaactcttcttcctgaagacagcagctttgccagtaatgagggcaacattcccaatacaggttggtggtcaagtgacttttgtga

SEQ ID NO: 241521 - DNA, 636 bp, Homo sapiens
attgctcattagagaaatgcaaattaaaaccacaatgagattccattccacatccactagaatggttaaaattaatgactgatattaatagcatcaagtgttaacaaggatgggaatgcaagatgttgtagcctctgcagaaaacatcgtgacagttcttgttaacagaaataacagtcactatatgatcaggcaactcattcctaggtattttctcagaaaaaaataaaaatatcgattcacacaaagacttgtacttgaatgttcatagcagctttttttcataatagcaccaagctggaagcaacccaaatgtccttggataagccaactgtggtttatccatacaacagagtactattagcaacaaaaagggctgaacggtgaatgcgtactagacctcatactgtatcattccattcatgtgaaattctagaagaggtaaaagtttattgatagaaagttgatcagtggttgcgagggcctggagtgagggtaaagactgactgcaaaaggacatgccaaacatttttgggataatggcaatcttctatatcaggcttctatagtggttatgtgactgtacacattgatcaaaactcattgatgtgcacatttaaaatgagtgaattgtat

SEQ ID NO: 241522 - DNA, 388 bp, Homo sapiens
ccaccatgcccggccagtgtatcttattgtaacagtgcagttacacgcatagattgaatcagcttccttaacctccagcatctaccggaaaacacctctcttctgggtttgtagtgtaatttgatattacactacaatatcaaattagagatgaaccagaagctttttggagtatggatagacaaagtcattgggatattacatgtaataaagtttgaaaacaatttctcagaccatttcatctgcttttatcagacagacctcactatatagataccaattgaactgctttaatctttactagtgtttcctgcatgtttataccagcttttctggttttgtgactcctccttccctccttgtctgtgagctgtcacttactgatgat

SEQ ID NO: 241523 - DNA, 532 bp, Homo sapiens
cagtcagatagaatatgctcatgtattattatgatttttttcaaaattcttagatttcagggaattttgaaacctggaatgaggaaaatctagtctatatgattattgagtaaaaagaaatcctactgacagcctgagatggtgagcaggaggtgatgggcaattagccttcctgcacctttaatcagtctttgcttgagtgagtcgcgccgtcagctcagtggcatgactcactcgccttactcagactcaggtcgctgaattgtacagagaagagaatcaggctcaactgacagcactcagcattgtgtcacctgtgccgtggaatactatgtagcttttaaaaagaatgaggtaaatcaatataaattcagatgaaaagatagctatagtatatatgaagtgaaaaaggaacttgtaaaatttacatatatttcattttatataaaatatatagtttgcgtattttttgaattatgtatgctaaactcttaaagtaaataaaatatctttggggtggaatgatggataa

SEQ ID NO: 241524 - DNA, 1016 bp, Homo sapiens
actaaaactcttttttggaaggctgtgcatttggaatccacagtattacaatgatttctctcagcagatacaagtgatgtaagtctcatttgttgaaagtgtgtggtgccagcttaagacttaaggggaaaatcacagcactttgaaaaagatgtaaatgttcaattggtaaaaaaggggaaaaaaccgtgctaaaacatgtgcctatttccattatgcttaatttactattcaaaacaagtttttcctaataagctctattgtttctttctgttttgtaaaatttaatatgtgtgagacaaaaaccagattcagaatgtgaatgaagtctgtttagcgaaagattgtgggagcttacagttcaagaaggcctcaaattaaaagaaacatcatcttctatcaccaaaaagatacaaagaagcaagtttcttgggtcatttctaggaccagttcctagattgccaacttcctccatcctcagagctcctcatggatgaattcacacactttaaagtgcaccaagcactagaatattcagaatgattatgccacgtttatttactgcatagctgtagctttcatcttattgtagtcctcttttctctgaagcatcaatcccctaataggactgaagtaagttctcaaacatgttatccccttgtcctgactatagagggttatgtctatctcaaaatcactcacacattttcagagaatctgtacctgattatgcaaccctttgacgtttaacccatctcccatggttgaatgtccccttggaatccagaaggcctggatatcctggcacttgcccatgtgtcctttgttgtttagggctataccatgaatacattcaaaaactatcttgttaatatcctttggaaggactgtaaaaataatgacttttcactttaaaataattcaaggaatagttgtttttaaaagaaaatgttaaagactgcctaattcaactttctttttgtgtggacaaaacaaacaataaagaaacaaacaaa

SEQ ID NO: 241525 - DNA, 489 bp, Homo sapiens
ggtttgaattggagcgtgttaagtgtagtgtcttcttcaccactgtgacgtgaggtcctggcgcaaataattgagcacagaaatacatgtcaggcattgctaggcacaagggtacagccagtgagcagggctgccatggtccctgccctcttagagctgaccttcaggtctgagggagactgaaaaataagtaagaatacctccagccgggcgctttggctcacgcctgtaatcccagcactttgggaggccaaggtgggtggatcacctgaggtcaagagttcgagaccagcccaaccaatatggtcaaaccccatctctactgaaattattaaaattagctgggcgtggtggtgggcacctgtaatgccagctactcgggaggctgaggcaggagaatcgctggaacccaggaggcagaggttgcagtgatccgggatcgcgccactgcactccagcagcctgggcgacagagggagactccatctc

SEQ ID NO: 241526 - DNA, 458 bp, Homo sapiens
tcactttttacttgaggctggccaaaacttgttgtccctattgggaagtttgagatagtgggttctaagaagtatctgtaattgctgagctgaccactgaagacccagtggtgttgagttagagaaagggagtaaggagtaggaagtaagaaaactgtctttggggtcagggcccatcacctggctcatgcctgtaatcccagcactttgggaagccaaaacaggcagatcatttgagctcaggagttcgagaccagtctgggcaacatggtgaaaccttgtctttacagaaaatacaaaaattagctgggtggggcggcctgtgcctgtcatccctgctactctggaggctgaggcgggagaattgcttgagcccgaaggcagaggcggaggttgcagtgagccaagattgtgccactgcactccagcctgggcaatgggagtgaaaccctgtctca

SEQ ID NO: 241527 - DNA, 335 bp, Homo sapiens
tgttctcttttcctagaatgtttccttttcttcttagcctggtaaagaaccattcacctttagagatccaagtcaagcttaatcacttaaccatagcccttccaatgttcatttattatagcatcaattttgtctaataattacttttgtccatgcttatcttttcactagattattattcacattaattttggatcttccatgtctaggaatgcaagtgggtcatactttacacataataatgttgattgaatgactggataattgaaggaatggatgaaatgaatatgtttgatctagaagatttggccgctgattttatatgcgatatatag

SEQ ID NO: 241528 - DNA, 218 bp, Homo sapiens
ctgtcatgataaatgcaaagcagttccagctataaatttcacctaaagtacagtaaaaggaccggccctgatggtggaatttcagagacagaggccaaggcagggaacagtgctgcgggaatgaggccctcttagatgctttgaaattgtaccaggaagaccacagcccctgaacccagttcagagtggagacagcagggcagggaagccctcacacc

SEQ ID NO: 241529 - DNA, 643 bp, Homo sapiens
tataagacatgatttacattgcagtaggtattgagtagatttttaagtatttgaaatactggaagtttgtgaaacaaatgtactaaacaattcctcaatgatacgagtttatagacatttgtctaaatttaaattatcatatttttaccaagtgagtgttacacacttttaaaaatacgcttcaaagtgaaatgagggattttctttttcaaaggaaacaaaaatactgttgttataatttcagagaaatgatgaaagtttcaaagaagcttggaaggagtaaaggggttatgccaaaattaatttctgacgggttttgaaacaaaaataaccttcccagttgaagagttgaaatatcagaatggaagataccgggacaagaatgacttaatcttaaatgttaatctgccgtgtcacttctaactaaccccaagtctgggaatgcctccaaaatgttgttgataaattactctttatgcaggaacacctattcaccgtaagttttcttccaaacaacccttgatgttgttgcagaaatcataggctgtgataccttagctacctacacattccttccagagcacatatcctttttccccaaacacaatccctgggtctagggggttatggtgtggcaatctac

SEQ ID NO: 241530 - DNA, 277 bp, Homo sapiens
acataaagcaagataaacccaccaccaaatgagatattaagacaacatgttttccaagagacaggaacatcacagaagacttcaggaaggaaggcagaagtatttaaggatagctatgctttcattaggcagaaacacaagtgaaacagtaacagttgacatttactgagctcttaccatgagatgtactaatcacttttcatgtaacaacatatttaatccttacagccacttcaggaggtaggcattaatactatcctcattttatagatctaaa

SEQ ID NO: 241531 - DNA, 465 bp, Homo sapiens
taaatcagacaaatctcttattcttcttatatcatgcaagatatactctggaactagtttaactgccattaatatccagtaagaacaaagcacacctctttgtagttttatacagcaatgttacaatttcccactggatttcaatgtaaataatttctatttgccaatataaaactaatctactggccaggcgcggtggctcacgcctgtaatcccagcaccttgggaggctaaggtgggtggattacctgaggtcaggaatttgagaccagcctggccaacatggcgaaatgccgtctctactaaaaatacaaaaattagccaggcatggtggtgtgcacctataatcccagctacttgggtgggtgaggcaggagaactgcttgaacccgggaggcagaggttgcactgagccaagattatgccactgcactccagcctgggcaacagagcaacactttgttt

SEQ ID NO: 241532 - DNA, 414 bp, Homo sapiens
aatactgttcttatcacaagaataaagacaacagagatttaaaactaggaatgaacctgacaaataaggttttgatttttctccctagcctagtggttctctgccctggctgaactttggaattgatgcctggggcctgtcaccagaaattaattggtgccagtgggtctcaggatatttaaaagttccccaagtggctctaatgtacaaccagccagtgttgagaaaagtcaccgtgctagagaaatcaataaaagacctccagaagtctagttatgaagacacaggctgggtacagtggctcactcctgtaatcctagcactttgggaggctgagacaggtggatcacttgaggataggagttcgagaccagcctggccaacatggtgaaaccccgtctctactaaaaatac

SEQ ID NO: 241533 - DNA, 802 bp, Homo sapiens
acttttgaactgtggacttttgggttaatgctgaaatgatttaagactttggggtactgttgggaatgcatgattggttttgaaatgtgaggacataagatttggaggagccaggggtgggatgatatggtttggctctgtgtccccacccaaatttcatcttgaattatactcccataattcccatgtgttatacgtgggacctggtgggagataatttgaatcatgggggtggtttcccccatactgttctcatggtagagaataagtctcatgagatctgatggtttcatcagggggttccgcttttgcatcttactcatttctcttgctgccaccctgtaagaagtatttttaacctaccgccatgattctgaggcctccccagccatgtggaactataagtccaattaaacctctttttcttggcttaatttcttgggtatgtctttatcagcagtgattctattcctatgaaatgtctagaacaggaaaatctatgagacataaagtaattaagtggctgttcaggggatacaggaataggggataataactaaagggttgggagggtgtttttgaaatgctaaaatattctgaagtttactgtggttatggttgcacatacttatgaatatacctaaaaatgttgaattgtacattttaagtagatgaattgtatctaatttgaaccatatctcagtaaagatataaaaatgtttttgggtactaagactaaactagaaagaacataagaggaaatacatattatataagaagaaaagagtaaaaataaatcttt

SEQ ID NO: 241534 - DNA, 415 bp, Homo sapiens
gcagatctccaggtatgagtctatctcaacaacattgtgtttgtctcatgatggatgctactcagccctgagaccgcaactcaactcaaaggaattgccctgagattttgagactctgtgggagggcacatgatggaacctgttgctgatcagatacctaaaacacaaaacacataaaaaatcatgtagaatgtaccttaaagttctttgagtattcagccatttggagtgacagataaaataccagtaaggaaacaatgtttgtctaccacacagaaaaagagaaacttgaaatttgggctcatcagtggctcagaatctcactcttctaaatatgaagttaacctgaccattgtgaaaagccatagcttggaacagaagaaactctaattaaacagagtctagtaaaattaaa

SEQ ID NO: 241535 - DNA, 399 bp, Homo sapiens
caaaagcaaaagaaccatcttgctgacccctttcacccacagatttgtgaaacataataaaaatggtagttatttcaatccacttactacttgcgtagtttgttgtaaaacaatggacaacgataacatattaaaagaaaaaaatgtataaggttatctttaagcttacagagaacccatttggaaaaaaaatctacatttattcatgattttaaaaaattctgaagcaaaacttgggatcagagagtagagttaatttccttcatctgataaaatccacaacaccccattataagtgatagcaaatccccattttgagatcaagataaagacaaaaatgcccactattaccactttttatcagaattatactgcaggttccagtcgctgcagtgaggc

SEQ ID NO: 241536 - DNA, 1997 bp, Homo sapiens
tgaaaaagatttgaaacagttggtttggacaacagctgagtcacacaatgactgtgagtgaaaagcaaaaactggttctgtgcccctcacagttctggttttgtacatcatgtggtctagctatgggctgtacctcttgcacaatatggagaggacattcagacatcttcaactgctcatctgcccctacggaccagacaggcttgaaactataggaagatgcatttgacctttcatttttcagttcagtagaatttaatatggactgtcagccgctgcggtgatcatggaagtagacctaagagaaaaaaacttgtgcaagttcacacgtggagtagtatatgaccatggtttcagagaactgaagcagttctttttagattcttcaaattaaatgtctccttggtgtatttaaacctgctgttactcacaggccaggctccaccaagctttcctacacacttcttcctgagctgtgaccattctcctgagcaagaggctgcagccagcctgggctggcgggcccatactgtctctcataggcattctctccccttgacctttcacctccgtaaattcaagagggtgaaaggaaatagagtgcactgtcaaagataattgggagagaaacacgaaaaggcctcgcagtggggatcttaaattatgagaacttgtgttttctgtgttgtgcctgctcctcattggcgtggatggttggtaggggcattctgcccgtagcgtctgaagtggtcttttggaaaagatttggccccttcatgttgggattccaggacttgccttcatcctcaggttaatattctcctgtgattgttacaagctctctaaggcatagttgcatttattgccttacagctgcgcagctgccgcaccgtccagataggtagtttcacattctcaggtgggtcagatgaccttgttagcgacttgacagacatgtcctggatgctctttgttcccaggaggctctcaggtcctcccccagggtcctgtcactcagccacctacagggatggggagacagtgaggctggctgataagccataaagtccttgactaatcctggtttcctggttctcacacagtggtaacaagggcttgcagccggttgtcagccaacagactgggaagggtggtgcttcttacaggccctgataacaggagaagcctaaatgacaagagaagagacagggaaagcataaaaggcaggcagattttcacaggcacagcaattgaaaatgattctgtttagaaggcagacattctcccacacccttgaggcccagggctcactgctggtgtacagcatgaagtggacaggagagttgattcagtccatgaacatttcaggaagttagaagtctatagttgtggattgcaaaatacatatctggcctgcctcccatttcctggctccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctca

SEQ ID NO: 241537 - DNA, 591 bp, Homo sapiens
gtctttttgtaccctaatgagttgaccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctcaaa

SEQ ID NO: 241538 - DNA, 353 bp, Homo sapiens
agttccaaggcccagaccttcttccttttggtttcccagaagccagaagaaaagttcaatagaggcccccgtgtggtggctcacacctgtaatcccagcactttgggaggccaaagcaggcggatcacttgaggtcaggagttcgagaccagcctggccaacatgctgaaaccccgcctctaccaaaaatataaaaaattagctgggtgtgatggtgtgcacctgtaatcccagctactcgggagtctgaggcaggacaatcgcttaaacctgggaagcagtggttgcagggagccgagatcacgccactgcactccagcctgggcaacagagcgagactccatctcaaaaaa

SEQ ID NO: 241539 - DNA, 383 bp, Homo sapiens
tagttctttcttgactaattctagctctgttcaaagtcactcttaaagcaaaaataacattaaaagtaaatatttttacatgtaaagacaaaggtagttttgtaactttgttacaccgtgtatttgttcagagggctatttcactgctcaatgaagatcccatagtggcttaaaggaaatggagatgtaccccttttccatgtgatcatcccaaagtaagtagtttatgactgacacgatccttccagggtgttggggaaccaggctctttcagtttcacactttgccatcctgaatgcataacttccatcttgcttaggttggcagctccagactccatctctacgttgcgttgtctaaaggtgacatagccagggcttgtc

SEQ ID NO: 241540 - DNA, 2029 bp, Homo sapiens
tgctcctccttccacctctccgattccacctcctcctcgcaccccgctgggaactcctccaggggctgagattggattcaccgagcctggtgagaatgactcaggagtggttgtccgagggtgtgcccctgcggttcctgtccgagtagtgttcacgcgtgcccagtggtggccgatggggtcacggcccctctccccaccccaggcgcgcggcgatgggatatgaaccagtcactgcctttgtgctttcctcctctctccgctgccccggtcaaccagcggagagtggggaactgcgggcaggtcggcggagttagatggcagcaaaggtgggccggcttggtgtgataaagttccaactgggtccttccgcgagccctgggtccataagatgtcatcggcgagcgctggacttgaccgtcaacttgggattgttaaggtaaatggtgtctccttctgtcgccaaggcggtggcatggtctcggctggctgcaatctccacctccttgcttccagcgattctcctgcctcagccccccgagtagcagaaattacaggatttgtcgctgatgccttacttcattcactttgtgaggtcatgttttcctggatggtgacaatgctagcagatgttcttcagtgtctggacattaaaactttggcatgcagcaccacataagatgtgaaaaaaagattttttttaaaaaaaagatgagcattaattgtagacttcactgtgtggggttattcgtagctatctttcttgggaaggatttccacatatttgaaaagaacccagagttgatctctgcaccacgccatcactgctggtggtgaggaaatggtgcctctttcagtgatatgaagttaaaaccaggagggaagatcagtggagccttctttctgccatcttgtgttacctttgcagccaagaatcagaatgaagaactttcaataagaaaagctttcagaaccaggaaggacgtagaagatgtcctggttctgtacgtttaacattggactgtttcttcaacttaggtgcataacagtgactaatcagggattatcatagataatttgacttggaatatagagttcattcaaatactttatctagacaatttaagtactggctgatttggcatgaaaatctgacaaactattttcttggtattcaattgatttttactctgtttgctgtagtagttttataaaccaatcagtcttcattaaagttctgggaattcttaccctgttcaaatgatatgattctaacgttgtcaaaaatctgtattcaagaatacttctcaggaccttttccatcctttcatgaaactccttaaagatacagtattctataattttgcaagcttgtaaagttttcagaatttgaaatgcctcacaattaagcaatttactgtagaaatgattttaaattttcatagacacagttgacaagaaaattttattatttacaggagtgacccaccacaccaggcctctgaagttcatttaataaaattttataaataaatttatcaaatgtgtcatctttgaatcccagatttttgtgagcctatgctttagattttcccccaactttctctatttatctagttgtatctattttttacttcttcaatttgaaaccttaagtaacttaaaaaaattaacacattttttgcctttataagttttctaatcaaaagtttatcttcacaagtctgtaatcccagcactttgggaggccaagacaggtgcatcagttgaggtctagggattgagaccagcctggccaacatggtgaaaccctgtctgtactaaaaatacaaaaattagcccagtgtggtggtgagcacctgtaatcctagctacttgggaggctgaggcaggtgaatcgcttgaacccaggaggcagagtttgcagtgagctgagatcatgccactgcatgccagcctgggcaacagaacaggactcggtctaaaataataataataataacaataaagaatcatatcttgctttttc

SEQ ID NO: 241541 - DNA, 398 bp, Homo sapiens
tccttctgctgcaaagaaatggtcataattccactaaatatagatactcgcacaccctcaacatataatactatatactcacaggtgcagctcaaattatgactttctagctgagcacagatttagactttctttccttttttagcattgccttgactttgtgactttaaaaaaaaatgctaagcgtattttgcttttttcctatcacaacagctcttgttctgtgggaacaggagggctgcagggagcctggggagaggagtggggaggggcgcgcatgacagcagccagggcctctggtggcagcttctattattcttccctgcactctatttgaagcctggagaaagagaaactgctgggctgttcactgggctgtgtggcagtgggaaaggaga

SEQ ID NO: 241542 - DNA, 553 bp, Homo sapiens
gactgggtgtatcagagccagatattgatgaaaatgcatttgtacatgttctgtactccggactgaattactctgttgccagcaataagccagggcacaaactgttcaagccttgattatcaatatgtgtgcactgggagtaatacatactagtattgagagcagtatccgtgcattctgacctagaatgactttagctgtgggggcaggggggtctcgatgattaatgtgctgtataaataataaacattttttaaatataaaatttttaatatttaacttaaaagacaaacataaaaagtgaaatgctttgtattttgtggttaacgtcccttattatccctttaaaatactgaaattctatgagtttcacttttagtattaccacagtttttaaaacgttttgaagactacatatcaatggcatattaaaatgtttctgtaatgttgtatgtttaataaattctgtggttgtttgttaaatgttatatccctttattctcagtttgattttgaaaattcatctacattaaaaacaaaaatactggccaag

SEQ ID NO: 241543 - DNA, 421 bp, Homo sapiens
ctcaatacaccatccttcttggccttaatcctccctccttccctctgctggtgttcccgcctccatcgctgacccgtcgctgatttttacttccacgtcctacttcccttattcatttcctcagaatgttttttatttttttgcttgtttgtttttttttttgagacaagtcttgctctgtcacacaggctggagtccagtggtacgatctcggctcattgcaacctccacctccagggttcaagcgattctcctgcttcagcctcctgagtagctgggattacagacctcactttccttttgctggccagaaatctgctcccagcatgtggctgtgctggagtctctctgaatctgctgtgattatgggggctgccagactcaggaatcgttcattgttaaactcctttaaatttaattt

SEQ ID NO: 241544 - DNA, 646 bp, Homo sapiens
ggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaaccaatcgtgcaggtattttgaccaatcaaaaatagaggccattttaaggtttttatttaaaatatttggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaaaagaaaagaaattaagtatggcaaattgacagtcattctgtattccatgcaaatttattgcaggatacttttaagtgaaagggatttgtttcataaatttaaattttatgatatacaataataactatttaaaaataaatgatgatttaaaatat

SEQ ID NO: 241545 - DNA, 560 bp, Homo sapiens
ctcagagttgtttgaagagagaggttcccaaacagttttaccataaccttagttcactgaatgttttgtggtagaaacactgactagtaagttcagtaacaatgcatggctcagattgtggaatatttctgatttaaatgtaatctgtagtacttcacacttcagatttttgaaccttttaacctacaatactgggcttcatttctgttatgccctaatctagtcatgctgaatatccatactgtataatggtagatgcaaaccatgtttactaaattagaactacatatgaattacagtttacttcaagtgttttgttttggtaatatagctttgccaccaagcttttacagttttccttgaatgtacagagactttttattctaataaccagattacagttatactatttctaaagctcagctcttattacatcaagtttcagtgatgtgttgaagtaggggaactttatatggcatttcaaaacattttcataatactggaattttatttattgtaaaatatttttgtctttaataaaataattttgaatgaagtca

SEQ ID NO: 241546 - DNA, 369 bp, Homo sapiens
tagaagtatgttacttattttcaaatatttgggaatttccaaatatatgtgaattttctatgaacatttgaaaagagagtatattctgctgatgttgggtggagcattctataaatattaactggcccaagatggttgatagagctattcaggtcttctgcatcctgtattcaggatgatagcgacattaagtggagggaggtgaggatcatatttggatggtggatcatatttggatgttggattatggctttcagtaatgagcttaattattacatttttatacattttaaaaatcccacaaataaggcatgaaccaatggtcagagtgtgttatgagccaaggattatgattgctatttctcagaa

SEQ ID NO: 241547 - DNA, 491 bp, Homo sapiens
atcatttatgccagtaatgatagtttatttggatgataattgaaagtgcaagagactctaataatgtctactttccaatcactttttaaattcatttaaatatattttggagaacctactgtgtgccaggtattgctcggagtgctaggggaagagacaatgaatagaacaatcccctgattttacaacacttacactctagtggaagaagggagacaataagcaaatcaatgagttaatatatcatatgttggatgatgaaacgttatgaaaaaataagttatggaaaaacagccatcctgagatggatcaagtggtgaggagggggtgctgaataaatgtttatataggatgatatgtaaaggtagatatatagacccaaaggaataaatggaagggagggcatgagccatgggaataactattatgaaaagtgtttcaggcaataccctgagatgggaacatatgtgatttgttaaagaatagcaaga

SEQ ID NO: 241548 - DNA, 1911 bp, Homo sapiens
  misc_feature (892)..(892): n is a, c, g, or t
  misc_feature (960)..(960): n is a, c, g, or t
  misc_feature (1461)..(1461): n is a, c, g, or t
  misc_feature (1625)..(1625): n is a, c, g, or t
  misc_feature (1821)..(1821): n is a, c, g, or t
ttattatatgcaaataatattttcccgccatcgttatggaaaattctatattttgtcaacgttcattttcttctcaaaagccttttgttattatttccaaatgaatattatgtgtgtctcagacaaccacagaaagttttgtttttgtcacattctactgctactgtgtcaatggcagcattttgatataggtggagggatgctcacatcaaccccataatttgtgtcagcttctcctgaagttatcagaagcatacaatttaagtaaaaacagtatcttcgctatccaaatgatgttccaaggtaaatctcctcagatcccttccagtacatgtatgctccaaggcctgctctatgtagaacttttggagccatcaacgtactgcttgaggttgctttgaacaaaaggtatttgacataagctctataagatcagggactcttttttattttattcattgttctttatcttctagagcaataatttgcaaaatgactatttattgaataaactaggacggaggtgaaaaggaaagaacagctcatccttccaaggggaagagagcagtatcccaaatccaaattgaagaaaataaacatatatctattcaccagaagagatagaagggagacagggcagaatttctgtggttcttactatctctgtcacctctacaggccaaaccagtgaggaccttggagactactaatatcactggatttgtgaatgagttcatcctcttgggcttcccctgccgctgggagatccagatcctcctttttgtggtcttctctctcatctaccttctgaccctcctaggtaacacacccagctaatttttgtattttttagtagagacagggttttgctatgttggccaggctggtctcnaactcctgaccttaaatgatccacacacctcggcctcccagagtgctgagattacaggcatgagccancatgctgggccaaaagaagtttattgctcacttaaaatctgaatgggtgctcctgattggcaggttcttcaagtgctgattctggaattcaggacttctctttgacttcatcatcttcataaatgtctttcaatgtcattgtgctcaatggtatcaaaaatcatcaaggcccttgtatgggtagggcctgaagtgttgcacagcagttttcattgttttctctgaactagaactcggtcacatgaccacacctaactccaaaggggacccagaaatgtgatctacacttgaaaaagaggaaatggatttgtctttttcacacaattgatatcttaacttctgagttgactaacatctaccttgtttgatctatatgtggagaaaaagagtttataagaaataaagatgggtagctctgtggatttctgggcataagatccttctggatttagtgggcaagatcttcaaactgccaattgggcaacatggatgaaaaatttngggtcttgtgaataatttaaaaagcaaagaaaaagaaacttgacattttggagacaaacctgtgtgagtgttttattggtacaaacgtatttaacactaggggttttgtacaattttttgccttttctactagaaaacaatgtaaagtgatttcacaatgtgangagaaaaaaaaattgccgctgtgaccaaacgcacagtctgttgtgcagcaacaatgggcttcgatcaactcagtcgtgattcagctgtagaaatgcttttccttcaccttgtttgagcttttcctttctttcctgttttgatttgcaaaagaaaatgtcttttttgtgtgaacttgtgttgtactctgtagaaaantacgggttttactttaatggtttaagaaaaaaagcaagaagagccctcgtcgcttttcttacctcatcacagagtttgtgtagtgaattt

SEQ ID NO: 241549 - DNA, 607 bp, Homo sapiens
tactttgtctttcatagactgctctttaatttggtaaagctctggtaaattattttcttttagagagttcttagaggcttctgttgtggagaacattttgggtatatttcaaaacagttacttgtccgaccagaaacacaaggtgatttttttggtctaattttggtcacttcctggggctttcaaagagctgtggggtttgtttattttttgaaaataaatatgagttttctcctggaaggtcattccacagaggcttgttctaaacaaactctttttccagaatctagaacctatacattgaaattaaaaatgaaattgaccagttctttagacatacagtcctctgactctgactctcttttttttttattagcaaattgaacccaaagaaagagaaaggtgatagaatatagatcagaagaaacaatccacaacaatagaaatgataaaggagtacataacaatagcaaagacgcaaaagctttgcacgcagcatggttatgggtactattctactgaagataacaagaatcttgaatttaaatcaaacaaataaatgataatcaaaacaaaacaaaaactataagcatcactgagcagacaa

SEQ ID NO: 241550 - DNA, 512 bp, Homo sapiens
gcattctcttaaaaagagaaaaatgagaagctatctcttctctcatgttaggaaagaggttgggtgggggaggggcggtttgtgagatcagggagttgagtggtttccaagagaagctgtgtaccctgcccctcagatagaggcccaggaaggcggcaagcccacaaagagagaagggctgcttggagggggccaggcttatgaagactgtgataggccatcaagggaatcaagaaagagcctgaaagagcctcacttaccagactgacattctatgtggaccaacggccagcgaccaaaaaggttgatatctactgacacaagtaagccaaagaccactttcttctaccctctctgctgaagaaagcaagaaacttgatgaaacaggaggacttggattaaggcagaatgaaacataaacatataaatttccaattgggttgaattatttacaaatatatatttattaatctacttgatttgtagaataaaatttatatatactccctggc

SEQ ID NO: 241551 - DNA, 425 bp, Homo sapiens
acacaggctttacatctacttgcttgcattatttagcaggaattgctttctgcgagaagctaaaaattgaagatgtcccgaacacagcgttcatactgtgagctggatctccttgtagggcttcaggcacagagtgttggatgcactgtgtgatgaattggacacgtagcatggcagtctgctcatgacacagagggtgggtggcttagtcatggctgaaagcaaagcagcattgttgaacagttaagagaaatgaacttattcacatcattggagggaaaaaagctttgcttatgttaagcagcgaagattgttatcatataattgacctttggggtagacaaacactttgaatatttccccgcaaaggcatccacaaagcagttataaaatgtagaatagagtctgctgccaagggtgttaaa

SEQ ID NO: 241552 - DNA, 479 bp, Homo sapiens
gcacgaggttttgagagccaattcagttataatgaatggttttaatttactttatattaaagggtgctgataaataatgttcaattagcattctttgggttctgagttaaatgctatgaaactcttatggtattggagaacataaccaataattttcaggggactaaattaaatattcaatatgtttaaaaatgagggccaggtgcagtggctcacacctgtaagaccaaaatgggaggactgcttgggcctaggagttcaagaccagcttgggcaacatagcaagactgccttgacaaaaatttaaaaattagctaggcgtggtgatccatgggtgcctgtagtccaagctactcaggatgctgaggcaggaggatcaaggctgcagtgagctatggtcacgccattgcactccagcctgggcaacagggtaagaacctatctctaaaataaataaataataaaaaataccaaaaata

SEQ ID NO: 241553 - DNA, 518 bp, Homo sapiens
aacatatgttgggaatttggatggggaaggatgtagaacagattgctttgagacagaaaataatgcaaaaagatgaagggaagtgaatacacagtaaaaatatgttagacaccaaagattagcttcacttacactgcagtttttgtgggcactttgacacttagaactcacctggctgttgctgtacagcaagagaccatgtgaactgaagcattggttagacctatacatttctacaaaccgctctagccctagttgaacttgggaaaataaatatctgtatgaaaaagttgtctagatctgttacacaattactatcttgtttaattgtagaatgcatgaaattggttgtaaaatggcctggttaagagtctcatgtcagggccaggcatagtggctcatgcctgtcatcccagcactttgagaggctgagatgggaggatgagatgggagaggctgagatgggaggccaggagttcaagaccagcccaggcaacaaggcaagaccccagctctac

SEQ ID NO: 241554 - DNA, 183 bp, Homo sapiens
ggagagttaagattgtggatggaattaagattactaatcagatgatcttataatagggagattatcctggattatcctggtgggcccaattcaatattttaaaaggtaggcaggaaaagagagggaattgtgactaaggaaactaaggggcagtagtcagagggatataacattgcgttcttt

SEQ ID NO: 241555 - DNA, 155 bp, Homo sapiens
aagccagagccctgggctgtcctggacggccagcagggggcttgctggcatgaacccttcacagctgagcctgtcagggtgagggcgtgcacaaaaaagtatccacagatgttgtgcagtagaaataaagaaacattctaaccttttaagacaaa

SEQ ID NO: 241556 - DNA, 497 bp, Homo sapiens
agagatgttattcttccctgtttgcggtacatggaatgtgtagaagaccatattcggaaacacagactatggagatgcagaggccttgagtttgaaactctgtattcctgtttcttcgctctgtcattagtgatatgttatccaactaactaactcagttaccagggaatggttctgtggtagagtctgtgagagggcataaaagaaatctctgctggctgggtgtggtggctcatgcctgtaatcccagcacttttggaggctgagatgggtggattacttgagcccaggggtttgtgcctggccaaggtagcaaaatcccatctctacaaaaaaatatgaaaattagctgggcatggtggcacgcacctgtagtcttggctactcgggaggctgaggtgggaggatcgcttgaacttgggaggtggaggttgcagtgagctgagatggcaccactgcattcaagcctggacaacagagtgggactccgtctcaaa

SEQ ID NO: 241557 - DNA, 339 bp, Homo sapiens
gagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacctggaggggag

SEQ ID NO: 241558 - DNA, 382 bp, Homo sapiens
  misc_feature (353)..(353): n is a, c, g, or t
gttgagcaggctgatctcgaacacctgacctcaggtgatctgcctgcctcggcctcccaaagtgctgggattacaggcatgagccaccgcaccaggcctgtgtcctgatttttaacattaaacttgaaagcagtggttaatgtagtctgaggactctcctggggatcccgagaaccttttagagagtacgtgagattaaaacagtcttctagcagtgttttaagacactacttgccatttttctttcttattcttagatatacaatggagttttccagaggctgaggcaggagaattgcttgaaccggggaggttgcagtgagccaagattgcgccattgcactgcagcctgngtgacaaagcgggactccatctcaaaagc

SEQ ID NO: 241559 - DNA, 717 bp, Homo sapiens
taggccccacttcccaacactgccatattggaaattaaatttccatgtgagttttagtggagacgacaaaccatatccagaccacagcagtacttttagtacttgctggtgagtaactaaatgaccatatccaaaaagagtatgcttttgtgtcaatctgtctctatcctagaatgtcgtttagttctttcatgttcaaaattttatgttgaactggataaatcttcagtttttcagatgacacatggctggaatggataactaacttatgactgaagggagtcaaggttctaaattatcttgattgggtatatataactgggctgaaaccaaaaaatgaaacttaattggaaagctgtgaagttttacttaggtatgagaagtcagttacacaaatacagaaatgggagtatctgatttttcctttgaaagggtctagaaatttaacacaagtctaatgtgaatcaagaacttccaccttttcataggattataaagctgaaagagaacatttgaatactagtcttctcatttacaaacaagagaatgtaatacatcttttatgtatttcttggtagttgggtgatcataaatgccattaaattcacctttaggcatgtgtgaaaagacaattgtgataatgacattccctcattttacaaatcctttggtaaaggatatataacccttccaataaaataacatttttaatgcaaa

SEQ ID NO: 241560 - DNA, 407 bp, Homo sapiens
ccgtttgtgagagaaaacctggtatctggcttctgacgtttcagtacaatcttctattgtgcatctggatgacatcactgttgtgtcctttgcagagatgtgcatacagggccctaactgtccaggagctgctacggacagagcccggtaatcccgacgacttagtggatcctgtgcctcccaagggtggcgcccacggtgactgcacacttgtcacagactggcaggccatttgtctgctgcagcccaccaaatcccacagatccttttggatcctttgcagcaggcttttcataccttgagtcttacttaatgttcacatgaaaaagcaactgctgtttgctgtgctcataaaagtcttgttagaaattaacaccttgtgtgaataaaaacatcaagtaagtatt

SEQ ID NO: 241561 - DNA, 421 bp, Homo sapiens
ttgtatctctcctccccatattcaaacacacacacaaattcgtatgctgaagccctaatcccccgcgtgaggtcatgagggtagggctcctgtgatgggagtagtacctttataagaagagacaacacagagcttgctgtctctttttctctgccttgtgagggcacagcaagaagacagctgtctgcaagccaagaagaaaggcttcaccagaacccaaccatgctggcaccccaatcttgaacttacagcctccagaactataagaaaataactttctgttgtttaagctatccagtctacggcatttggttaaagcagcccaaatgaatatagtgccacttgtaattcccagtgtagcttacttttagaaatacaacgtataatacttacttttgaagagccacactaaaacttgtgg

SEQ ID NO: 241562 - DNA, 367 bp, Homo sapiens
ttgtatctctcctccccatattcaaacacacacacaaattcgtatgctgaagccctaatcccccgcgtgaggtcatgagggtagggctccttttctctgccttgtgagggcacagcaagaagacagctgtctgcaagccaagaagaaaggcttcaccagaacccaaccatgctggcaccccaatcttgaacttacagcctccagaactataagaaaataactttctgttgtttaagctatccagtctacggcatttggttaaagcagcccaaatgaatatagtgccacttgtaattcccagtgtagcttacttttagaaatacaacgtataatacttacttttgaagagccacactaaaacttgtgg

SEQ ID NO: 241563 - DNA, 322 bp, Homo sapiens
ttgagagagtatctcattcctgttgcccaggctgcagtgcagtggcacaatctcagctcagcacactgcagcctcgacttctcgggctcaggtgattctcccacctcaacctcctgagtagctccaaatgcacatcacacctggctgatttttttttgttttagtagagacggagtttcaccatgttgcccagtctggtcttaaactcctgggctgaagagacccacctgctttggtctcccaaagtgctagaattacagatgtgagccaccatgcccagtctcttgtgttttattctggttttgttatcagcttactgctg

SEQ ID NO: 241564 - DNA, 487 bp, Homo sapiens
caaggaaaataggaaataacaaagtaactaaatttctcaaagcatgcagaaggaaactgaatgaaagctggtggtggggacagcagagaaccaacgattttacactcaggtctcaaaagactaggaattggtggcttcatttcttatctttagaattgggtggtgcagaaggagggagccaaaatggaataagttgaaattatgtttaagaagcaatactcgccgggtacggtggctcacatggaggctgaggcgggtgaatcacctgaggtcaggaattcgagaccagcctggctaacatggtgaaaccccatctctgttaaaaatgcaaaaattagctcggcatggtagcatgcccctgtaatccagctactcaggaggctgaggtgggagaactgcttgaacccaggaggtggaggctgcagtgagccaagattgcgccactgcactccagcctggacgacagagcaagaccccacatcaaaaa

SEQ ID NO: 241565 - DNA, 512 bp, Homo sapiens
gatttattcattctgtcagtatgttctgagatgcttggaactggagacagagaaatcaagaaaaggctgtagccaggcatggtgtcacgtgctacttgggaggctgaggagcagggatcacttgagcccaggagttcgaggctgcagtgatctatgatcatgagactgcacttcagcctgggcaacagagaggacaccatctctaaaaaaagaaaaaaaaaaaaggaaaaaaaaagaagtggtcatttgtccagtgtaataagcacattcttagaagtgaggcttgcaagaatgcggagaagtgagctaactctacctggtggcaaaagaaacgcttcacaaaggaagtgataatgcagctttgaaggtttgaagaatggggaaaaggaggaatgtgtggtggcatttcaaatataggatactgtgcgagatcacattattgtttccaattacttgttccatctccctgtgacaggtttatatttccctgccccatttaaggtcaattttgg

SEQ ID NO: 241566 - DNA, 140 bp, Homo sapiens
agttggtggatggaggcagtgaggtcagggccaaaagttctggttcatctgtaacaaccagcacggactctgaggcacctgtatatgcatgagaagaacctgctgtactatagggaaataaatgccccacttgagttttg

SEQ ID NO: 241567 - DNA, 413 bp, Homo sapiens
aaaatcatcctgttgcaaggattacttaggaacagtagcgaagttggtgagcatctccgcattagtcaactttgttcaactggattcacaaacatttccagagggcattctcagtcaagtagccctacaaaccattcatggcacgccaagcagctcttggaagtgcccatgttaacatgtgaccatgagtccttcctgtctgtattgctaacgtgtgatcatgagtcctgcctgcctgtattgctgacgtgtgatcatgagtcctgcctgtctgtattgctaacgtgtgatgactgtctgtctgtattgctgaccaacttttgaatggaaattggaaggagcatttgccacctccttgatgacttaatttcaaacattcaatacaagtaaaatattttctagtgctaaatgtg

SEQ ID NO: 241568 - DNA, 296 bp, Homo sapiens
ttttcttttttttctttttgtagagaaggggtctccctacattgcccaggccaatctccaactcctggactgaagcaatcctcctgcctcaaccacccaaagtgctgggatttcaggtgtgagtcagtgcactcagactcacttctcttaagttagctctttctaccaaaaagaacacaagggccgggcttggtggctcacgcctgtaatcccagcactctggaaggtcaaggagagcagactgcctgaggtcaggaatttgagacccacctggccaacatggtgaaacaccgtct

SEQ ID NO: 241569 - DNA, 704 bp, Homo sapiens
ccagaagcatcttcccaaagaaagatctgaccaaggaactccccagcttaaaacacttccatggctcccagtacccttggagaaaactctgatttctttcaggctctgctccagcatcacctcttccctctctctccccacaacccatgcgtcagccacagctgccttctttttggctcctagactataccaagcccattcctaccccaggccctttgcacttcctgtttcctctacagagagggtccttccccagccccttactcgacctttccgtcattcagctaacatctccatgactttgtctatactcctaccacccgatcactatctctttgtctcagcattttcactgtgaagatgtctccctgtgtgctttgtctatttggccgctaggctgccagtcccacgagggcagggacttctgcccacaacacaagtgtctctcaggtcctaacagagatcctggcccaggagagtcgcaggcaagacgttcaacaaactcctcccttcagtcttccttccgcagcaaccctctcatagggatatctgaaggctggcgaggccaatgttttggtttgcgtggcctttccctagttgttctatgtgtttgctcatctccccagaacgaggccagcattgcagcatctccagcacctaaaacatttgctactaaaccattaaatatttgttaaacaaataaa

SEQ ID NO: 241570 - DNA, 455 bp, Homo sapiens
cattctgcaaaatggttgcctgaacacctgctatgttggacttgaactcactaccaccccagatgaccaatgaatggctaagagaggtttgaatgttttgattaggcctgttaacatgtgcttagtcttccctctttctcctccctctcctcctctcaccttctatcacttgacttctgacacttgcctagccctggatggagggactcccttgtcttcactcaagaaagggcaagctcagtagctcagcttgaggctgttcctgcatcttcaagaaggagcccaaggccgggaggagcttcctctttccctgaactaactcagtcagtgataggccctggtaatttctctctctctgaaagaaaaagaaagaaatgaagaaaagagaggaagaaagaaagagaaagaaggaaaaaaagaaagagaaaaaaaggaaagaaagaaagaaaaagaaa

SEQ ID NO: 241571 - DNA, 507 bp, Homo sapiens
tttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccga

SEQ ID NO: 241572 - DNA, 531 bp, Homo sapiens
gaaatacattctcattgctttggagaccagaagtgcaaaatcaaggcattggcaggcccttgctccctctgcaggctctaagggaagagctttctttgctgcctccagcttccagggaccccaggcattctttggcttgtggctgcatcactctagcccctgcctttgtctgcgtgtgaccttctcctctgtcttctccccttctcgtctcttaaacaacacttgttgccatgtgcagcagggcattcctgtagtcccagctactcgggaggctgaggcaggaggattgcttgacccaggagttctgggctgtagtgcactgcaccaatcaagtgtctgcactaagttcagcatcaatatggtgacctcttgagagcaggatgaccaagttgtccaaagagggatgaactggcccaggtcagaaatggagcaggtcaaaactcctgtgctgatcagtagggagatcgtgcgtatgaatagccactgcactccagcctgggcaacatagtgagacctgtcactaatttaaaa

SEQ ID NO: 241573 - DNA, 762 bp, Homo sapiens
gaactggcttgctggctgattgtggtaaagtaagaagtacttaatttagtagaaagtttaaatggcagacataacattaaacccagctgatttataaatgaagcaaaagaacaaaactcattcaggataattggttattctaaaatacagtcatttctaaaattatgaagtgttcaggacctttgggagtgaaagaatttgctaaagaaggatcagtgaaaaaaaggaatgatgggtgaagagctgtggagaaggaagagaagaaacagcacaaggaaggaagaatataaaatcagatgtgggaatccaggggaaagtgcaaacgaagcaagattgagaaaattctcaagtttttataaacagttctcacactctgccagttccttggaggtagacttttttgttaacttccaactacagtagtgaaaaaaaaaaaaaaaccctcaaatttgcaaaagcagtctgtggaattttctttacccagctttcctgactgttaactttttagcacacttaactttatcattcgtttattctctctgtttaaaattaaaaatgtaaattttaaaaagtaaaatgtttgttggttacaaacatttatacccctttgtctctaaatatcatttcattttaaaaaatgaataatctaagcctacacattctaaaatgtgtatattttctaaaaataagggcattctcttacataaccaatgtcacaattatttgatacagtgatcaaaatcaggaaactaacattgatat

SEQ ID NO: 241574 - DNA, 489 bp, Homo sapiens
cagcactgatagttaagtttgggtgaataaatgtgaacaatgactccaatgccatagaccctcacgtgtttgttgcattaattggataattcaaaatataaagtattatccagtttcaggataatattaagatctaaaccaatgaatgctctatgaaaagttgtagattaactgatcccttaaaactaaaaacagcgtcttcataagcttctactgggggcagctaccactttcttcatcacatttcttatcctcaatagctgtgggcaatgccaaaatagctgtatgatcaacattaataaacaacaccagggcaacagccagacacaaacctaaatgaagaattaaattgtaggagaaggaggaggaagcagcgatggcggctgctgcggcggttgcggcgggggccggggtgggcgccgcggtctgggccgggcagtgaggcacgggcggccgggccggtgggctgggcggcgggcccggcggccg

SEQ ID NO: 241575 - DNA, 1036 bp, Homo sapiens
gcggccgcctgtagtcccagctactggggaggctgaggcaggagaatggcgtgaacccaggaggcggagcttgcaatgagcagagatagcaccactgcactccagcctgggtgacagagggagcccactccagcctgggcgacagagggagactccgtctcaaaaaaaaaggaaagaaagaaaggagaggtatctggggagaaggtacagcttggggtgtgaccgggatgagcaggggctgacagaacatgtccccccacctctcatcttccagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaaaggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccaggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgccagggcaacaaagaccggaggaagactcgtaggagaaggggtggtgttggggaactggaattgaagggcgaagcttggagggagccttaattgcagaaacccggggccccgggcatgggacccttgggaatgccggccagtccttaccggccttgtccccgcgcccgattacggggtaaccacgcgcggtcactgcgccg

SEQ ID NO: 241576 - DNA, 124 bp, Homo sapiens
acattctggataatattatctactcccatgacatttcaagtggatttacttgtgtaaatgtgcacatgattcaaagcaccaaatatctgtttggtcttttcaataattcttcctgggtagctat

SEQ ID NO: 241577 - DNA, 427 bp, Homo sapiens
ggtgctctttgtgccactatctttccaatgtcctcatcgaatgtgtcaattctacttgaggatattggctggatcttgcttgcggggtggatcctgtggtctaagttggagagggaaggaaatagcccaagcttgatgacaggagcgggctggaccctgcaggaaagcagaggacattgggtctggaagtcacaaagaagtcaacgaaacaatgccttagaagcagctgagtgagaaaaatgaaaagcctgaagaaaggggccgacctaaacttattcagatgcttcagcattttcctaatattgtcatttttgtggctccatgtgctctctatttctgtgagtatccctaccaaggaattaatatagaatcctgtcagcagaagtgggtgaggcaagagtatcttgtcaccttccatatgttttgg

SEQ ID NO: 241578 - DNA, 437 bp, Homo sapiens
taagacgaaagcagcgtagaggctgtcagttaaaaagtgggactggaggaaagatttttcaattagaaatggggaggagagcgaacagcttaagagtagttagaaataatacctggttgactagactaggtggaaaaagaagcttaataaaagcaaacacacacacacacacacacacacacagagtattataatactattacctattatattacattatattattgtagttctacaggaactacaaggaattctactgtgaattccttaagggtgggatacattttacaatcatcactgtttctctcattagttgtggaatcaaaaaaatgagtgcacgatgaaaaattattcaaacacatacatgctttcattccaattgaaaatgtaaaaatattactgttaaaacaatattaaaggacatgtaatacaattca

SEQ ID NO: 241579 - DNA, 573 bp, Homo sapiens
taattgttagatgttaggggccacaatgctaactgtgctttgaacagaaacacagatttctgccacaatttatatctcaaatgcatagttccctataatttagactaaaagattataaatgacttggctttcaaatatacatggtgacattaagctatgtgacagacacaaactatactccaattgtgaagtcagagtgaccatgacagtctaaaaaggagccaatccagagacctaaaagtaacatttttaacaaaaaaattcaattaaatttgcactttacttttatagattctgggtccattttttggagaaacaaaacccagcaattttaccttgatgttttttaactaaatccaatcttcattcctgcttttatttagagggtgggaaatcaagtttatctgtggtaaaatctacctctgtgtagttgtgaaaaggatgcaggtatcaatttttttgttgcgtttgtttgatttttgagacgtagttttgctctgtcgcccaggctgcagtgagctgagattgtgccactgcactacagcctaggcaatagagcaagactgtctaaaa

SEQ ID NO: 241580 - DNA, 665 bp, Homo sapiens
gtcactccactgcactccagcctgggcaacagagcaaggctccatctcaaaaaaaaaaaaaaaaaaaaatcaggctgggcttggtggctcatgcccgtaatcccagcactttgggaggccaaagcaggcggatcacctgaggtcgggagtttgagaccagcctgaccaacatggaaaaaccccatctctactaaaaatacaaaattagctgggtgtggtggcacacgcctgtgatcccagctaccagggaggctgaggcaggagaattgcttgaacctgggaggcagaggttgcggtgagctgagatcccgccattgcactccagcctgggcaacaagagcaaaactctgctcagactttctgctcatgatatgtggaatttttttgtgtgtgtgccaaaatatcatgttgaaggattttttgacaaaccaccaagcctatgaaatgagcttttattttgcagggtcaagcagctgtttgaagtgtaatgtttggacaggcctgaaatctacagcaccaggatttttcctacataaatcatctttggtatatttgttttctgggtgttaaatcaaaatagtaacttgatagtcagtttattgtgcctcctaaaattcacacagatggtttttgtcccccccgccatcaacgaaagccctaagctg

SEQ ID NO: 241581 - DNA, 618 bp, Homo sapiens
aatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgt

SEQ ID NO: 241582 - DNA, 380 bp, Homo sapiens
cgcataaagggaacgggtggggacacagggcccctgcagcctcaggaggatcagcagtggcctggtttactcgtgtcgtcattcgtcgtgggcaccttgtccccggggccggccagttacttggcctcctggctcatcatcctgccggaagcatctccagcttggggatgttggagggtccctggccccacctggctggggatggagtgtaagccgaggagatgccatgtgagggtgcagcgaggagttgggctgtctaaaagcaaagaaagagattgcatcagacaccgcatctgctgacaccttgttcttggacttccagcttccaaaaccgcgagaaataaatgtctgtgtctaaaccccaaccctaccacctcaaa

SEQ ID NO: 241583 - DNA, 412 bp, Homo sapiens
gcagcaataagttaacttctgttaaatccgagtaagtggtacctaattttctctatgttcaaaatattttataatttaaattaagaaaaaaaaaacctaaacttgtagatggaaatcattagattaaaggagtctttcccaggggtgggtatagtaagccccttacagaggatgacttgatgactttctatagataatagatgttggggggttgcccacagcacccagagtcgtctttgcttcacacaaatctgaccatatttgttccctgcttaaaagctttccatggctccccatgttcttcaggataagctgatgcccttttggcctggcaaacacagtccttgaggatggttctccagacctcgggaacagcccctcccacggctcccaataaaaatgtgaaaaccta

SEQ ID NO: 241584 - DNA, 390 bp, Homo sapiens
cgcaaaattcacacagtgggttggaggaggagtagttcctccagaacatgcaagggttttggatgctgagtaaccccaaaaccaaccccaccaaacatcttcatggagggagctgaagctggggcgtttgttagaaacaacttcgtgggcccagacataggcaggaaccaagatgtgacagggggaaaagctggggtgttgctgccatctaccttcaaccattaaaagaggaacatctcctctgagcatcagagtgaattcaagtggcatagatcatctctgccacaatgttctttccacaattacaagaagttgtctttgaagaggaagatgtttgcagatgattggttttgctcatttagaaagcagtttcctttaggtaatcctgac

SEQ ID NO: 241585 - DNA, 381 bp, Homo sapiens
agccggggaggtggaggttgcagtgagcctagattgtgccattgcactcgagcctggacaatagagtgaaagcctgtcttaaaaaaacaacaaaaaaacccacaatagcttagattgctaaagtagtcctcagttttctatattctgaattctgtgtatcagggtttgaagaatagaatagaagttattgacataaatgagttaggtttcataggagaaaagttaattttacttggtgtattttctactgaataagtttcatctgtgtatttgtgaatatttattaattataaactgtgaccaagcactatactaggtattggggatataccaagtcaaaaagttgtgcctcacctggagtttacattcagttttgttaaa

SEQ ID NO: 241586 - DNA, 480 bp, Homo sapiens
gggggaagaggtcggggacagaaaggggaggcctggggctcagagaccaacgtctcatgtcttctaccacatggccacgtggctcgccccttgactcactctggtctctgctcgaatgtccccttacatgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacggtgcctggcacatcataatttctcaataaacgatagctattattatgatcag

SEQ ID NO: 241587 - DNA, 466 bp, Homo sapiens
cggtagaatagggatattttcagacagaaatgcaaggtctcaaaaattagcctcctctgcacccttttttgggaagtttctggagaaggcactatgctgagtacgtcatgaggactctataagacaagcctttctgtgctcctcaggtctgggagacaaaggcttcaagaaaccaaacaactgcagggctcaaatggtctcaacctcagagcctgtaatgtcaaccactgcattgactgctaggagaaagggaaatacaagatgtggaagcaacttacaacgtcagaacaaatggacacatgaagtcttaccacgacgcagggattggtagagcagatgcttgcctgtgcagtaatttgaagaatgccagcagagctctgttttcaaagtccccctctcttatcttccattcctgcaggcagagcaaagtttgcaggtccatgaaaccaaacttgtctttctccta

SEQ ID NO: 241588 - DNA, 498 bp, Homo sapiens
caaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaa

SEQ ID NO: 241589 - DNA, 382 bp, Homo sapiens
cgcttgaggatctgatgagccctttcctatgacaaatgagtcacctaacacctgtagtgataaagcaaccctatctgggttccatctgcagtggccacatcctcgtcctcccgctccctgggttccatctgcagtggccacatcctcatcctccaactccctggtttccatctgcagtggccacctcctcttcctctggttctctgggttccatctgcagtagccacctcctcatcctccggctctctgggttccatctgcagtggccacatcctcgtcctccagctgtctgggttccatctgcagtagccacctcctcttcctccagctccctcagcaagttttctgcgcagacatgaaggaagcaatattgcatttctct

SEQ ID NO: 241590 - DNA, 360 bp, Homo sapiens
aatctgcacgttgtgcacatgtaccctagaacttgaagtataataataaaaatcaactagagatggatcatggacttaaatctaagacctgaaactataaaaattctagaagataacattggaaaaacccttctagacattggcttaggcaaggatttcatgactaaggacccaaaagcaattgcagtaaaaacaaagataaatagctgggacttaattaaactaaagagcttttgcatggcaaaaggaacagtcagcagagtaaacagacaacccacagagtgggaaaaaatcttcataatctgtacatctgacaaaggactactaatatccagaatctacacaacaaactcaaattag

SEQ ID NO: 241591 - DNA, 315 bp, Homo sapiens
gcggtgacagatgataaagcagatgaaagtgtccttttatcaaataattaattcactcatcagcatttatcaggtatctgcagtgtgctgaggagtgtgctgcccagagaccaatgggacaggaagagctcctagcctgtttgtgctgagataatgtaagcagtgtgcagtggctcatgcctgtaattccagctactcaggaggctggggtgggaggagcacttcagcccaggagattgaagctgcagtaagcagcgattgtgcctgggtggcacagtgggaccctgtctttatatataaataaataaaaagatt

SEQ ID NO: 241592 - DNA, 383 bp, Homo sapiens
gattctcagcaaaaggactctaaggatgcagaggaagggaagtcacccaatctgggaaggaggtttttattaagtataaaaacaggtcatccacacatagcaatgtgcttttctagagaaaaccatcctactcaccgagagccaggattgagatgatgccttaagaaacacccactccccgtgagggatgttaccaagaagtcaagaaccaccagtaactttgaaaagtccagattactcagtctcgggtatgtgtatcagcaatgtgaaaacggactagtacatctctagaggcacatgccatgtggtccagccataattatttgttgtcacaactaagtttcctttctatatgaaaagattatattgatcagaattctaaa

SEQ ID NO: 241593 - DNA, 1243 bp, Homo sapiens
actgcgcctggcccccaagtgatttttgaaaagcaaattgcaaaaccattttaaaatttaaaactatgtgatcttttaacatctgatactctactaaaatttctttaaagtgaaagcttacaattcaatgtgtaaactactttatagtctgaagtttaagatagtgttgttggatatcttgaaaaatttttataacaatttattgttagaagaaaaaccccatactctattcctagagcagttatcatgggagcaaaaacaaagcacaagaaacctggtatcttaaaagttattttcatgcagaggatcccaatcccccattccctgttaagagtattagagtttatcctaattgattcgggagatggggaagagaaggtacagaatagactttctgctctcattgttgaggttattgctgtgcactaaaaatttttaaaaaaatatttaaagcttgcgccttttaaaaatactcaggtcattcctgtcagtttggaattcagccagggaaatgtgtatttttaaaagcttcccagccagtcctgataatcagccaggtggaggatctgttgatgtgctacagaacagacccctctccagatctagtcagaatctctacatccagacttcttgctatacaccgtctgtttttgattgacaccagacacatatgtttacctcttcgatttattctcgttttattaggaacactagaaaggctttgctttaaactttgtctctcatagggcatgcccttacacagatgtgactttgtggcccagatgctggtaactgggcatctaaatcatctcttagattttgtgcattggacattattttgtaggtgtcttttaaggttacatttttatgaatcagggtttaaagttgtctaaggaatatacattttagtagtaaattgtaaattatagttttaacaaaagatatggcccagaaatgaaaaaaataaattacagcctgtaatcccagcatttttggtggccgaggcgggcgaatcacaagatcaggagatcgagaccatcctggctagcatggtgaaaccgtgtctctactaaaaatacaaaaaaattagccgggcttggtggtgggcgcctgtagtcccagctactcggaaggctgaggcaggagaatggcatgaacccaggaggcggagcttgcagtgagcctagatcgcgccactgcactccagcctgggcgacagagcgagactccgtctcaaaaaaaa

SEQ ID NO: 241594 - DNA, 222 bp, Homo sapiens
agcaaagattatttttcttctgactgcgcccgcctccctggctcttggcagagtgtttgatgtaatggttttcgatgacttttcagggtggtttagtgccccaccattctactctcggactttgtttctgccatttgcaggaaactttaccaaattgctgctcttatgactctgaaagccgccagtaaaacagcttgccgtttttatgtgtaaacactgcca

SEQ ID NO: 241595 - DNA, 403 bp, Homo sapiens
cctatctgggggttattattagccagtttggagtgtggaactacaagtacctctccttcaggggaccaggtgatgggagttaattcctcaacctgcatgcccagccctgcctcttctcctcctcgtttcttctaggccttggctgtctagcaagatggagaacaggggacaggcttagcctaggctcttgcagtttgcagaagtgccccacgcacccactttagcatgtgtgtgacggtctaccggtctactgtcaaatgttccacttcccactgacaaaatcaggagaagctgctcttccggaaactcttagaagttgtctccaaaacaaaacaaagtaaaaacctcatcccctttaggatgagtgcattttcactctggccatgaatctgggaggcacctc

SEQ ID NO: 241596 - DNA, 641 bp, Homo sapiens
atgttttttctttcattaattaccaggtatttcaggctcatcttgcattttgcctgtctcaggtccagaatcaaccatttctccaaggaggcgtcaggaagaattgtgaagggaggtgacaggtggtaaatgcgaagagtttggaaaaatagattgacagtaggcccagtgatgttgatacttttcttgctctgagcacagatgttggcttctgtattcatgttactccagttctgggaaaagattttgtttctaaattcccacgatttagagaaccagatatcaaatgtttgaatacatgacataatcctgaaacaaaatttacaaaaatttaatatattctcaagttagtacacacaaacacttgctgtttttccttggtgtttttgacaacttttttaaagtaaaaagaccacttaaatactatcgtactcagaattaacatttgacattttgcattgccctctaagactcctttttttctatacgggcttccattcccttccttccagggatctttttcacatctttccaggctgttttattgatggggaatttttaaaaatagctttattgaggtataattgacaataaactgcatgtttttaaaatgtactgcctgataatttcagacacctttt

SEQ ID NO: 241597 - DNA, 504 bp, Homo sapiens
gaggtccaggctgctttgagccatgatcatgtcactgcattccagcatgggtgacagagtgagaccctgtctcaaaaaaataaatacatacatacattttatctaacccaacatatccaaactattagcatttcaacaaattactaaaagaaattattttacattcttttttaaactaagcattcaaactttggtatgtactttatacttacagcacgtctcaattcagactagccacctttcaagtgctcagtagccacatgtggctgctggctaccatattagcacaagtgtaagtagcctaacttactgttcctgttctgtacttcctgtgagatccagaatgagggaagctagaaacttctgttaggggggtatctttctcagctaccctgcttccttcccctctcctgaaggaaactttggggatgtccaggttaatagatgtatgatcatatccttagattaataatgctaataattgagcttctactctcaaacaag

SEQ ID NO: 241598 - DNA, 942 bp, Homo sapiens
cagaggttgtgagcctcccctggctcagcctgacccagaaccagctcactcatgaaactaccctctcttgaagagaataggagttgtggggaggaagaacataacccagaggccagagaacgtggaggccagggttggtgtaactgtgtaggctcttccacatactagctgtgtgaacttggacaagtgacttaacttctcttctccgtgtctgctaacagtccctacacagatggttgttgtgaggcttagttaccatacaaaattcttagattagtgcctggcacataataataaccacagcccccaaatgctagttgtcattcattatcttaacataccatgtgaaggttgtgttctcttacattctatagccctctgtgttttaatataaaattgtgatgtctctctttcttttatttgtattttttgagtaaaacggacatttcagaaagatgtaccagatttttatcacatggctttgtgagacccgacagccagccaacatcacacacagtcacatgtgtgcatgcatgagcacacatgcatgcagacacacacactttgagaaggccatgctacgccgggctgcttcccaaatgggctgaaacaagtcctcttgccctgaagaaccgcctgtcccctctcccgcccactcatcgcgctccgtggagtgaggcaggaaagggtgattggctcacagcagcagcatagctcttagtaaacctgacttgggagaaaggcctggctccagctcctagcccaagtgtcagagcctgggtcccagcactggctcgatgccctcttttgctgtgcaaccctggccatgtaacttcacctctctgagccccagctttgtcatttgtgaaagggagctaactgttcctacctctcagggttatgaggatttgacagacacatggaaagtgcctggcacttcgt

SEQ ID NO: 241599 - DNA, 395 bp, Homo sapiens
tccataaattgtcagtgttccctagctaggcaaccccttcctctctctctggctaagaataactttccttgtgatctggattataaacttgtctcaagcaatagatacatagttttcatacctgtgttctttaatctgtacttcattttcaatctcaaaactagcattgtaattgtaaaatgaacataatttattacatttttaaaaaaaaaattgagtatccctgctcctatatttagattgtttaaaaattcagtattttgaaattgtgtttagaattcttaaaagacagaggctggagggctggggctgagggagggtggtgggcctgcggggacattcttactgtgcaaacatagcgataaaaacatgtcattttccaaagcaaaaacaaa

SEQ ID NO: 241600 - DNA, 671 bp, Homo sapiens
gagttattttattagattttattagtggttaactcatcagaatctctttcagatatatgctaacttaatttcacaaaaaattttaaaattgcacctatatagctctgttccatcttcctccttttgtgctaatattgttatacacattatatttaaatatattacaaacctaccaatacattttattatttatataattttatgtctattaaagaagctaagagaatagaagagagtaagcatatattcatagagcttgttatatttccctttctatttatcatttctgattcttttcatttgttcctatagatttgggttaccatctggcgccatttccttacaccaatacaggtttcctcccacccatctccattgtgctgttactgtcaaatatattacatttacatataagcccaataatataattacatacatattattttatataattgcttttttagagttaattatttttattgtggttaacgtgcataacaaaatttaccatttttgtcattattgtgcataattcagtggtgttaggtacatttaaaattttgtgtaaccattaccagtatacatttccagaatatttttattttcccaaaagcaattctgtacctattaaactataactgcctactcttctctccctggcaagtcctcac

SEQ ID NO: 241601 - DNA, 390 bp, Homo sapiens
taaaatgaatgcattcactagtgaaggctccacatggatcctgagcttggatgagactgactgtctttcatggaacagcttccccaggctgcactgggacccttcctatacgagggacagtgtccagcccccaggccttggaagggggtgactttccagccccagctcccatccatatcaatgaccatatctgaggcccagatgggggatttctgctggagcttttgggccatagtattgctgatttttccttcagcatctttgcatttcttttcttgctggctttaaaaaaattattgagcctgaaaatgactgaggaccaaaatattttaagaatatgtaatacctccacaaaaatctaaataaaatatctcttacagtttcccagtg

SEQ ID NO: 241602 - DNA, 674 bp, Homo sapiens
acccggcggaccatgccaggactacggacccggacaggactgatggcctcagagaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcagagctgcgcttttggcctgaattttcagtgacaaatagaaaagctgaatggatggagacaatgactctttaattcaatgtaagagctgactcatcgcttcccaggaagacttgttgcaggtaggtgatggttatcctggaactggagattatcccagtcctttgttgcactggcaatgggcaggtctgtttatttttctcttttttcctgcaccaaatagtcctactcagggatgctggcattggtccccacttccctaagcccggaagaagtcttaatgtgagtacagaccacttcagtcagtctttttttggttcttggcaggaggggatactgggaatggatagatgcctgatcatcacggtgctatcaagagccatattctttattggccccatctgtgccagagttcagcggtaccatgagccctagtgctagactattagcccttcaat

SEQ ID NO: 241603 - DNA, 497 bp, Homo sapiens
tgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaa

SEQ ID NO: 241604 - DNA, 333 bp, Homo sapiens
ccatttacttacagtcactccttgtgcccatccccagaccataaacaactatgaatctactctctttttctatatgtttgctttattggacattacatgtaggtggaatcatacagtgtgtgttcttttgtgtctggcttctttcactcagcatgttttcaaagttcatgttatagaatgtatcagtacttcattcatttttcatggccaaataatatattcatttaattttaggagtatactaaatttgtttctccatttactagttggtggatatttaggttgtttctactttttggatattgtgagtaatgctgctatgaatcctgaaag

SEQ ID NO: 241605 - DNA, 391 bp, Homo sapiens
tcttttcttttttttttttttttttgtagatacagggttttgccatgttgcccaggctggtctcgaactcctgagttcaagtgatccacctgccttggcctcccaaattgctaagactgtaggcgtaagccactgtgcctggcctgcttttattttaaaggaaaggtggatcctattcttgaatattttgttactactctccttaagaggaaagataaacacatcaccactaaaagaagtgtgtgtcttggtagtgttttcccagcagattggattgcttttcgtgtctcagagatttttagacaggtccatttaaactaagtagagccaagactatcaaatcagattttatgattaatgtaataagaccttgcccttcaaaattttttgc

SEQ ID NO: 241606 - DNA, 455 bp, Homo sapiens
aaaagaggagggaattgaaaggaatggagaagttcctcaaagtttcttaaatccatacagatttatcattccccggttaaatgttaggatgtgtgtattccaaggctgctccagcttgttccagtaggttgagataaggctaaatgagtcccagatcaggatacatgccattccttatttgggaacccctttgacctctcatcactaacttcctcttttttttgtcctttttcccttcgtcctatttaggaaagttttaaattattaaccaatccagttaagtttagagtgtgaggtcccatcccagccaatgggaacgggacccagccataggggattgcatcaggatgtaaaggttataaatgtccccgtttcctttgtttggtgtgctttcgtgggtggactgctggtgagtgcccccttttggcagaaagtaaaccagccttgctaagaga

SEQ ID NO: 241607 - DNA, 105 bp, Homo sapiens
ttttgtgcacttttttgggtattatactgaaagaaaacatttattttttaaaaagttgaaaaattgccttggagcagagtaaggtaaatctatgattaagcttag

SEQ ID NO: 241608 - DNA, 458 bp, Homo sapiens
tgtgagcaaagggtatgaacagacacttctcaaaagaagacatttatgcaggcaacaaacagatgaaaaaaagctcaacatcactgatcatcagagaaatgcaaaacaaaaccactatgagataccatctcacggcagtcagaatggcaattattaaaaagtcaggaaacaatagatgctggtgaggttgtggagaaataggaacgcctttacactgttggtgggaatgtaaattagttcaaaagatccattttcctaagaattactgatgtttgcttcattttgttttcacagagaaataacagaaattcgtaacactcaaaagggagctcccatggctgggcatggtggctcatgcctataatcccagcagtttgggaggctgtggtgggcagatcacttgaggtcaggagtttgagaccagtctggccaacatggtgaaacatcgtctctactaa

SEQ ID NO: 241609 - DNA, 306 bp, Homo sapiens
gatctccctgcagtggattacaactgtctggtcaccagagcattgcccaaaagactgactgataccattctgggtgtatccttttcaggatgcttataatatcacattcacaacaacttcgtaacacagtctttcctgacttctggtccaatattcttgccatgataccacatcgcctctcagctttaatgaagacaagtcctgtgacatttagagtactatgtggttttgagtgcataggcggtatgctttcagttcttgctttaccctttgacaaaaagaatcaacatttaatatcagaaatgt

SEQ ID NO: 241610 - DNA, 686 bp, Homo sapiens
tctggacatggggacttacgaggagctaggatgaaaggcctccttgttgcttagccttggcagggctcttctggaagccaggctctctcctagtctgagaaggcaagctttttgctggattacaaagtcttctctggtcgtggccacggtctgtctaccccactcagcgcccgccctgtgtccacacatgcttgtcagactggactgaggaagcccacaactggggtgggtttggaatttccagtccccgtcagcatcttacactcccagggtggtttctttcagacttagcccagttttctttagcctctcagtttccgggtccaatctaagctaccagaccagctctgccaaaccagaggcccagatgggatctgccactccagccactgtgagcagctttggtttcagcccaaatgccaggactcgagaagtgtcgacaaggttgagggtccaagcttgaactaccctagctggctggcacaaaggacttctaagacaaacaagacgacggatccttacagtggacactcacgcaagaatctacccaagcagggtagcgagagacatgtgtaccagagcaagatcccaaatgagggaggaccatccacaaacatggggaccccatacactaacgcgataaggatccacagcatcctgcgctaaaagacagaaccagagacatg

SEQ ID NO: 241611 - DNA, 610 bp, Homo sapiens
tctggacatggggacttacgaggagctaggatgaaaggcctccttgttgcttagccttggcagggctcttctggaagccaggctctctcctagtctgagaaggcaagctttttgctggattacaaagtcttctctggtcgtggccacggtctgtctaccccactcagcgcccgccctgtgtccacacatgcttgtcagactggactgaggaagcccacaactggggtgggtttggaatttccagtccccgtcagcatcttacactcccagggtggtttctttcagacttagcccagttttctttagcctctcagtttccgggtccaatctaagctaccagaccagctctgccaaaccagaggcccagatgggatctgccactccagccactgtgagcagctttggtttcagcccaaatgccaggactcgagaagtgtcgacaaggttgaggcctccacttcttccaccttggctacccctgagatagcaagaccaatccttcctcttcttcctccttctcagtctacacaacaagaagacgacaaggatgaaggcctttatcatgactcacttccattcaatgaatagtaaatgtattttctcttcctta

SEQ ID NO: 241612 - DNA, 710 bp, Homo sapiens
ttccccttgctgctgccatgtgaagaaggacatgtttgcttccccttctgccatcattgtgatgttattgaatggacaaatttcccttttcattggaaacagaaatggtactggaccctttctagatctcttgcctcacagcttctaacccaaatcttatttctacagcaaccaacacagcttctcgtttgtaaaacttctcaagatgtttcaaaatggaagaaataccaaaacccacaaagaatccttgagttggtatggttatttttagttgaggacatttgagattccacagatgcagaaaagaatcttctcagagcttccttcttctgattaaaagcagccacttctgggaaataaggctggcataaatcctctcttgagagtggctttactcccagaaacaagaccaagggtaaatctaccataaatcccctctccaggggagtttgatggccataaagaagatgaaaagagttctcacacctgcataaacaaatgttatcacaaactttcttatctcttgtttgttctcccaaaaaactatttgtctttcctaaagaaatccatttgttttccttatagaagtcttttctcccggcttgcttctcctattaagttagatatataaacttctaatttaacttttaggaaactacttcttttgtaagctcttgtatgcaaataaactgttttattctcttgttaat

SEQ ID NO: 241613 - DNA, 245 bp, Homo sapiens
ctctagcgaggacttccattactatgttgaataaaactgttccccttgctgctgccatgtgaagaaggacatgtttgcttccccttctgccatcattgttattcatgttaggctcctgaaaacaccacaaggacctaccctccgggagccagccagagaacccttcttcctgcactgtctccgttatgcccaacatttctgggcataagttttaataaaccttacctgggaaaagtttgtttggc

SEQ ID NO: 241614 - DNA, 281 bp, Homo sapiens
aattgtgccattgcctgtcattggatttgaggaggtcatccaatcacaatgaagttcaatgaaatctgaagactggttagcaaagtcttaaccataaccacttgctatctattgaaatatattgggaagcacagattgtatcatcatgaaattttcacacatggtggaactccatttgttaacagtcacagagggtgatgcttggcattttaaactgcaccacagtcttaaattcattatcatgtgaactgataagatctagtacagaatttaaaaatggg

SEQ ID NO: 241615 - DNA, 442 bp, Homo sapiens
ggctaaggcacaaaaatggctgtaaaactcacctgaagtctgtgctcatgttctcttgaggaccccatttcattacttaaaacagtttcatctcctggcatttcatgcatttgttctgttggactttggaaacacattaggaaccactttacagttaacacttggctcatagcttatcttggaccagagtgttcataatcttgtttaatttatgttagactttagacatttttcaggaaaccggtacagacctgcccccaggacaggctacagataaattaggttgtgcaaaactaagaattaaaattgaaaatattatgtgtagctgatgtcattcattatcatgacattgaaattttgtcacaatgtgggggtatatcgtgggctctggctccaaaaagcaatctctgagccagatgctaccagttttaaagatggtaag

SEQ ID NO: 241616 - DNA, 420 bp, Homo sapiens
taaaatggaaattacagtagtagtatattaaccatatagagtttttgtgaggattgagatagtatatgtaaagttctttaaaacagtgcctggtcatcacttaagtgttgaggtagctgctgttttaaaaattactattgttattcaaagaaggttatttgagttatattttttccctaggctctccaaggtatactttaaatccttgaggttaatgattctttggaaaagctggaggtgtgctgtggtaaataataggaagaaaacccttgccccaatagaaaataatacaactagaacataaaacacaattaaaatattaaatacattttgtatttcttttattccattttgtttgttcatgatttaagttttataatccttcgaatcccacaattttcattcgacactacctttaaa

SEQ ID NO: 241617 - DNA, 496 bp, Homo sapiens
ataagggggcaaagttaggcatcttctacaatttgcttggagtaggctggttccagcttatctgcatgactgcactgtaaataggtaaatagttctctcctggacaaggggatatccctttgcttttctatttgtaaaactcatttattcatcaggcattgagtacatagagtccaagagtattctaaatgctagggatataaggatgaataggatggaactaacaggaatcttaaaaaaggtaggaatggaacaattagatttgttcttaagaaacaactagtagtaatgtagaagaaggttttgagtagggaaagcctcagaaaaagactgtttaagaaggtcttgtcttgatgcagtggttcatgcctgcaatcccagcactttgggaggcctaggcaggaggatcgcttgaatccaggagtttgaagctgcagtagccatgatcacgccactgcactccagcctgggtgaaaacctgtctcacacacaaaaa

SEQ ID NO: 241618 - DNA, 397 bp, Homo sapiens
cagcacttcagtggggaaaagaatgcttttttgggaaataaagttgggacaatttgtggaaaaaaagttttgcttcctaccttactccttaccaggaatactttctaaaattagacataagcatttaaatatatggggaaaaaaaaaccccactacatttctagaagaaaatctcaaatgttttatgatcttacagcggagaagatattcctgagatgacacaaaaatgcaggagccgtaaagagaaaaaaactaatgaccagtaacaattttagatgcttagcttaaagaaaaaaatacaaacaaagtcaaagactaatgacagatagaaaaaagaaacacttccgggtcagccgagaaatggtattcagcaataaatgtgtcagagtcccaaaaa

SEQ ID NO: 241619 - DNA, 447 bp, Homo sapiens
aggttaacacacactaaagggcaatgccattaaaggagaagaggaactttggaaactgctgtctgaaaggaaagcaaagcactcttcattaacagctagtgggctcctaatttctgcccatgaaggcatgttcatactgacagagcaccccctcaaggggaagaaccatccgcgctaattcttgttgtcctcttctgagctagtgtgctcattgttcatacaaactagtgtgtcaacattaaaacaaaaagggagttgaatcaataaatgacttgggaggctgtcatacttgtaacaactatggcgacagaagaacactggctgtagtatttggtattagcattggtgtctggatctataactaaaaaagcttcttcatttctccaaactaatagatatgacagatattgccacacttagctctacttaaataaatattctaaactc

SEQ ID NO: 241620 - DNA, 201 bp, Homo sapiens
tcatgaatagtattaatattcttataaaagagactccagaaaatttcatgatcccttctgccatgtgaggactcaatgaggtgacttctatctatgaacttggaatcaggcactcaccagacactgaatctgctggcaccttgaccttggactttccagcctccagaactttgggaaataaatttctgttatttataagcc

SEQ ID NO: 241621 - DNA, 561 bp, Homo sapiens
cagcggatcaagcaatcataatatcaagctgagattaattgctatgtaaccatcagcaccatccttttccagaactttccattttccccactgaaactttgtacctatgaaacaactactcctcattcccatttcctccagcccctggcaaccaccattctactttatgtctctgtgaatttgactactttcggtaactcatataaatggattcatatatttgtccttttgtgactggcttgtttcacttagcataatgccttcagggttcattcatgttgcagcgtgtatcagaatttccttcttttttaagatcgaataatattgtatatacgtgccgcattttgtttatccattcttctgttaatggatattggggttgctttcatcttttaaaattttgttttttaatgcatgtacaatatttgtattttatttctattttgtttcctattattattttatagttttgctgacttagaacatatgtataattatttttattgcttttattaccactttctgatactaggtgttgctaagtaaaacattgattttgtt

SEQ ID NO: 241622 - DNA, 252 bp, Homo sapiens
gggtggctgaggcaggagaattgcttgcgcatgggagactgaggttgcagcgaactgaaatagcgccactgcactctaacctgggcgacagagtgagactccgtctaacggaaaaaaatgtttattttctctttggggtacttccttacagagaccttaggaatcaaccagactattctttaagtctgtgagaaaatttccaactcataaagttagatatttgggattcattcacccttctgcatcagcgtc

SEQ ID NO: 241623 - DNA, 201 bp, Homo sapiens
gatctgaacccttgtctcctgggagtgtggaaggttttctctgcctaccaagaacaagaaattaattctaattacatggaacagtgtctgcccctaagagggagacccagacactcactgctctggtaaggaagtgatagcaatgtgaaaaggtacttttcaaaacaaaaaggtaaagtcatgactctcgtaaagatatga

SEQ ID NO: 241624 - DNA, 617 bp, Homo sapiens
ggaggaaccatgctaaggcatgaccaatgaggagaagcaagagagcctgtttgtattcctgggagccagtcctgttctattcagtcgtcaggtccctgtgtgtgtgtggagggggttgggaaaggttgggggtagatgaatgtaacctacatggtgatttaaaacaagcaactacagtcatgcatcacttaatgacagggatacgttctgagaaacgcatcattatgtgaacactatagggtatagttacacaaacttagatggcatagcctattccacacgtaggctctatagtataactccttggatacttacggtatggcctaggtattgctcctgggctacaaacctgtactgcatgtaactatactgaatcctgtgggcagttgtacaataacagtgagtttttgtgtatctaaacatagaaaaggaacagtaaaaatatggtattataatcttaccggaccaccagtaagatctggtgatctgacattgactgaaatgtcgttatgcagcccatgactgtatttcctctctgacttccccaggagagctggttccagaaggttcggatgagtcctgaatgtttatgtatggcattttcctttaccaaaaca

SEQ ID NO: 241625 - DNA, 402 bp, Homo sapiens
tagtaagtattttgatggacaaaggatatatgttacattaatttatagttttaatatctaaaaaacactaagaatttagagaaaaggttataatactggccactattaatcagtatattcattcattaaaaatagatttacaaatttctatgtggtttgtgtgagaggaggggccatttgtccctttattcacttaatgtctggtcaggtgcatcacccatggtatctgcttgttaattaagctgctaattgaattaattaaaatgaatgtaattgctagattaatttttcattatctatctcagtttattactttagataattattatgtatagattacttattttttggaagaaataatttctatttctgggaatagatgtccttatggatctaaaaggg

SEQ ID NO: 241626 - DNA, 1010 bp, Homo sapiens
agagtatatgatgtgcatgggtggggtaattcaatgctgtgaagatatcagttttccccaaagttgatctttaagttcaatgcaatgtcattcaaaatcccaggtttttgttttgtttttgtttttgttttaaatgaacctgagaagctgattcttaagtgtctatggaagtgcaaaagaccaagaatagccaaaatattcttgaaaaataacaatgtggaagaagtactctataagatttacaacttattataaagatgtagcaagtaacattggtaccaggatgaaaaagtatgccaaaggaactcaaaagagaacacagaaacagaaccacgtatatatggacactgatttatgacacagtagctgcagagcagtggaaaacaatgtggaccacatggatatccatataaataaaagaagaaaattgacctgtgactcatattataagcaagtatcaattcctagtgaactgtagatataattgtgaaaggcaaaacaataacaaagcttatacaggataattttatcatgattcaaaaaaaaaagaaggtttcttaaagaggaccagaaaggaattaaccaaaaaataaaagattgacaaattggattatatcaaagttaagaacatctactcatcaatagatactgttacaataaccaaaagcaaaacacacagtgggaaaattaacaaatgattcataaactgattatatttagaactcctatagatcagtaagaaaaatgcagtaactcaaaaaggggcaggagacgagaatgcaaacaaaacccacgttatactactgcacatccactcaaatgattaaaaagactgccaatacgaagcattgctaagaatgtgtaaattaatctcatgcagtgctagtaggggtcaaattaacacaaccactttgaaagactgtcattatttacaaaatgtacaaaatatttacaaaatttagacatatgaataccttatggcctaaaaatcatactaccgagttataccc

SEQ ID NO: 241627 - DNA, 1420 bp, Homo sapiens
ggcacccagactccttgcgggagcgagcgcgtctgggagcccgcggccggagaagggctgcgggttagggggccggcgcccgcggttcaggattccagaattggaaataacgggagggaggacctggtccagcttcccttcctcaaataaggaaattgacacctggcgtgagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagagggcacgttggatttacaagaacaatttcttttgaagatctcagctcatgggttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagtaagatgggaagggcgtgcggccgtgtggttttcagcctgatgtctcaggattggctgtcctgaggaagacacggggcatcactgcctcgtctgtatgtcctccctaccactgtgggcacaggagcagctggcgaggctagctagcatcaacgatgtgaggcacggtggctttgacttcgcagggcctgctgaatgtagtgtctgccttaatcgttacagtgacactgtcgagtataggaatcgtctccacctcagcagtgctcaagaggttagggagcttgtccttggtcctatagccaggaagcagcagagccaggagttgggccctgggtttgtcccactttttactgtttccattattccatgctaccaagtt

SEQ ID NO: 241628 - DNA, 1340 bp, Homo sapiens
ggcacccagactccttgcgggagcgagcgcgtctgggagcccgcggccggagaagggctgcgggttagggggccggcgcccgcggttcagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagagggcacgttggatttacaagaacaatttcttttgaagatctcagctcatgggttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagtaagatgggaagggcgtgcggccgtgtggttttcagcctgatgtctcaggattggctgtcctgaggaagacacggggcatcactgcctcgtctgtatgtcctccctaccactgtgggcacaggagcagctggcgaggctagctagcatcaacgatgtgaggcacggtggctttgacttcgcagggcctgctgaatgtagtgtctgccttaatcgttacagtgacactgtcgagtataggaatcgtctccacctcagcagtgctcaagaggttagggagcttgtccttggtcctatagccaggaagcagcagagccaggagttgggccctgggtttgtcccactttttactgtttccattattccatgctaccaagtt

SEQ ID NO: 241629 - DNA, 305 bp, Homo sapiens
gtaggtgtgagttactgcacccagccaacaacaaagaattaattgctaaaaaacagttgttacagaaattacattgtgggagagtgattattggtctgggaagtgtaaattatagattgtgatctgtttatcatttattctcagtctcattttactcatctgtaaaatgaaggcatatgaaatttatgaatttaggagttactgtaggagcattctgagaaaagagctcttccaggtaagacttgaaaattccagtgggaatgctgtggtgaaagggagggaggagagctgtttagctgtaatta

SEQ ID NO: 241630 - DNA, 473 bp, Homo sapiens
  misc_feature (32)..(32): n is a, c, g, or t
  misc_feature (49)..(49): n is a, c, g, or t
ataaaatatatgttaatactttgacatgttgnaatgtatgaaagatagncaaggaataaagaaaagttgacgcccttcaccatcccgcacacctgaggagcgggagtggcggacccagcagcgctacttgaaggtcttaagggaagtgaaagaggagtgtggtgacacagccctgtcatctgatgaagaggatctcagctcatgggttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcaggtaaatgactgggcccctcta

SEQ ID NO: 241631 - DNA, 1509 bp, Homo sapiens
ggcacccagactccttgcgggagcgagcgcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagagggcacgttggatttacaagaacaatttcttttgaagatctcagctcatgggttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagtaagatgggaagggcgtgcggccgtgtggttttcagcctgatgtctcaggattggctgtcctgaggaagacacggggcatcactgcctcgtctgtatgtcctccctaccactgtgggcacaggagcagctggcgaggctagctagcatcaacgatgtgaggcacggtggctttgacttcgcagggcctgctgaatgtagtgtctgccttaatcgttacagtgacactgtcgagtataggaatcgtctccacctcagcagtgctcaagaggttagggagcttgtccttggtcctatagccaggaagcagcagagccaggagttgggccctgggtttgtcccactttttactgtttccattattccatgctaccaagtt

SEQ ID NO: 241632 - DNA, 525 bp, Homo sapiens
cacaagctctctgttgccttaggcaataagatgagaaattacggaagccaattatctatttgttgtcatggcaattgctaggagcagggtgggaggcacgtgacaccagaaaacaaaaaatacaacagacagtgtagactggggctacagctgcacatcagagtatctgattttgtgtgtagagaatggggaaggacctacatccctacattgatcttttgggtcacagctggttccaagaatatatagcagcaggtttcatagcgttaatctcttaataaaatgagaagtttttataacatcaaatttcatcttaaaattatctttatgcagaatatttaataacacaagttagtaatataagtgagaaagtaatctatagagccatatatagtatgatctcaactaaataaatataaacattaaaaagaaaaccttgctaatacacactgtatcctgtatcaaaatatgccatataccccataaatagatatacctactacatactcaaaaaaattaaaaatt

SEQ ID NO: 241633 - DNA, 194 bp, Homo sapiens
tgtataatatctccataagaagatattgtttgaaaggaaatccatcatttattaaaaatatgtataaaacacttacaatgggccaggcattgttctaagtagataagatacataaattaccaaaacacacaaagattcacaccattaaagagtttgtatcttagcatgagggaggaagaaaataaacaatagct

SEQ ID NO: 241634 - DNA, 366 bp, Homo sapiens
atctcggcctcgggaggaatggttcattgcatattctctcagagacagctgggcgcttcgcagggagtggtccccctccctgtcaccagggcaattctctttcacatctcccaggacagatggagaatgaagaaattaataattcatagtgtgtatttaagtggtgattcttcctagactgagacatacttgcattttgttcaaaaacatcttgatgaagacaggcccagtggtgacctaagagttagaacataggaagtagggaaactcttactaagtggccttccaaagtgctgggattacaggtatgagccacctcacccagcccattttgttttgtgattatcataaagccattctagtagt

SEQ ID NO: 241635 - DNA, 351 bp, Homo sapiens
tccttccttccttccttccttccttccttccttccttccttccctccctctctccctccctccttctttttctttttctttttttgatggagtctcactctgtctccaagctggagtgcagtggtgcaatctctgctcactgcaacctctgactattctttgtattctgttggactcgatatgtctttctctacggatctctccacgagcctttacattttttgttgtttcattctctcccgcatttcctcctgtgtcttcttgcatttgcctccgctggggcatgtctctgtctctctgcctgattctgcctgttttcactccttgctcctagcattggcccccttctct

SEQ ID NO: 241636 - DNA, 2230 bp, Homo sapiens
cattgcctcttcaaactacctcagtgggtaaaacagcaccagagagaaacgttgaaattccgcccagctctccaaatccagatggtaagggctacttggcagggactctggcaccactccaaatgagaaagcgagaaaaccaccccaaaaagagagtagctaggactgtaggagaacacactcaagttaaatgtgaaccaggaaaattgttggtggagccagatgttaaaggggtgccttgtgtcatcagttccggcatcagtcagctaggacacagccagccatttaagcaagaatggctaaacaagcactccatgcagaacagaattgttcacagccctgaggtcaaacagcaaaagcggctgctcccctcgtgtagcttccagcagaacctatttcatgttgacaagaatggcggcttccacactgacgctggtacctcacacagacagcagttttaccaaatgcctgtggctgccaggggccccattcctactgcagctctgttacaggcctcttccaagaccccagtggggtgtaatgcatttgccttcaacaggcatcttgaacagaagggattgggagaggttagtctttcctcagcacctcaccagctaaggttagccaacatgttatcccccaatatgcccatgaaagaaggtgatgaggtgggaggcactgcacacacaatgccaaacaaagcactagtacatccgccgccgccaccgcctccccctccccctccacccttggctttgcccccgcctccccccccaccacctccgctacctccacctctccctaatgcagaagtcccatctgatcaaaaacaacctccagttaccatggaaaccactaagagacttagttggccacagtccacgggcatatgtagcaatataaaatcggaacctctttcttttgaggaaggtttaagcagcagctgtgaactgggcatgaaacaagtttcctatgaccagaatgaaatgaaagaacagttaaaagcattcgcgctaaaaagtgcagatttctcttcctatttgctttctgagccacaaaagccttttacccaattagctgctcagaaaatgcaggtgcagcaacaacagcagctctgtggaaattatccaacaatacactttggtagcacgagtttcaaaagggcagcatctgcaattgaaaagtccattgggattttgggaagtggctccaatcctgccacaggcttgtctggtcagaacgctcagatgcccgttcagaactttgccgacagcagcaatgcagatgaattggaactgaaatgctcttgccggctgaaagccatgattgtgtgcaaaggctgtggggccttctgccatgacgactgcataggtccttcaaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaataaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttg

SEQ ID NO: 241637 - DNA, 1002 bp, Homo sapiens
gattacaggtgtgagtcaccatgcctggatgctaatatagattagcaggaatactctggatgctgttgctgagaataaactctggggaagggtttattttcaggtggggaagtaagataactagttggaaggcaatgtataatccaagtgagagatggtggttgctctgaccaggttggttatggtggacgtggttaaaagtcatcagattttattttatttttattttttagatttttaaattttaattttcagttttttaagggtagatagtaggtgtatatatttatggagtaggtgtgatgttctgataggcatacaatggataacaatcacattagggtaaatggggcatctatcactttaagcatttttcatttctttgtgtaacagacattccagttatactcttttatctatttttaaatgtacagtaaatttttgttaactgatgaaggaaagaattctaaagccagtaagacaaaagcatcagataacctacaaaggaaaacctatcaaagtaacagcagacttctcagcagaaaccttacaagccaaaagagattagggtcctgtcttcaacctctttaaacagaacaactgtcagccaagaattttttatcccacaaaactaagttttgtaaatgaaggagaaataaagtcattttaaacaaatgccaggggaatttgtccctaccaaaccagcactacaagaaatgctaaaaggagttataaaccttgaaacaaaagcctgatatacaccaaagtggaaagcttaaaacccacaggatctgtaaaacaattatacaatgaaaaaagcaaacaaacaaactaggtaacaacatgaggaagagaatgatacttcacatctcaatattagcattgaatgtcagtggcctaaactagctccacctaacatacagaatggcagaatggatacagaatccaaatatctgctgtcttcaagaaactcacctaacagagaaggagtcctgtaaactc

SEQ ID NO: 241638 - DNA, 879 bp, Homo sapiens
ataaaaatatgaattgggctccttgccatgaaaaagggtagatttactcattgtgcactgtctacagtgaaactacatttatgagccatgagccatgaaatatattttgttgaaaggtataatgtaaggctggccctgtggttcaacagtcatattatatatatccattctggaaatgaacctgggatcctggcttttgtgagggatggagagatggttatagtctctctcatgggagcaagtgggtatttgtatacttgaaaagcgcaggcacagatgttgctagatggagcaaatcatttcttggtctcattttaaaatgtgaactattgaatgaaaggctgatccagaaactgttgttgcttaacaaaagaaaatagtggaaagaatatactatgaaaaaaaagtgggtaaatcgagtccaagaaactaaaaagcaatagaaaaagtcagagaccccaagaacaaaaacaagaaagatgaaacaaataataaaacctacatgcatcttcaaaaacaaaaccaaaatctggaacatgttgcataatattttacatgtgaacatcaaggctccaaggtaaagttacatttaaatgatatttaatatcttaaggctaaattttattcagttctttattctcttaaagtcctacagcctacaagcatgaagccaacaggatgtaaaacaacctaaaaccccctttgagataacagatttattaaacaattgtcttaaatgctaaaattgaagtttgaagagatagacaatattgcattttataatgtaaaaagttatacatgatgtagacatttatttcttatctcttacaaagagccagaatcgtgtatctttaaaataaatttacttcaaaatcttta

SEQ ID NO: 241639 - DNA, 124 bp, Homo sapiens
tatgtagtaatttcccaatttgatttttctctataattttatagcctcttgcaggtggatcacctgaggtcaggagttcgagaccagccaggctaacatggtgaaaccctgtctgtactaaaaa

SEQ ID NO: 241640 - DNA, 222 bp, Homo sapiens
gagcgtccagactcccctctccgatccctcattctagcttgggtgtcccctctactgaggactctaagatgtcagaaacaatgaacagctgtcttcatacttaaaaaaaaaaaaggatcacagcagtactcatgatgagaaggatcctttggctgccccttagcacctgcattaccatccatcaataactgtcttccattgtaaagtctctctccccgtacc

SEQ ID NO: 241641 - DNA, 446 bp, Homo sapiens
ctgaactccctgtgttgttgcttaagatttttacccaggcatgaaaaggaaatgaattctgccaactcatcgctgtgtctgtgggaacagaaactcagggcacctattctctgcaagaaaagcatcaattccctgtaagaaaagtttcccacctgagacaatgacacagaccaacataaatgctcttttggttttatgatttctgatattagattttacttgatttttttatttttaattttttaaatttcattttgagagttaaaagggttacttcttttatttccagcagttcaaggaatttcagagcaatcttggtccagagttggtaataaagacatttaaatgagatgggaatactgtctgttatgctgaccagtactaagtctcccgcagttcatttttcctgagaataaatgcctgtctgatacatcaagacctattta

SEQ ID NO: 241642 - DNA, 513 bp, Homo sapiens
ataacaatcctgttacatctgttttcacacactgtcaaactcaaggtgtacagtatctagacagtatatggaataactaataatttgcttaaaacccagtccttaaccatgggtattcatcactctgaattttaagccttgacatttatgtctgctacagtggtatctggtgatagagttgagacccttgggagtttagtccttagaattttcctttcctttgggcagtcttaagaaagttaaattttacaaagtatctcttgaaagagcattggctgtggtctaagagtagaattaaatgtagcaattttattatctttggggcaaaggattctaccagtgtttaaaaactcattttaaagaaatataataattttgacataagcctaatcagctgagtgaggtggctcatgcctgtaatcccagtactttgggaggccgaggtgggaggggatcacttgaacccaggagtttgagaccaccctgggcaacatggggaaaccccgtctctac

SEQ ID NO: 241643 - DNA, 346 bp, Homo sapiens
cagtgtcaagatggggactgatgcccctttctgctgatcatgattcctgattaggaggctttgagcagttatttaagctgtctgagctttaggggtttttgtttttgtttgcttgcacagggcttgctccccccttgccagtttgtcgtgatagttaaatgacataatatatgtgagcatgcattgtaatttaaaattgtctatgaatgtaagaatcattagttatgaggatatacggtctgcccttaaacttattgtatgtgccatttaaatgtgtgatgtcctaaatgtagaggtttaaatataccttcacctaatagatgtaataaatgtgctcttgaactac

SEQ ID NO: 241644 - DNA, 886 bp, Homo sapiens
agcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggag

SEQ ID NO: 241645 - DNA, 676 bp, Homo sapiens
agcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtaagggcgggcggggcggggcgggccaagagggtggggaggaggctggacctccggagggctgcctggaggaggaggggtgcataggcacgcattgggctgcgtggccattcattcaacaggcactcattgagcacctgctgtgtgccttgtgaagagagctaagcctccacggccattggtttttgaccacccactccactttcactccattcacaggcttttctggaatttataactgcagtttctcccattgttttgagcagctgcagcaacccaaatacaaagtatggctttcataaacggataaaaacac

SEQ ID NO: 241646 - DNA, 843 bp, Homo sapiens
aaaaagaaaaaaaattcaaaaagttgaattctcctcacctactctgtcagctgttatttatttattcctacctaccccttccttatttttacatttttcaaactgacaaataataattgaccagcctgggcaatatagtgagaccctgtctctaaaaaaaaaaaaaaaaatagccgagtgtggtggcgagtacctgtagtcccagagtatttgggactacaggcgcgcaccaccaagcccggctaatgtttgtatttttaatagagatggggtttccccatgttggccaagctggtctcgaactcctgacctcagatgatccacccacctcggctcccaaagtgctgggatcacgggtgtgagtcactgcgccccacccatagtgatgtttcaatacatataacacataatgatcaggttcagttcctcattctttatgccccttacctcttggggctctcagaataaactgtttatccccaaaaccacatctttgacctggagaccagcaaatccaagagcttctcctccctctcactattccagtgggtgtggggagctgctgaccagcagtggatgatggagagaaggagggaagcctgtgttggggtacccaaaccacccagatctgggacacgccctactgttctctgaagcagagcccaagaggactcaccatctgcagtgggcctccctatagaaccctccagcagggctgggcacagtggctcacatctatactcccagcactttgggaggccaaggtgagatcatcacttgaagccagaagtttgagaccagcctgggcaagaaggcaagacagtctttaattaaaaaaataaa

SEQ ID NO: 241647 - DNA, 205 bp, Homo sapiens
agtttataactgctaaaatgtgcgtgaaatacgtcaacttaagcatttgcttaatttcacatttacatattaaagattctattgaaagacatggtaattttgtgcttagttgggataaagaaaatgaaaagaagcttcaaggtgtgcatatgtgtcttcttgaaagcattttcttcatcctttgaaaatttgttcgtattttctc

SEQ ID NO: 241648 - DNA, 414 bp, Homo sapiens
acccattacagggcagattaatgggcaccagaaacatatgtcaaatagcaatcgctgctaatggacaggaaatccccacattgtcagggcagttgaatttagcaaccactcagttccagcctaactctaaaattagaaagtcacctatttccttctcttttcctaagcaactgtatgtttaatgacacagcaacaattactatgaaagcaggtatccaaactaaaattttttgattaatcaaatattttccctcacttccatttttcccacttggtggcatatagaaacatatcctcttttccatgaccgtggacctccttacaactgtctgctgtacatgtatcccatgcacaaatctgggaacaatcttcaagaagttcatcttagaacttgcaactccctgggaggatctc

SEQ ID NO: 241649 - DNA, 357 bp, Homo sapiens
tgcctgtaagcaacaatcaaaacgtgaacaaaaaccttcttccacaggaactggcattgtcttcattcagacagagccacagctcccacctctcacatcacaaatcaagagaatcaccagtcattggaatgcacaaaccagaattcttttcatctgccttcgagttaattgtgatttcccggtttctttaagaatctcaggtgttaagaccagcacagtggttcacacctgtaatcccagcgctttgagaggccgaggcaggaggactgcttgagcccaggagttcaagaccagcccgagcaacaaagcaagacctctaccaaaaaaaaaaaaaaaaaaaaaaagaatttcagatgc

SEQ ID NO: 241650 - DNA, 191 bp, Homo sapiens
cactcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaa

SEQ ID NO: 241651 - DNA, 258 bp, Homo sapiens
caagagaacagactttagggcccagttgtatttatctggccatctctaatgtctggaattattgttttgtgtgccctatatagaaactcattccatcctggactgtattgagaagcatgtttttctattcagtatcttatgtaatcacaaaagagtcttagtgtttgcttactgtgctcaaagattcacttgtatcaatttattgataaaatacccacttttatcaatttgtttttataaagtgttttgcttgtcagt

SEQ ID NO: 241652 - DNA, 487 bp, Homo sapiens
tttcctgtcttcatttcagccctttagattatttctccctgtgacgctatcaagcagcctgggttcagtttgacagttaagcattgagatatctctatcactaccctgtctcactttgcaaaaggaagagaacttcaatgctgtgcagcaggaaggatgccaggaaaattagattttattttcagctctgcttctcaccagcttgtgtgatattgggaaatttattcttctgctctggatcagttttcaatatttcaaatatgcgtggacctgtttccaaagagctaaaagacctccagaggtcctctcattattaagatatgatgatgctaataaaagcgtaacatccgaaatgctacctattacttctgtggaatgatttctccctggatgccttcttgttgcttactttcatttccttcagagaaaccaacaacccatagaatgttgcctttacagtactagaatggattgagggcatatcgag

SEQ ID NO: 241653 - DNA, 412 bp, Homo sapiens
acccaggggttctatggagatccctctgcctcggagggtctggagtaggcctcagacgctgcgtgtgtaaaaagcgcccagcctgttcccacattctgagcagtagggtcaggctggcagcacgtggctctgctggctctccaggccacagaacgtggctctgtgtccaaaggactcttatctccacggtggccccacgtgagcctccatggcgtagcccaggccagctgggccaaagtctgccaggagcaggacggggttctccaggggtgtgtttccccgaattcactggaaacggtgtcacaagcacgcacgcctgggtggtctcaggcgtgggctccctctgctgagtggagtgagagtcgctgcctctgacagggttgttttaaataaatcacccggttttttgagc

SEQ ID NO: 241654 - DNA, 523 bp, Homo sapiens
cagtacaccattgtctgtgccctcctagaactgagactcttaagtgagatgtaggcatccaggtgatgagggcagcttgtacaatttgcaaagcgaggaggaacctgggctcccagtgcacagcagagcgaccatgccagcctggactctccatgtgtgagatgtaagtttctatctaacccagtggtcttcaatggggacaattttgccctctagggagactttgaaaatgtcaggagacatttttggttgtcaaaaccagagagtgtggttgttacttgtatctgttatcacctctggagggtatcattgcttctggagggtatagcagctacattcattgcttcaggagggtatagcagctacatacttacatatatatgtatatatatacacacacacatatatacatatatatggctgtatttaataataatgtattaatacattatttaataatgtgtggctgtatgtaataatatatggctgtatttaaaataaaattggaaataactcacttata

SEQ ID NO: 241655 - DNA, 808 bp, Homo sapiens
ggataagacacagcagacagaggtgggctagacaaggacagatggaaatttggtgtctactggtcgccccaggcaggaatgactcagaaggaagcctggccgtcctggttccatgccacagggaaaggcaactgggtcgaaataggccttggtctccagcactatcagtgaccccagggaggtgacaggctggagcaagtgcagggcaggcaggggaggggacgccggccacagcgcactccacggggaagggtctttatgggcccctcctcggagaacccccggtctatctgtcagtctgggacaggccacctcaacttgccaccgaggacaccaaaactctccacagacccctctgcccctctgggaaaccccactgtgctccaggacactcaaaaggaaaggatccctggacaagaggtcctgccaggaaaatcagccaaattttggccaacgaccagcaaggtgcacagggaagagcaggggctgaaactcagaggtccagcatcagcgacgcccttggcagcccagggaacacaggcaacgccttttggctctggagtcttaggctcttcatcggcgaactgagcccagggggaaggggctactatgtagggttgtcatgaggatgaaacgagacagcatctggtgtaaagtagaaaaggcataaagggccgggcgcggtggctcacgctgtaatcccagcacttttggaggcccaggtgggtggatcacctgaggtcaggagttcaagaccagcttggccaaccctgtctccactaaaaataaaaaattttgccgggcgtgg

SEQ ID NO: 241656 - DNA, 339 bp, Homo sapiens
attttcatacttttatcttatcttttctcatattactttgtcttaattgtttgttcgaaactattagtatcggcctgccatggtggctcatgcctgtaatcctagcactttggaaggccacggagagaggattgcttgaggccaggagttcaagaccagactaggtaacaaagcgagaccctgtctctacaaaaaaaacacgaaaattacccgggagttgatgacttgcacctgtagttccagctactcaagaggctgaggctaaagaattgcttgggcctgggaagcggaggctgcagtgagccaagatcgcaccactactccagcagcctgtctcaa

SEQ ID NO: 241657 - DNA, 628 bp, Homo sapiens
ggcagcagatcaagtatatgaatgctgcttcctgagccccagtagcatgctgtccccgtcatctgtaatccctctgtgccctgggagcagggtgatcagcccattttgcagatgaagaaactgtgacttagacatcctgcatttggagagaggcagagctgggagccggactctagggcccatgctattccttcatgggacacgtccctgagatttccctgggcttgctgcggatttatcttgttcattgttgcccgccatgaggggacttgttcaactataacagtgctggcgaagaatagggctcagtgtgtgcttgttgaatacatgaatgaataatcaatgacccctccctctccgccatctgcagtagcctccacgaaactgcactccgtggcgctgcaggcacagtgggaaaccaggcaaggcgaagttcatggtgccaggtgcccaggctgctggagggggaagctgaggattgggctgcctgacttccttcccccgcaggccgaggactgactgaggccccagagtgccccttcctgggtttggtcagatgtgggcaacgctctgtccagcccccaggagcagcaagtcggagatcccagatgatggagatcccagagga

SEQ ID NO: 241658 - DNA, 733 bp, Homo sapiens
tctagccagcagccataattttcatcagtgaaaagtgctggcttgatgggttgtttactctgggctgtttcattctacccccattttaatagaaataacagaaaatactgaagaaatcattttctcccccatttttttccaagacaaaaatttgaaacagttccaaatatttattgtatagtattctccacattcacccaccgattctcctgttggaggacctgttcttacctaagtatagacgaatgctgtgctactagagtttatgataatgcattacagcaagggtcagcaagctatggccagatttgtcccacagcctggtatggtaaataaagcgttactgaaacacctccatgtccactcatttaggtattgtatggctgctttcatgctacaagggcagagttaggtagtcatgacagaccgcatgccctgcaaagactgaaatgtttactgttttgccctttacactgactagacaacttcttttagttgagcctctcactagagcaccttgtgtcttttttacctttttcagtggttgagtggacttttaacctgaaaagccaatataaattgaggttgagagcataaactccacagtcagctaggctgagtttaaatctcggctgtatgaccctggacaggttacttctttttgcattgctcatctcctcatttgtgaaaaggagctttccgaagtgctacctcataggattattataaggat

SEQ ID NO: 241659 - DNA, 262 bp, Homo sapiens
tattgaagtagctaaagtttctaaagtgtgttaatttgcatacttcctcagcagtccagcgtggaggataaaaggggtatcttgtgagtcgatttgaattgtaatcccgtttttttcacttgctagctgtgtggctctgggaaaattacagtttttatgagctttggcttcctgatcaataaaatagaaataattaagtgatacgtgcaaagcgcttagcatggaacgctctcaataaatgtttgccatttttagtgtctgc

SEQ ID NO: 241660 - DNA, 495 bp, Homo sapiens
taaagataattaacatctgtttctcctaaacaatatgaggaacttagaacgttttaattttcatcttcccatatgtcaagatattgtttttgttgttgctgtttttattgttttttaattttctctttatcaatagatggttttttggaagcagttttagacttacagaaaaatattgatggaaaagtacagagagttcccaaacgtgccctttctccctcaccacgcacacaattttccctgttattgacatcctatactagtgtaatatgtttgtcacaattgagtcaatattgatttattactaactaaattccgtagcttacattagggttcagtcttggtgttatacattatgtgagttttgacaaatgcatgatgacgtgtatccacaattatagtattgtacagaatagtttcactgccctaaaaatccgctgtttcctacttgttcatccctctcttctcccgaaaccgtagcaaccactgatcttt

SEQ ID NO: 241661 - DNA, 773 bp, Homo sapiens
ttccccatacttctcccccagttctataaaaacctcctcaaaaaattcatcagagtgttcctgcacctcaacatcgctcagggcacagcgcaaaccgtcggccgactgggaagcgttttgagggttacagtaaatgttcaagagggcaatggtctggctaaacgtcggtttatggtgcaaccaagagcacctgtctccatgaagacatgctccaattttgaaatcaaatgaacagttgactttctcggtgccaaagatggaggctggacactccgccatttcccacccgccgccgcccctgctgacgcccgcgggagacctgtggagaatcttaactgctggattgaatatgtcatattcttcctttaaaaatccaccaaaggccccgaagtaatggacgtgtttttaatcaatctaatacataaatcatgcatcagatatacttcaaaacagagcagctagcagaacaccttgaaagattcattagaatattttttttttttttacagacatgcaactaagttaaataaatgtgtgtcaactcaaaactgagatgagaaacggcagggtgcttcatagattgagactcaagaacatgggaattctaatcttgtctctgttactgactggtttaatgactttagtaatgtttatgacatatttctaactactcttcctttggccaaaacccagaacaacgtgtaatagagcattttgagcttctaagaaaatggccctatttcagttgacagcagtaaagcattgtatttata

SEQ ID NO: 241662 - DNA, 720 bp, Homo sapiens
gttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgact

SEQ ID NO: 241663 - DNA, 326 bp, Homo sapiens
aatttataaaattatcatataatgtatattaactatacatctgggaacagcaatgacaaacaaggcttctttgtgttttagggccagataagaaagtaattggttaatagccatttgtcaccactggtgaaaaatcaactcaaaatcatgttttattatttattagagttatgagcattatctataagattcatgacaccatgacttggtgtggtggctcacacctgtaatcccagcattttgggaggccgaggcatgtggatcgcttgaatacaggagttaaagactagcttggacagcatagggagccctcatctctattaaaa

SEQ ID NO: 241664 - DNA, 469 bp, Homo sapiens
gatgagtctttaatctaaagaggaatattgttgttattaatgatgatgaaaaataagtacctcatctgatcctctcaatgtcatgccctaagaagtaggcactattagtatctccattttgcacatgagaaattggagctttggtaggttaaggaagaaccacaggattacagagttaggaagtctccaaatccatccccttaaccattagtgctatagatggtgactgttcaggagcctgatcatctctatgaatcatcctggtatgagtcctgggggaggttgccctcctaggaaaattgctattccctgccccatccagaccttttatttttcacataaaacaagcaaatccagaatggatagcaggcatcctcactataataagagctacatgtggaggctcagtgctcgtctttgtttctgcttgttggggaaataaaggagagaaaagatttgattcaaatgc

SEQ ID NO: 241665 - DNA, 380 bp, Homo sapiens
agatggagtctcactctgtcacccgggctggactgcagtggcgtaatctcagctcactgcaacctccgcctcccgggttcaggcaattctcccgcttcagcttcccgagtacctgggactacaggcgcccgccaccgcacccggctaattttttgtatttttagtagagacgggttttcaccgtgttagccaggatggtctcgatctcctgacctcgtgatctgcccgcctcagcctctcaaagtgctgggattacaggcgtaagcaaccgcgcccggcctgttttattcttttattaccgtttttccctgagttttgaatcattcatatctttatttaaaaccacttcccagttatttcaaactttcttaattcccgtg

SEQ ID NO: 241666 - DNA, 525 bp, Homo sapiens
taagagacagtctcgctctgtcacccaggctggagtgcagtggcaccatctcagctcactgcgatctctgcctcctgggttcaagcgattctcctgccttagcctcctgagtagctgggactataggcgtgcaccagaacgcccagctaatttttgtatttttagtaaggatggggttttactatgttggccaggctggttttgaactcctgacctcagatggatccgcctgccttggcctcccagagtgctgggattacaggcatgagccaccgtgcccagctgccactgatttttccaaaataattatgcatccctgggaaggaaataggaaatgaaacgttttgtatataatttggatttgtaggtggcctttgtaagtaatttattagaaggtaaacaataattatgtagaaagaacctggttggtaaatataataattatgaaaccttattaattttttttttttttgagacggggtctcactatgtcgctcaggctggagtgcagctcgtgctgatctc

SEQ ID NO: 241667 - DNA, 471 bp, Homo sapiens
taagagacagtctcgctctgtcacccaggctggagtgcagtggcaccatctcagctcactgcgatctctgcctcctgggttcaagcgattctcctgcttttgtatttttagtaaggatggggttttactatgttggccaggctggttttgaactcctgacctcagatggatccgcctgccttggcctcccagagtgctgggattacaggcatgagccaccgtgcccagctgccactgatttttccaaaataattatgcatccctgggaaggaaataggaaatgaaacgttttgtatataatttggatttgtaggtggcctttgtaagtaatttattagaaggtaaacaataattatgtagaaagaacctggttggtaaatataataattatgaaaccttattaattttttttttttttgagacggggtctcactatgtcgctcaggctggagtgcagctcgtgctgatctc

SEQ ID NO: 241668 - DNA, 806 bp, Homo sapiens
actttctctaaacatgtatgcaaccataaaaagctatacataggatttctctcctttttaaaaagtatataatcttataacatttatggggtctttttccagttattttgctattatgaaaaatgttgcaatgaatagtcttgaatatacatccttgtgcatttactctctggtaaacatctagaagccaaatttctgcttggtagattactcatattaacattttttttttagttattccaaaattgctcttcaaagtaattgtaccaatttgcagttctgccagcactgtataagttttccatttctcgctaactccatcaattctttgtatcattgagttcgctgatttttgctaatctgactgatgtgaggtggtatttcattattctcatttgcactcttctttgattgctagagaggtaagagcatcttttcatatgcttgttatctatttatgcttatttttttcttggattttcattttgtctgattttaaacgaattctatgacattctgctgaataaagtgagttacataggttgtaaacaccttcccatggtagctattgaccttctttttgttgtcatcttgatacatggaagtatttagtttaatgtagttacattctcaatactttcttttctcaatatggtttatgcttttagcattataagtaatatggcagtactcagatgtcatcaagatattcttctatatattctttttaaatttagcttttcacatttaggcaactttgagtatgctatgaagtagtacccaattttaccgtctttcatataaat

SEQ ID NO: 241669 - DNA, 879 bp, Homo sapiens
gcctgctgcttgctgcaccatgaagtctgccaagctgggatttcttctaagattcttcatcttctgctcattgaataccctgttattgggtggtgttaataaaattgcggagaagatatgtggagacctcaaaggtatgaagctaaggcagaaaataaatccaaaggtcaattatgaatgagagagaaggtattgggagaaaagtgtgttatctaggtagtccaggaaggtcttcctttcatgacaatacccatagacacttagtcccttgactcagggcattacttacactaggggtcctctggatgtttgatgagaaaaaacagaaatgacacaaagtcctttccagatggagacctcttttataggaggtccaaaggactggaagtattttgaatcagaggttgtgtgacaaatttcaaagatcccagaccattgatgattatgtattgggatgagagagaaagggggttggagacagagcaaattaagacattttcagtatctgggctatggacatatacagaactcttggacagatgattcctgtttagaggagctcacaatgtaaatgtgagaggcaatgagactttcttccatagatagtgtgtgaaggctcagcgcttccaggggacgagaaagtagcacagtttataccgtaagtcagacacttcaagttctggacctgttcacttagcagatatgtgcccttggacaagtcactcaaccacttattattctcttagtctcagtttccccatgtgtaaaatgaagatcagaaaagtgcctgctgcagagggtgtttgtgagtatgaaataagattatgcacataactttaccagagagtaaattccaggctggctgcttgagtaaggtgg

SEQ ID NO: 241670 - DNA, 523 bp, Homo sapiens
gcctgctgcttgctgcaccatgaagtctgccaagctgggatttcttctaagattcttcatcttctgctcattgaataccctgttattgggtggtgttaataaaattgcggagaagatatgtggagacctcaaagatccctgcaaattggacatgaattttggaagctgctatgaagttcactttagatatttctacaacagaacctccaaaagatgtgaaacttttgtcttctccggctgtaatggcaaccttaacaacttcaagcttaaaatagaacgtgaagtagcctgtgttgcaaaatacaaaccaccgaggtgagaggatgtgaactcatgaagttgtctgctgcaccatccgaaataaagacacaagaaaattcagactgattttgaaatctttgtaatatttccataatgctttaagcttccatatgtttgctattttcctgaccctagttttgtctttcctggaaattaactgtatgatcattagaatgaaagagtctttctgtcagccctggct

SEQ ID NO: 241671 - DNA, 517 bp, Homo sapiens
agtaagaataacataattcacttttatagcatcacattttatacaaactattttgttggtgaagaaaaacgtctcatctgacatgattgcaggggaactctccttgtgttctttctctcccttgcccctaatattcttgcgcccatctataagagcacataaaatgtgtggtatgcaggatggtaatgagatggcagactttttctaacatcagaatttcaataaggatgaaatttgcctccaaaagaggacagtgatcttttcacaaacactgtcctttgtcctgaggcacacaaaatccccaaatccctaaaatatttcatctgaaggtaagataattttgctctagcttaggctgaaaaagaaagaagggggaaaagccatctatcagatgcagccagaaaagtcctgttgcttagggagaaggtaaattaaaggctcctatcttatctgtatttcaattaaaatcttatttttggtccccggcagtgcaatccgttgaagtctttccaagtta

SEQ ID NO: 241672 - DNA, 366 bp, Homo sapiens
gaaccctactcagactctgcagtgagtgactctcccaggtgtcattctgactggaagtcaagagctctggatgtcacaggcctgtgatgtgggttgcttgctcattgagcttggaggtggattttcatactaaagtacctgatgcatttttttttggccattcctccacctgatgctaatgcttttaatagtggtagaatcctgggcaacatagcaagaccctgcctctacaaaaggaaaaaaaaaaaggctaggcacagtggttcacactcataatcccagtgctttgggaggctgaggcaggaggattggcttgaggccagaaggttgaggccggcctgggcaacatactaagtctcatctctt

SEQ ID NO: 241673 - DNA, 110 bp, Homo sapiens
gacaaaccaagggaaaatgggtgaaagatagaaacagacaattcacagaagcataaatccaaattgtcagcaaacaagtgaaaaaatgtttaaattaactagtagttaga

SEQ ID NO: 241674 - DNA, 468 bp, Homo sapiens
tttgttagtaaagcaactcctctagttgttgcttgagaaaatatgcatgagaggaagttctaagctttgctgcctaggctgggtggggtggctcatgcctgtaatcccagcattttgggaggctgaggtgggaggattgcttgcttgaggccaagagtttaagaccagtctgggtgacatagtgagaccttgtctctacaaaaataaatacaaaataaactttgctgccttaattttaggttagatataattttccctgtgagttttaagaggcactgcttcatagtattttagcttctcatatttctgttgagaaatctgatattattctcttttctgatcctttatgtgtgaactgtggtaggtttcttcttcttcctctttttcttattcctgctcctctttctcttcctccttaccccaccatggacatttgtagcatctgtattaacttgttctgaatattca

SEQ ID NO: 241675 - DNA, 327 bp, Homo sapiens
tgctgttgtcactgttattgttactgtggataatggcccttggtgtgttgcatagctccctaggtattctctgtttccatctttactttcccacaccaatatacattaagcattttgcatggtctaacttgtgtttattccaaccacttggaaaactcctggaaagaaattttacatttggctgttctatgctgctaatgacacttgaccttgttgaacaaatggcagagactttcccaaggatttgattgtttgtgaattatctgcatgtgtactttctttttgtgtgtatgtatttcattaaaaaatataaatacttatgaaaat

SEQ ID NO: 241676 - DNA, 897 bp, Homo sapiens
agttttgctttgtcacccaggctgcagtgcatgatctcaactcactgcaaactccaccaccccagttcaagtgattctcctgcctcagccttccaagtagctgggactacaggtgcacacaatcacgttgggctaatttttttgtattttagtagagatggggtttcaccatgttccctaggctggtcttgaactcctgagctcaggcaatctgccctcctcagcctctcaaagtgctgggattacaggcgtaagccacggcgcatggccatgtgaactaacattttccccataccttcagaatttcaaacaaaggtaatattgataatttttggtcaataatttttgaagtagtagactgtaacactgggcaggtcctaccatctctgccttagtttcctcatctgtaagtgtcagaatcggtctgctggctcagctgccatccagcttcaagcttccacctgaagtaagcccaggacaggggtgaccaaaaagacccactgcagtcacaactacttacagagcagtgacttctcgtggcccaaacgtgggtgacaggctggtaggagcagagagaggggtctggggaagtgtgtgtggctgcatgaccatttctcatggtcagctacaggaagctttagggacaagctctgtgtctctgtggagccagagtggcagagcgtggtggatcagcttcagccagccctgggctatgcagcccccacaacagcacttgcttccaaagctttcaaattcttcctccgccctcttttccaagcaacccacctccaccccagactcctcttgagtctgctttagtgccacccctcagggcccacctggaaaatcccacaaagtcctgagaagcttgtgacctgggggccttttctaggtata

SEQ ID NO: 241677 - DNA, 363 bp, Homo sapiens
gacttctttgatgcaggtggtcaccagaccacaccttgagagacactgcactagatggtgggtgcttcaaggtcagccagcaatcaggtctgtcttgattacttgagtctccagaacctggcactgtgcctgtcacatacgagtcactcaatcaattctcctccgactccattgagtacttatgatctaccccagtcatctggcacctcttcaaatgttattgtatattatatattatatattattcactgttttgtggtttataacttgtctatcatccaaatcagaaacatcccaagggcagagaacgtgcccaatgctctttggtgtctccacccaacagggctttccatagtgattttt

SEQ ID NO: 241678 - DNA, 525 bp, Homo sapiens
gcatgtaccctgtgccccagcgatgccactctgtgcatatttactcaggagaaatgaaaacatatgtctccagaaagattggtacataagtgttcttagcagttttcttcacgagagccccaaactggaaacagcccgcacgtccatcaacaggaggatagataaataaataaccatagatccacgcgcaaccgagtactgtttagaaatgaaaaggagcggtcgcctggtgcacaggacagtgggaacaaatctcagaaacgcacgccaggtggaagacaacaggcacgtgtccctgccgtacaacgccattcatgtgaaccactaggagggaacgaggtctgtggtgactgagagcgcgtgcgtggttcggtggggatggcctggtagagggctggtaggaggggtgcctgggggcccggcatgttttgttcctgtctggatcagtggttacgcccagaactccgagcagcctgtgatccctgcgttttactggatgttaaataaagacgaggagcccacttg

SEQ ID NO: 241679 - DNA, 409 bp, Homo sapiens
atcatctaatgtcattgtctccaaagatggatatatagttcttccccatgcatacattaactcttcccaccaaaaggcagaagctatttcctgtcctctttaatttggacaggccttatgattcacgttaactaagagaatgctgtgaaagtgatgttctggggcttccacgcccaaatcttaagagcttctgcttcctctctcttaaagttaacctctacataagaagtccaactatctgagactatcatgctgtgaggaagcctgagctcaccatgtagagaggccttgtggaggagcactgaggcaccagacatgtgactgaggcctttgtgtactttccagatgagcccaactgacagctgaatgtaatcgagttagtaatcccagccaaaaccatgtgaagcag

SEQ ID NO: 241680 - DNA, 285 bp, Homo sapiens
tcaggttggtgccaggatgctggcctgagagcaggagccagggctggaagcagggctgggcgtggctgggtctttcgaggcagagctcagaggcttgtggtgatcaaacagagccggagggggagccaggggaacagtcccacatgggaaacagaggctgagggtctagcgaggcaggcccagcaaggcaagccaggtgttgggccacaggcctggtggtctgccctcaagatagaggtttggagagcagtgccctgaagttcccccaaaagttgagatttaaaa

SEQ ID NO: 241681 - DNA, 599 bp, Homo sapiens
tgggaaaactggaatgcttaataaactggagcaataaaccacttgagttgttgaatgttaagggatgactaagtcaggagataggcaagtatacttaggggtgagatggtatgcaatgttaatttttcacttacttaaagagtttaaaaacagcttttcatactggaaagctagcagtgatgctcagggtcatcagaaggacttactaccattagccaatgcacaagctttatctagaaactgctttttctgtgatctcttctttcctttcattgttaaaagcatccaaaatttattgagtaaagcagtggataacagtttagagctacaaaaattcttgattgttacccttctaatttcagaaaaagccaggtatgacacgtaattttatgggaaattcagttttgtttgttagtaaatgagcagtgttgctaactatgacgaagttgacttggcttgcagctgctagaccacattctaactttgatgttcgttattttattatttatttatttatttatttttattttttgagatggagtgtctgtcactcaggctggatgacagcgagactctgtctcaagaaaaaaagttttttg

SEQ ID NO: 241682 - DNA, 593 bp, Homo sapiens
tgttacatatgtggtgcatgagtaatcaaagatattcaaataggataaatatgatacactattttctatttttccatctatcaaactgataaagatctggacagtattaataactaatgttaaaagtgtgtgagaagagatactcttacatattcatcatcacattgaaaattgataacatttggaggctaatttggaaatatataataaaagtcttaaaatgttatttcttttgacactataatttatcaccaaggaatatattctaaagaaatgattataaatgcacacaaagaattataaattagaaagttcataatagtgttatttaaaagtgagcagtcataaattaaacaatattaaaacgatagaattggttaattattatataatacttctacttgattaatattatgtagtaaaaaacatttatatgccaatacaataaatagggcataatttcaatttcatacagacctacacacacaagtgactctcaaggcttgtgcttatcacatgtacttatttgttctcttttgttctaaaactacaaccatgaatgtgaattctttttacaaccagaatcacacaca

SEQ ID NO: 241683 - DNA, 634 bp, Homo sapiens
aatggagatggggtctcactctatcacccaggctggggtgcagtggcacgttcacagctcactgcagccgcaagcgagctcctcctgcctcagccctccaagtttctagggctacaggcacatgccaccacacttggctaattttttgtgtgtatagaaataggggtctcgctgtgttgcagaggcctatctcaaactcctggcctcaagcaatcctcctgccttggcctcccaaatatttgggactacagactacaggcgtgagccaccacacttggcgaattttttgtgttttgtagacacaagagtcacacagtatgttgcccaggcctatctcaaactcccggcctcaagcgatccttctgtcttgatctcccaaagtgctaggattataagatgagccactgtgcccggccctagtaaacttcttactcaacaaataagtatgaagtcactcaggtgtatttccttgagtcctttttacccaatggggtcctggctgggagggattctgggacagacctggcttaaaccacacctaagcagatgtaatgtgaaatccctgacctggaaattccagagcagcatattctaatctctgcctgcaatataccagctttggcctctcatatac

SEQ ID NO: 241684 - DNA, 645 bp, Homo sapiens
agccgggacctgggtggctctataatttgaggaaaggtatttaaattctctgagcttcagtttcttcatctgtaaaagtaaaaatagtcatatattcttcccgggagttttgtgaggaataaatgagtatccaccacaaagcaagtacttcttaaatatcatattatctccccagttcactattagtggcaattcattggttttcttacaagaagggggttgtaacccatagtcgtttgtattctgccatgcacttctccaaacattatagtacaaacaaagcaataatgagaagttcctgctcctctcgtgcattgggttgtggtacctctcaaaactgtgttctggaccaggtgcagtggctcacatctgtaatcccagtcccttgggaggctgaggtgagcagatcacctgaggtcaggaattcgagaccagcctggccaacatagtgaaaccccatctgtactaaaaatacaaaattagctgggtatggtggtgtgtgctcatagtcccagctacacgggaggctgaggcaggagaattgcttaaacccaggaggcggaggttgcagtgagctgagatcgtgccattgcatgccagcctgggcaacagagcaagactccatctcaaaacaaacaaacaaac

SEQ ID NO: 241685 - DNA, 590 bp, Homo sapiens
agccgggacctgggtggctctataatttgaggaaaggtatttaaattctctgagcttcagtttcttcatctgtaaaagtaaaaatagtcatatattcttcccgggagttttgtgaggaataaatgagtatccaccacaaagcaagtacttcttaaatatcatattatctccccagttcactattagtggcaattcattggttttcttacaagaagggggttgtaacccatagtcgtttgtattctgccatgcacttctccaaacattatagtacaaacaaagcaataatgagaagttcctgctcctctcgtgcattgggttgtggtacctctcaaaagctgaggtgagcagatcacctgaggtcaggaattcgagaccagcctggccaacatagtgaaaccccatctgtactaaaaatacaaaattagctgggtatggtggtgtgtgctcatagtcccagctacacgggaggctgaggcaggagaattgcttaaacccaggaggcggaggttgcagtgagctgagatcgtgccattgcatgccagcctgggcaacagagcaagactccatctcaaaacaaacaaacaaac

SEQ ID NO: 241686 - DNA, 316 bp, Homo sapiens
  misc_feature (14)..(14): n is a, c, g, or t
  misc_feature (90)..(90): n is a, c, g, or t
gcacgagctctctntctctctctctctctctctctctctctctctctctctctctctctctctctctctctctctcgtgccgaattcggnacgagcggttatgctatagatgtggaagttgagaaagctgagaacaaatattccaaggcccccatctatccctaggggtttctttctctaagaaattctcttgtatgtacacaattatttatttcccttgggtggatgtataaaaatgctagttttaagattctaatctgttgataaatatatctggggtgggaatgtggcaaactttctaagttttatatttctt

SEQ ID NO: 241687 - DNA, 500 bp, Homo sapiens
cccctgggaggggtgcgatcgtctgaaggtgcatgagattttacactgtaactgcttggtaatataatacagaaaaggcaatcccaatccacatgagtcctaataaatagaaaaaaaattggggatgaggggaaaaaggcaggtagctgggagcttttaacaaggtcggtactaaaagatcagaataaaaccacatccagtttaattaataatagctataaactgaaataattccccatgattctgcccttgcttctcctttttacagagtcatatctcttcagtttagagaaatgacttttgtggctgttcgattctcacaacaacaataactaaatcagttgcacactgttatctaaaaccatctacaaactccagcaaataaaaagaagttcatttgtctattaaggcaagcatttagttgagcagaaatatcccagtaacactgaatagagttcgtgtaatcctatggaaatcaagtcatcttgttgcactgaagt

SEQ ID NO: 241688 - DNA, 142 bp, Homo sapiens
tagaaaaatgggtaaatggcaacaggtaattcacaaaagaagaaatacaaatgtcctctcctcccgccaccaccccccatgaaaaagaacgtgtgacttcagtagcaaaaacaggtccattaatacagtgagatattgctta

SEQ ID NO: 241689 - DNA, 368 bp, Homo sapiens
gggtctggagcaaatggacacttgctcccaagcagaggctagggctccctctttgtcaaagccagactcacttgtccaggagtctaaagtctgggccagggacagtgggagggctctgaaatggaaaaaacaagaaactatgaggtgtcttatgcctagttaataactcaagcatctctgccagcatgtcttctcagatgagtataactgagaagtggacgtttatgaaagggaatagagggtccctgttctcctataagtgttcttgttatgagtttccctaggaaacggaaaagaaggtaagaaagctatccccacctgcattccaacctcaatattccaaaagctcatgatacagtcaacaggtc

SEQ ID NO: 241690 - DNA, 417 bp, Homo sapiens
ccctttttatcctggacagtgagtctggctttgacaagagggagccctagcctctgcttgggagcaagtgtccatttgctccagacccccaggcatacagtgggagggctctgaaatggaaaaaacaagaaactatgaggtgtcttatgcctagttaataactcaagcatctctgccagcatgtcttctcagatgagtataactgagaagtggacgtttatgaaagggaatagagggtccctgttctcctactgccttgttccttccctgtttactactacccagttctacccctgcccttttagtaagtgttcttgttatgagtttccctaggaaacggaaaagaaggtaagaaagctatccccacctgcattccaacctcaatattccaaaagctcatgatacagtcaacaggtc

SEQ ID NO: 241691 - DNA, 305 bp, Homo sapiens
tgccgaggtcccggcgaggtcgggccggggctgatgacattatgggcccgatttggttttccttgttagaaacatgatgaaagacttggaaacctcctgtcttacaacccaccaactgggtgcagaaaccgcccggcgtttaagccacaagctcagacaaagccctggtgtttgctcaattcaggggaaaaagtgggtgtcacttctccacgcaggagacaattaaatcttatttcggcccacccgggatttcaacagagttgaacatgaacgcacagcatagtggtttggttttacaaagaaca

SEQ ID NO: 241692 - DNA, 505 bp, Homo sapiens
ctctcagagtcccttccttatcttctgaaatgggcataatcacctcgatcacagcctattgtgaggatttaaggagatgatgagtaccaagcccttggcacagtgtctgctgcagaaacaagcacaggagtgttcctcggtagcagtggacaaatgccaatgagaaggactccaggtaggggaccagcgtctgaatcccactacacctgcactgtctcaagaagacccagtgggttttagctttgcatgacattgcacctggagccactctctgtggatgctggtcttggctaaacggttcatccgggttttccttattgacttaaagcagcggtctccaacccttttggcatcagagactggtttcatggaagacaatttttccacagatggagtagcgggggtggattcgggatgattattgtgtactttatttatattattattacattgtaatgcgtaatgaaataattacacaactccccatcatgtaaatcagtgggaa

SEQ ID NO: 241693 - DNA, 396 bp, Homo sapiens
caacgggagggatggggcggattgggagaaagtgaagcagaaaggccacaggctcaaagacttttgtaaaaaatgtcaaaagccttggagcttgtttttcagctctggccttggggcccagagctttagcagaaggctctgattctgagggccatttgcttcatgtaacccggtggttagcgcagctggatcccatgtcttggaggagggccagctgcagctggaggagctctgagacccaaagcaagttcctggggtcctccaagcctgcacccgagtttgtccatgcctgtcatgggatggttgacaagtgtgaatgcctgtgagtacctggcacagcaccaggcacagacaggcaagctgctaatgtttgtcagttcccttcctcgtggcaac

SEQ ID NO: 241694 - DNA, 235 bp, Homo sapiens
atgatatttacatattttttaaaaatacacttccaaccaatgcctaaggttatagatcaatttattatggtgattgctctgtgtagggaaattggtcagaagaggtgaataaggtgaacttcaaggtgatttgtaatacttttttttcttacataaagttataaagcaaatataaagatcaaggtgaattctggggtggtaggctcgagactatttctgtgcttttcagtatttt

SEQ ID NO: 241695 - DNA, 267 bp, Homo sapiens
agggggtttcaccatgttggtcaggctggtctcaaactcctgaccgtaagtgatctgaccatgctggaccccgacagtgctgggacctggccagcactaaggactatctttatacagatggtgagaaggagtgtgcttgatactatgtttatcaacaatgaaaatacacttagaaaacatttatacagtagtcccccattaccttcatttttgctttctatggtttcagtctcccagtgccaaaaaatatttaatggaaaaatctca

SEQ ID NO: 241696 - DNA, 903 bp, Homo sapiens
atgccagctttgagatgcttttgagagtacacatcagtcagttggcaacatttatttatggagtgtctactaagtagctagtagtggaatatacaggtttatttatgtgtaaaaaagaaaaataaaatggatacacacaattcccccttcttcgagacccttgctgttccactattctactgtcttctcgcttctgtcattgtctgttctctgacagtctccactcctcctcatttgttggatggaatgatctgatccctcacatttgtagtttcttggcctgttaatttctatagacctttaccaccactccacttcactgtccagtcccatgtccacactgtgaacctcatcactaagaactcatcaaccttaaacttcttgctctctagctggacccttctgtccttttggctctctcatttccctcccgtcctcttcctgcatcctcctcatttactttcctatttcttcccttcctattatttcaaaagcttgctggaaggatttcctctctatcgtggcctgacaaataggagacattcaatgaatacttgagaaggtgaccttctccgcttctttatctcccattcattcccaacccactggacttcagcattgacctccacctccactaaggctgaggcagggggatcacttgagctcaggcattcgaggctgcagtgagcagtgacccgctgctgcactccatcctgtgtgacagagtgagaccctatctcaaaaaaaaagataaaattcaccattttaatcattttgaagtgtacaagtcattggctgagtgcagtggttcatgcctgtaatcctagcactttgggagtccgaggctggtggatcacctgaggtcaggagttcgagaccagcctggccaacatggcgaaaccc

SEQ ID NO: 241697 - DNA, 535 bp, Homo sapiens
atccaagcaaaatacttagaaaattatggtagtaagttcctcctgaaatgacagctgatgttcctatttttacattgtctacatagctctagaaagcatgagaatttgctgtgcttgctaaatcagtagtctgtggcatatgggcaaggtccagcacactgcctctgttactgcagcccatgagctaagaatggttttaaaatttctaaatagttgaaaaaaaatttaataatattatttcttgacatgttttatgagatacaaatttcagcatccataaatgaagtttttggctctcagccactttcatttgttttcctattgtctgtgaccactttcattctacagtggcagagtagagtatggcttatgatagagaccatgtggcctgcaagcctaacttctttactatctggccctttgcagaaaaaatttgctgacccctggtctacatgatccataccagttatatgtagttgaattctataaacagtgtggagcgaggccctttcatctgtttcatttgtgcagagca

SEQ ID NO: 241698 - DNA, 445 bp, Homo sapiens
gtgcaggtttgttacatgggtaaacatgtgccatggtggtttgctgtacagatcatcccatcacctaggtattaagcccagcatcttttagctattcttcctgatgctctccttcccccattcctctcccaccacaaccgacaggccctagtgtgtgttgtggaaccactattcttgactattctcattgatcttagaatctctcattagataatgggcattgaggatctctggcagagacttatagtttctaataaacacaaaatcctttagtcacagattgcttcatgaggcttatgttttatgaaacatactttggaactgctataggaaatattccaaaattcaataaacttatatttgataacttttccacatttaactgtactaagcacaataaaataggtagattctttactgggaaccaaccagcaacaacaggaaa

SEQ ID NO: 241699 - DNA, 721 bp, Homo sapiens
gacaggccttgaaatttagattaagtttctagaaggtgatgtgggtagaggtgggagaggattctgggtgcagaagtcagaaaaaaatagcatggttgtagcaaaattctagatgagcaaaacccatttcactagaacagagggcaagggtgcagtaggagataaatctggaaaggatcacttagctcatatcctatgatgaacacagtgaggaaattacacttaattccattggcagtgggttgatgaattttgcacagagtatatcattagaatgtaagcttcatgagataaaatgacaacaacaactgtgtgtctttttctctgactctttagagtctagcacagtgtctggcatagagagtgtgtgcttaagaaatatttgtgacttcgtgaatcacagctgtatcttagcaacgttaatttggcagcaccaaatagaatgagttataggggaagactgggagctgtgagaccaatttggaggtgaatatggtagcttggctgagaattaatgaagacctttgagctgagctagaacagaaaggatggaggctgactggtagaacattgtggaagtggaatctgaaggactagacatacaggagaggcagagaccctttcaatcaagggactagattcccaaaacagagggactagattcccaaaagagagtgacgaccaaaagaaagaaacctacacgttactgttttatgagaga

SEQ ID NO: 241700 - DNA, 597 bp, Homo sapiens
gttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaag

SEQ ID NO: 241701 - DNA, 391 bp, Homo sapiens
ggcattaatagttttatttatccagtcactgtgcctggctacctcttcttaaaattcaagaatttcttctccatctttcctagaaaatgtttacacggtgtctttttggtgctctttagcgacaacaaattcatctaataaggcaaacttttgtttgtttataagtttagggaaatatcatttttttttaggaaatgtaacataaaatcaaaagtaagattagtttgtttcacatctttttacttttacctttcattttaaagccccatccctcctacctttgaatcccaaaagtggatccttgctacatttgaaatagcaatggaaaatcctcactagaatggtattcctcaaatgtggtaaacaagagtgtcatcttttagtttctaaa

SEQ ID NO: 241702 - DNA, 389 bp, Homo sapiens
tctgccgccaaagactgcccaaatcaagggctcttccatgcaagatgatgctgcctgtccagataagcccaggaccctctctttgtccatgtcactgtccttggactagttcattaaccccttttcctctccccgtgtctcttgatgttaaatgttactctgtttgatgtggactgcttaatctaaacatttatatattaagtacactactaggtatggtttgcagtactgactgagctgtggagtggcttgagcctgtgtgaccacagctctgattaccgagtgaatggaaaacactaagaagttccttctgggaaactgcatggagcacatggattttatgatggaaatagtatcaataaaagcctgaccttgtggaaagacacaaa

SEQ ID NO: 241703 - DNA, 755 bp, Homo sapiens
aatagcaaaacgtttcctttgattcttttggctttcatatttgttatagccattgttaatgtcaagcataattatagttactaataacaataaaaaagcacatatagacaagagggcagctcttgacattaaaatataaacatgcttttccagagttaaggtggaacttaatctcctggccatcattatatggctacagttgcttatctgagttgatttacaggattaactgcagggtcagatttaataatcagtgatggggttgaggacacgctgccccaaaatatggcaccttggcaaactgaattttttaagctgaaggatttgagaaaatggcaaattttaagtggaaatattactctgaccttcctttgccacctttctccccggaagcaggtaataaaacctttgctgaccttcctctaaaacacatcataggaccctcatgtgagaggtgctcttcctgtatccacagaggaaaggcagttccctatctcccaagacacagggacccagaggagaatctgaacaaacgggctctgctaagtttccctccatttattcctattagatctagtactctttttgcctgatcatatttctgcaagtgtctctccattcttcatcaaacctactactaaaaacactcaagtgtaactgtttcctctgatcttcacttcctgaggatggcccttgtgttacgtagaacttgtttaaataaaccactatgtttttctctggttaatcttttatta

SEQ ID NO: 241704 - DNA, 126 bp, Homo sapiens
taactgggaatatctttattgtgctttcatttttgcagttctagtggaaaaacagaattcttgattgaaagatttttcctttggcacttggaatgtcattctactgccttctgtcgtctgtcattt

SEQ ID NO: 241705 - DNA, 509 bp, Homo sapiens
cagtgctttctaagtggtgtgtggacaaatgctttgtttgcatagttttgtacttatttcattgtgcattggaagaaaattctagctgcacagaaagccttctgtggatattagtgcttagaataaggctaaattttgggaaaaaaacaagtgagtcaattcaaagaaagctatccagtaaacagcagagcaaacagtacacagatatggccaagagctggaatgtgggctgggcgtggaggctcatgcctgtaatcctagcattttgggaggctgaggcaagaggatcccttgaggtcaagagtttgagatcagcctggccaacatggtgaaacctatcacaaacattagctgggtgtggtggcgggcgcctgtaatcccaactactggggaggctgaggcatgagaatcgcttgaacccagggggtgggggttgcagtgagccaagattgggccactgcactccagcctgggtgacagagtgagactctgtttcaaaaaaaaaaaag

SEQ ID NO: 241706 - DNA, 176 bp, Homo sapiens
ataataataataataataattaagaaacagagtcttgctatgctgcccaggctgtctcaaactcatggcctcaagaggtccttctgccttggcctcccctgccttgggattacaggagtgagccactgctccccaccagagctggggttttacagacagtatctgaggtctgtggg

SEQ ID NO: 241707 - DNA, 221 bp, Homo sapiens
attctccctctagtggaatataagctcctttgaggatggtagaaataatgaacccctggtttgcattactgattgtgccagaagattgctactgtgaatgaaaagctccgaaggacaaaaatagatccatacctgatttcctgctcattatcatgaaaaatattcatttctcaatgctgcttataccaaggaaataggaataaagtaacaatgcacacaaa

SEQ ID NO: 241708 - DNA, 531 bp, Homo sapiens
ccttccggaatttaacaggaaaaggttttctgagaaatctatgcacattcaatctacatttaaaaaatatttaatagtgtttagaggtccttggaagaacaatgaataaatatttttgtcaaaggaagatttaatgggaaaacatgtaacttccattcgaacttcactggactctgattaaagtagcccagccaatgtaacccatgcagaaaaatgtcccaaaggaatggttataatatagctttctgataatgtttggttttaaatacttaatctatgtctgtaaaaacatatgcttgtgatttatttgcttcacttatttttcatgtatgtgtgatatcaaataggttcccagacataaatgctccgttaccgcaaatctgagctgtggttgttacgcattcactgttcaggttttaagtacctggtgagcaactgtaggctaggcattctatcagattctagaaaggcattaatgaatacggacataatgaatgatcacaaaaatgctaattaccagacatgagcaaa

SEQ ID NO: 241709 - DNA, 427 bp, Homo sapiens
gcttcagccctggggttacccgatctgacaaagccttttccattgtatgtgtcagagagagaaaagatggcaggtggacttttaacccaaactgtggggccctggatgagagaagtccttcaaatgtaattgcaaagtcagagacctacagggaaatggggatcaaaagctctcatcactccagatgctacaaagccttcccttccagatgctaccgattttactccccagagcacagaagaaaagttcgtcattgatgactgcagctgtcatactgaaatcatgaagctaaaggctacagagggctactagaagcctgagtttctgaagactgtgtggaaccatcaaagcagccctgaatatttcccttgagacttttccattataggaagggcaaataaatagatgatgtatgatgtaaaaaaaa

SEQ ID NO: 241710 - DNA, 411 bp, Homo sapiens
ctcttttctaagaagacattcatctcttttctgagaaggcatttctgcaaaggcattcatcatcatcagcctcctgagtagctggaattacagaacttccaagatggtggtgagccgcttccaagatggtggcaggccgcttccaagatggtggcaggccgcttccaagatggtggcaagtctcgtgttctctgacctggggttcttggcctcatggagtccaaggaatggaatcttgggtcatgcgcagctgtcatactgaaatcatgaagctaaaggctacagagggctactagaagcctgagtttctgaagactgtgtggaaccatcaaagcagccctgaatatttcccttgagacttttccattataggaagggcaaataaatagatgatgtatgatgtaaaaaaaa

SEQ ID NO: 241711 - DNA, 512 bp, Homo sapiens
accattctacaaactagaaatgataattatatgccatatgttaagtatgaaaggtgaccttgttatttggacagtttttactcttaactgtggatggaaagaatatcagggatgtttccttggttattccaaggaattgcactatcctattggagatcaagaaaggggctataattttaagtaaagttttccctgttaattttatcatggtttctaaatatacaaattagattttccttgatgtaaaggttacttactctttcttatttcaaacatctttcttctcctggggagtggttcatagtcctgtaaaatattattgctgatctattttctttgtatttctctatgaatgtacttaatcttgtcagtgagtgtatattaagtgcttgttcaagtcctatctcaggtattgccaatgagcttttataaaatggaacctcttaaaatttacaatgtatgctgacaatatttggagctatacagtcaatacaaaagattaacttttaaaa

SEQ ID NO: 241712 - DNA, 507 bp, Homo sapiens
gtgtatcatcatcaatgcctagttatttataagaaaaaatgatactcattagatttatgttatcaagatattcaataatatgaattttattagattttttaggtgagtatgaattaccttaaagttcttcaatttctagctttaagtcagttagaaacaaaactaaaaaattaaaatcagccaaagttcaaatatatttttatcctattgctcttctttattgtacattttcacgttgtatttcactttttgagccacaatatttcttaataacatgaagaattgttcttttgcattgtcagagcaattttatattataagctataaaaaaaattttgcattcactttttattaacatggaatatctgttaaactgtaccttctaaattcaaaaggttgaaatgttgaatagtactaaatattaaatatcaaaatatgtttgaattaggagttattcattcattcacaaaatttcgtgaaccattattgtgtccgaaattggtgggt

SEQ ID NO: 241713 - DNA, 619 bp, Homo sapiens
agggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaatacctccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccagg

SEQ ID NO: 241714 - DNA, 337 bp, Homo sapiens
  misc_feature (156)..(156): n is a, c, g, or t
gagaccaggctcttgctctgtcgccccccacatgttgagaagccagtgttgtgatcttttggctcctggtaacctcccggcctcccaggttcaggtgatccttcatgcttcagccactggaagtagctgcaattacagacggtggcaccacccacncctggctaatttttgtatttttaggattcaccatgttgcccaggctggtcttcacactcctgagctcaagtgatgcacccacctctgcttctcaaaatgttgaaattacaggcatgagccactgtttccagccaaactttgtatctcttcccagtgcacctgctcccttctttcagcagcc

SEQ ID NO: 241715 - DNA, 617 bp, Homo sapiens
gtagccccatgcagggttcccagctttctccccttttaacccagtttctttttccacactttaacatctctgaaatgactatccatgatataatcaatggcatcttacaactgctaccagcagaacagcagtcatggtatactagtcatccaggaggtgtgaacttggctgttagtcttgccgacattattggacaactgcaacctcttgacgtttcaatcagtaaactctttaagagccatttgaggaaggaaaataagccttatttgttccctgaaaatattctgttgatatcttctggtaaagtcaagaaagtgccagcatcaaaacttgcagaatgagtactggaggcttaggggaaaaaatctcagaagcatactgttattagtagtagaacattctactaagatatgttgtcatcatcaaaattattcaagaattttgaatagtaattaagattactattataaatgggaaaataattagaatagtgaaactagtttatttcactcataatttactttgtatatatacctatgagtgatatatgataaaactacatttttaaaatcaaaaggtctttcaatatgtatacaataaaaatcctaagaattaga

SEQ ID NO: 241716 - DNA, 547 bp, Homo sapiens
tgaaacagggtctcattctttcacccaggctagattgcagtggcacggtatcatgattcactgcagcctcaaactcccaggctcaagctgtccttccacctcagcctcctgagtatctgggaccatagttacgcaccaccatatgcagctaattttttaaatttactttttgcagaaatagggtttccctatgtgactcaggctggtctcaaactcctgggctcaagtgatctgcccatcttgtcctcccaaagtgttgggattacaggcatgagccaccacgtccggccctgaatctttttttaagagacagagtctcactatattgtccaggctggcctcccaactcctgagctcaagcgatcctctcacctcagccttccaactagctgggactacaggcatgccccaccacacccagctatcctgaatcttaaaaagactcttatcgtctaagagcaaacttcaaattagaggtgccctaggatttttcacatatcaagagccagtgaccagccaaacttgggaacagagaatccaagagtta

SEQ ID NO: 241717 - DNA, 314 bp, Homo sapiens
gttgttttgatttttatattgacatgctttcagttttctcttattgttttttgtgtatccatatggattttttttagtggtatcttagggaattacctaaaacctctaaaagattcaacaatatattttaatgtagtaagaaattagcttcagttgcatacaaaaattcttattacatctgccttaaactttgttactgactttactaattacattttttatgttgtatattcatgaacagatgcttataatttctatacatttatcttttaaattttaaagaataattaaaaaagttttctgtaccattatga

SEQ ID NO: 241718 - DNA, 589 bp, Homo sapiens
gtacttaactgcagggtattcagccctgcagttattacctaatgttcccatgaaaacattatttttatttctttcaactctctgtctaccatggttatattataagatggtccaagttatgccctctaacaaatattgcttaatatgtaatgtacatttgtagttcaatggttcttaaccctggctgtacattagaatcacccagggaatctaaaacacatacatgtacaccagagagtgggctccacaccagctcaataaaatcagaatatcctgggtatggcttggggcatcagtgttcttttaaaagctcccttaatgattttaagacagccagagttgagaaccactagtttaatgggataaaaatgtgtcatttattgtaatctgcgtttgttggagaattttttctcttagtattatagtaatctgaaaatagatacgcttttgcaagtaaattggatttagcaagatttcttgtgaaggagttcttatcttagccgaaaccttttaactgtacttttgcgacgatctctcctcgcatacttataatcttgaaagaaaaaaaatacttctcaaaatattgaca

SEQ ID NO: 241719 - DNA, 169 bp, Homo sapiens
tctaccattaattccatctacttctaatacatgccacaataaaatgccactgaatttctaggggaaagttacagttttaaagatactgctcataaacatgattttacttacccaaattctatttagtctccaggaaataatatactaatctcttttctccttttttttt

SEQ ID NO: 241720 - DNA, 189 bp, Homo sapiens
ccaagtagctgagattacaggtgtgcaccaccaaacccggctaatttttgtatttttagtagaggcaggctttcaccatgttgaccaggctgattagtttgtatatttctttcttcctttccttttttatttctagaagcatgttaattttaaaatataaattatgacatgtaaaagccttcatttctc

SEQ ID NO: 241721 - DNA, 436 bp, Homo sapiens
gttggacccgttggatcgaattcggatccaatttgcaaaatctctaaacacttaattgctggttttcacaaacaagtatgagccagctccagcacaccactgtctggcagagttgtgttctcaagagcctgggaatccatttcaagaagatatacatctatgtgatgggcagctcttggctactgaatgagtttaagtagaggaatgccaggatcacagatgtatttcagaaaagttctactaatgtatttgagaagacggtctagagaagattgagaatacaaacagagactactatggtcactgctgcgtagtgcaggagtgagagagattatagtaactgagctaagacagagtaagggcattaaatgatataaatgcctaagaaactgatatttctgtgaataacagcaacacattctgaacagaacttaaa

SEQ ID NO: 241722 - DNA, 581 bp, Homo sapiens
ccatagcagggtatataataagtatgtattttaaaagttcattttgtttctctgaatcgatgggtgttttaatagcagttactaagtaattttaaaacatcacatcatattccatcagtcattttcaatttgtattagtatagtacttaatgtggtatctggtaagattgactagtcttcgttgtttcttaatttttttttaataatattacttctttttccaaataacttaaggattttcttttaagttttctaatgctcattcttaacatcttattaacatgttacttaatcagattttcttgccttctcttcttatacattagataaaaagtgttatagttgggaagtagttgattattttgtttcatccaatttgttgggtccccatgcttccattccctaagttttactttttacctgataattgagaatgtgtttgtttaatgcagtatcagaaagcaacaatgtttaatgcagtgacaagcaaagcttatgtgtaatttctgatgtgctttgatctttagaaataagaatggaaccatgtgcatcttctgcaaagatgaagagtaaaaataagg

SEQ ID NO: 241723 - DNA, 420 bp, Homo sapiens
tgctagatttccacagttctgctcttactgcttgcatcaaatcaactctgaaactctccctcagatctttgaggtctccgtagagatctgtaagtgaccacaccacatttccaccatgacagacagtgaaaccaaaccaaaggacggtgctacctgatgtgcgagtaacacagagagaaaagagactctgaaaaggggcttattaaatagcagcttgcttgcctcatccacagctgcaggaaggcaggctccttaaaggctgtcagggagggtgtagcgtcccgagccacgttaaaaccttttccaaaagtaatttcttctctcagatgggtcacatttttgaatacattaaattctacttgaactgctacatttctaaaggatgatatgtagctttctctgataaacaagaaaggccca

SEQ ID NO: 241724 - DNA, 221 bp, Homo sapiens
tcttcaaaggagagtgatttgtctcttatgtagctggaaaaatatttttctttagaaagacaaactcgccgtccttttcagaattagcctgaaacctgttctgatgaacattgttggctctcaggaagccagggctgagctttgggctggtgcactgcccatctttaatatgccttgtgttttgcataataaaaaaataccccatgcactcttaactgtgt

SEQ ID NO: 241725 - DNA, 515 bp, Homo sapiens
aaatgtaactaaaattaaatttcacttaaaatcagcatccctggttaacagacaggaagatagttgtattatttctagtgatggcaagaccatttcccaagggatctgtttacttttcagtaagctcgctcaggcctgcctgttgaaatacccctggatatgcaaatagagtataaagaaatttggttttctagttagttttgtatttagaacaactgttctgtagaaatggagtacaacagattagtcaccatcatttcaacatcacctaaaatcacattagtttttgtggcagcactgtcacttgctaaccaatactacaaaatgccattaacacacatatctaagtatgtttttttttttttttactatacccagtcaacctaggtttcaacctccctgaatttacatataaattcttccaatttcttgatttctgtatttgtttcagttaaatttataaatgctgtcattcacaatggctatcacttccttgatttaatgtcatctgaaca

SEQ ID NO: 241726 - DNA, 925 bp, Homo sapiens
tcggcctcccaaagtgctgggattacaggtgtgagccaccacacccagccccccactttcaatggatagttctcttgaataaaattcaagatcagaaatcattttcattgagaatttatactgtcccatcagtaggttccagtgttgatgaaaagttgctactctgattcctaatcctttacctgtgacctagttttcttctcttgtgaaaggttttagtttttcatctctgatgtgaaatttcacgaaggtgtgtgttgatggttttcatcacgcctggtgttgctttttcattagcccttccagtggggggcacatctttacccgtccttggaatttgatttttctcttctgttcttttcttgggcatactagactgataactcgtattctttttattctatttccattgtttccctccttccaaaaaaagtgctatattttgtaaccctttttatgaaatttacttcaacttttgttttcaatttctgaatactctatttttatactgcagtgtcttctcatctctctaaagacatgaattatagtttaaagttactttctgcttgtcttcctgcatttgtttcctcacagtcaccttttcttctttcctttggtctctgtgatgatggaaactttcttcaaatgtcaggcagtccttcactgtctatttaaaaaaagaaaaaaaaaagccatttggaagctctctagaaggcattccagcaactggcaggctcagatggccaactgactttttgctagggattcccaaatgtcagtttgtagagatctttttctgggttggttcagtttctccagaaagggatcctgtgttctctgctggaaaagtggggaacagtggagggaaggggtttgtaaatgtccctgacagtattttggagcaggatgggttagaggatctcac

SEQ ID NO: 241727 - DNA, 387 bp, Homo sapiens
ggtggaaaattttgtacagaatagtaaaatgaatgacatgtacttagctggaaaaattctagtgttagaaattacttttctctccttaaaagatgtagatactgctatttatggcacggaatgtgattcaatctcacatctgcttaatcagaagagctttctgggctgaggatatgaactcttcagcactgtgctttgttacggtggtagtagcttaatagcagctgcatttggtcttttgcagactgagtccttgtaaggaggtgatttcctttactcttgctaagaatgtggagcgagggatgtatgctctcagatgaggaggcaggtgtattttgccctcctgtcatctgcagtttactatgaatgatgacctgacaaccatag

SEQ ID NO: 241728 - DNA, 386 bp, Homo sapiens
aactcaaagaagacaaagcttgtgaaaatattttatatactgaagtgtaagcttacgaaaatttcagagaacctagtataaattggacgtgcaactgctaatggaagaatgcctcaagtaagcatgtatacgactccaataaacacactatgcatgctcccctcccaagtcctggcaagccactgtgcatgcagacagcccaccccaagggaaaaatcaggggagaagggacatagaccccagaagtatgccaacgtataaaaccctaagtcaaaggtcaaatggggtacttgactttcaagtcgcccacttggccctcttcccagtgtatttccttccttttgttcctgctgtgaagctttttaataaactttcactcctgctct

SEQ ID NO: 241729 - DNA, 287 bp, Homo sapiens
taaaaagccacaatacccttatcacatataaaatgtgtgccattatcactcttcctatcatgaactctccagtcagtgctcacatttcccagtgtctcatgaatgtcatcatttctcttttttcaacttgtttgtttgaatcaggatacaaataaggtcactgtgttccaattggtttatgtgtctttaagttactttgtttgaaagtcatttggaatagtttttctctttgtggtattaaagtaaattacaatgaagaccaggcctaaagaatccccgagcaaaca

SEQ ID NO: 241730 - DNA, 471 bp, Homo sapiens
tctcccgcggtcctaggcaaccactaagctgctttccctatctgtggacttgcctgctgtggacatgtcgtagagacagagtcataccctatgtgcttttgtgtctggcttctttgactgagcactgtgttttcaaggcgcgtttatgttgtgtcctgtgtcagcactttctttgtggctgaataacattccattgtatgaatagacacattttatttacccattcatcggtgggtggacatcctgacacttgcttttgtagatgaagttttattggaacagagccatgcccattcacaatgtgttgtctactgcttttgtaaataaagttttattggcacacagccatgcccattcactgtgtgttgtctgtggctgctttcaggccacaaaggcagcattgagtagtgagtggcagcagagaccacctggccctgaaagcctaagatgtttactatttagcgctttaca

SEQ ID NO: 241731 - DNA, 514 bp, Homo sapiens
aggattcacttttggcactctcgcctggctcagccacctggaatcaaggaagacagcacagtgctgaccccacgctcctgccaatgctcacttcctcccctggggtcatttcccaggagcagagctgcaggccggggcctctgtctgcctgtggtaggcacccacactcattctcatctggttccttgtaagtcttctattgcaaaatcttctcaggacttggagacatgctattctcggtttccccaataacaaaatgaaagtgcaaaggtgccgtgtcagcaggtgggccgtggacttcgcacctgggtgatggtgaacctgcctccaaaattgccatgggtccaaagaggcgccaattcctggcaaaactgatgacatttatgaattttatttctggttgcaacctgattttgttatggacctatactgacgtcagtaataaacaataataagattgtaaactattgctctttataataaaataatgcctcttggctgtattataaatcta

SEQ ID NO: 241732 - DNA, 399 bp, Homo sapiens
catcccactgccttgattcacacccagcccacagacagactagcaagctgcaggggtgtgaggacgggtagccacgggcagcctcctgcctcctgcctcggagccctgcccttccaggagctggccttggccatgtgcttggctgcagctagggctctggccttgcccaactccccctaggcctcattctgcttctatgttccctgcaccccagtcctccccatggtcaggggtccttgctgcctgggtagacattgtgattgctgtcaccccactttctgtgcatgctggtggagggtgaggggtggcctttggagaggggggcagtgcactggctgccgggtcacatttctgttcttacacattggtttttcctctggtaaactggacaaggtgtga

SEQ ID NO: 241733 - DNA, 676 bp, Homo sapiens
gaatacaacacactggaattggcacattgagtgcacctttgactgcattgtactgtttcgtggtttaaacctgtctttcctttgcccttgctgtttgactactatgattgagctgccaccttttcacacaatattggaattttttgtttgaatctctgtttaccctactggactgtgaatcttgagggaagaaaccatatcttattgatcatatcaataagtgcctgtacgtagtaggcacattatgttcatttttaagttgaacaaaattggaactaatttgttgaaattatagtcctccaacaaggactcacttgaatacatcagataatctttctttctttttctctctctctctttctttctttttctttctttctcttgctctctcacgctctctcgccctctcacactctctcgctctgttgcccaggctggagtgcagtgtgatctcagctcactgcaacctctgcctcctgggctcaagccagcctcccacagtctcccaaacagttgtgactacaggtgtgtatcaccatgcccagctaatttttgtgtttttttgtagagacagggttttgccgtgtagcccaggctggtcttgaattactggactcaaggtatctgcctgcctcagcctcccaaagtgctgggattacaggcgtgagccaccttg

SEQ ID NO: 241734 - DNA, 801 bp, Homo sapiens
ttattttttgagacggagtctagcgctgtcgcccaggctggagtgcaatggtgtgatccccactcactgcaagctccgcctccagggttcacaccattctcctgcctcagcctcccgagtaggtgggactgcaggcacccgccaccatgcctggctaatattttgtatttttagtagagacggggtttcactgtgttagccaggatggtctcgatctcctgacctcgtgatctgcccgcctcggcctcccaaagtgctgagattgcaggcgtgagccaccgcacctggccaaattcatcagtgttttgccttgtgcaatttttcattccaatatccctacagtgaggagcctcatctccaccatccaaaatagcaactagagtgtcagccattacacccatgttccagtaagcaggattgacgagaaaaaaaggaagaatctgaatctttccttttaaaaagtataatacaatactgcctcttaccgcttatttgtcagactttgtgacatagctgcacaaggatgcaagggacgctgggaaatataatcatttagctgagtcaataggcccttaaagtgaatttgcagttttatgttggagaaggagaagaacaatggatttcttgagataatcagtggtctttgtgatagcctgcgctttgggttattcaactccttccatgtgcattcctctcctacaaaaagaacacgcttcctctccagcagagatgaaccaaagtcacccccagttactgcatctagctcaaagtccaggatctctgggtgatgtacagttctct

SEQ ID NO: 241735 - DNA, 3008 bp, Homo sapiens
  misc_feature (211)..(211): n is a, c, g, or t
  misc_feature (692)..(692): n is a, c, g, or t
  misc_feature (1324)..(1324): n is a, c, g, or t
  misc_feature (1714)..(1714): n is a, c, g, or t
  misc_feature (2847)..(2847): n is a, c, g, or t
  misc_feature (2875)..(2875): n is a, c, g, or t
  misc_feature (2882)..(2882): n is a, c, g, or t
  misc_feature (2888)..(2889): n is a, c, g, or t
  misc_feature (2915)..(2915): n is a, c, g, or t
  misc_feature (2941)..(2941): n is a, c, g, or t
  misc_feature (2964)..(2964): n is a, c, g, or t
tttaattaaaagaatcaaagaaaccaaagttaagaatttaaattttattttggcatttgttactggttgtgatatataattttggtaacattagtgagggatcaggtttaaaaaatttctccaatgttgtcttctgcagattgcaattgtcttgcaactgctgttggcaaactaaaaatgcttttgctggttaaggtaaccagtcatttcngaactttttttcagttgtaagggcatagaatgaacgtgcacgcctgatttagtgtattaaaactaatatcatgtgaggacattttatagataagaggttagaaggcaaacgactctattttgagaaaaatttggagggaacctttctttcaagataaataaattatttactgtccagaagtttatcatgtaattatctggatttttttttttcatttctctgagctttagctcagcctcgatggactctgatttcataaatacattacatttttcaattttagaagtcatgggaagaggcacacaactttgggaatttgtgaaacttaaagcaagtataatgaagagatacatactcattttgtttgtgttctgtttccattccattaacttctactatcactcaggttcatccttgttgaggcctagacgagtggaaggtttctcattttgaagttagttgttttttaattggtcacgcnaaagaaaggcttacattgattttgaaagacaaaacatgtcattgtttttttcactaatgcccaacttctacatggctgactggatattgttcaaattttccaaaagaatagaaaagagagagaaacacccttcttttggatccgaagccagtcatggaaaatttcatcctgaaaggataatttttcataaatatgcaagcagcagaatggcagtgtggctgcaatagaatctgccccaggacttccatgcatagtactttgctgtaaacacgaaactacaggcacacatatactcaaaagaatacacagtattggaagcctaattatttccactaagattgagattattccctctaagagctatactggagaaagcaatgtgtcttacttcactttattccacatcaattcacaaatttttatagcatatatactctgtgaaaggtgatactgggctaaagaaaataattctgccctcagtttgcaatctaacagggaaaataaagtccatatatattaaaatctaagtctgtttataataagtgccaagtagacaatatggacaggaagtactgtggatctaaggaggtcaagctcatgggtgtacaggttgtaatagttatgaagccttntcagtagcagtagaacttgaatgatggggtggatcgggataatgcacagagtgggtgcatgtggaacacttacaagaagaggggatatggggagctgatgtccaccaagaacagggagcctgtagtctgcgggtgtatgtggggccctgctgtagtggtgttgattgacctctgtaggcactttgccttccttcttctgtgttccctccagctagggtagagaggactggttcagcttggctcttccgggcctgcccaaaggaccatgcaacatgaaggtgaagtccttgtagagcaaagggcatgagaagtctctcttctaaacctaggctctgccctgtctccataattttatttcatgatgttagatctgggaagagatttagcacntttctgtattagtagagcatttgagggagatgataactattaaacaagagaggtaaagagaaacattcagagatgaacaggtttattgggataaagagtgagggtacagatttgaggctaccattcacagaccagggctagctattctagaaacaatagatgtcattagacaaataatgacatgatggtttgatattggtgttctaaacctccagaggttaataactttgttggatttcagtggtggacaccagcaatcttaggaggtctagcagcaagactggttcttgccaagttaggagatgttagtttgttagtgctgattggatggaataagcatacaaccgctctgtgtgcccccttctttcccctctgcagggtgtgagaatggaaaaagagaattacacttctgataacctaaatattcgctaacctgtggtggggatgcttattttggccttttaggcgcaaacttgtttctttaactgttagttttatggtgcccagggttaaactttaaagttggactgtttacatgcttgcgacatggtgaaccaaacggggaaagtaagataaaaacaggcttgataaaggccagccgacttctgccagtaggctaaaactcacagactctcagatatatacatacatatatggccaagatgtcttgctgttaaatggtctttaagagagcagaaaagcctttttaacaaatgcacctattgtagagtctttccaatagcctatacctttcaacttgtgaagataaataagaacatatggtttgtctcaacatgcttttaacaaaaaccagatgaacacatgtaaaacaattagagagttgtcttaggtaccctgaagttcttatacaggatatttgctcttcattcaacgtttattgactacctactgtgttccaggccaccagaccctgtgttagaggttagagatttaaaactctagtaacttatgtattataatctatacatgtcatttaaagacatagcatttttgggctgagtgcggtggcgcacgcctgtaatcccagcactttgggaggccgaggtgggtggatcatgagataaggagttcaagaccagcctggccaagatgctaaaaccccgtctctactnaaaatacaaaaattagctgggtgtggtngcatgcncctgtnntcccagtcactcgggaggctgaggcnggagaagcgcttgaacccaggaggcngaggttgcagtgagccgagatcnccccactgcactccagcctgggagacagagcaagactctgtctc

SEQ ID NO: 241736 - DNA, 475 bp, Homo sapiens
agaaacactgtagcttttaagaagagagagaacagttcctggcatatagtaggcatgtagcagatgtttgaataaatggaatgaatgtatgaatgaagcctaattagcagagcctttgtagctgtagtgaagttgaaagcttaagacttgaagagaagtggtgcaaaaaaaagcagttgaggccaggcacaatggctcatgcctgtaatcccagcactttgggagaccaaggcaggtggatcacttaagatcaggagttcaagaccagcctggccaagatgatgaaaccccatctctactaaacatacaaaaattagctgggtgtgagccgggcgcggtggtgcatccctgtaatcccagctactcgggaggctgaggcaggagagttgattgaacccatgaggcagaggttgtggtgagccgagatcgcctcattgcactccagcctgggcaacaagagcgaaactccatctca

SEQ ID NO: 241737 - DNA, 478 bp, Homo sapiens
gggaccagggattggagcactttcaaaaaattcttatttctcatcactgcttctctttgcttatcgtttccaagattatatctctctgttgaagtgtccattttagcttgaaattgaaatcctttagttccaatttcaaatttctgagaaacagaatacccactattgaaccagcttggggcacccagtattgaaccaattagttattgacagagggacatcatcttacaaaaaagtctgtgggtgccacatagatagtgagtggtaaatagataaggagttatctgttcagcatttttttttttcctggcaaaaatgtatttactacattcattgactgaaagtgaaagcttctaggtgactttatggtttgctgtgcacaaacttgcagtattaattgtgtattttgggggaacttagtaaaatacaagtctctttatctctgaattacagtgtctttatctctcagtcatatttc

SEQ ID NO: 241738 - DNA, 506 bp, Homo sapiens
gataattgtaatgatgaagatagagtcaatcattcttccttgttatttggactacacggatctggtcatgctgtggttcagctcttgacccagagaatatgagcacatgtaaccacaacctaatgtaatggagttctaggtcctgccctagccttatataacctcccatttagaatgtgtataacattgggtaaagtgatggacctcaatgaaataacattacatgtagttctatgcttcaagtaaatgcttggatattatgattttgtaacagaagtcatggggtttgaaatggctatttctttaacctttggcccatctcttttataataaaagcaggccatcaaatgaagtgctggttcttaggagagagatggcgtcaagccaactgcaaagaaggtaagactgaaaggaagggcatatccttttactaacccagggagaagagtctgtcaaaattggttctggcacaaaagatggaataaagctttaaaaatggtcgcact

SEQ ID NO: 241739 - DNA, 686 bp, Homo sapiens
gattttataaatctgtagtgtataaaaggagagttagaccagaaatatgacatttatttccttcaataaatcaagttagatagttttaatttataatggtataataaatacagtttaaagaatgtgaactattttaagtatgtaatgtcaaattcataaaaggatgcttaggatccaacatactacaggattcaaagcacatgagacaatttattgtgcaaaagacaaaataggaagcaaagaagcctaaaatataggaggaaatcataatagtgtaaaatgagtctgtaaatttgagggtttacagatacttaaagtatatgggggaatattgaataattttgttgccctatttgcagtattgcctgaaaccaagattattggaagaaatcaggaaaactggctttgacaaaaagaaataaaatgaactaggattggccttttcccaaagcactgcttaaagaaacatcactatttttaacatgcagaaaagaggtaaaaacagtaagaatatgatggggttttgatttgcatagaaaaggtcatagtgaattagaagaaagctaacattagaattatacacctgtctttttaagtagtctgcacaattttaggaaaacttgaatatgacatttggaaagagttccatgtggaaaaaaattgtaaaggttagaaaagaagctatc

SEQ ID NO: 241740 - DNA, 457 bp, Homo sapiens
atagtataaattcctaattattttgtgcttttgacacctcagagttactaataagggatttcgttttaaaatgatatttatttatttatttagagacgcagtctttctctgttgcccaggttggagtgcagtggtgcgatcttggctcattgcaacctctgcctcccaggttcaggcgattctcctgcctcatgcctgtaatcccagcactttgggaggctgaggtgggtggatcacatgtacataattcatatttcttgttgtatgagtgctagacttatgtgggaaaaataaacaccttggctgtttaagtaattatcagtttaattttcaagtacctatggttaaaaacattcttgactgatactgctatcatttattaattaccttacctttttctcaccgcctttattttatctttgaaaaaaattaggggtcaggcaggtgtagttatcta

SEQ ID NO: 241741 - DNA, 508 bp, Homo sapiens
ggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggcctcgacttgacattggtccactctttatttaacatttgctttttaaaatttttatttcggtaaactatatgaacataaaattcaccattttaacaatttttaagtggcattaagtacattcacactgttgtgcggccatcaccaccatccattccagaattgtttcatcctctcaagctgaaattctgtgcccattaagctatgcctccctattgccttcccattgccttcccattgcctccccattgctctgaggtaggacataaaatacattttaagaataacagcattaaaaaatggctactataattcattactactattacatttttgatacttttcaataaaaagaaagtagtgaccc

SEQ ID NO: 241742 - DNA, 351 bp, Homo sapiens
agaaaaattcgagaaacttacctgtttctctccctggaatgccttctgaaccctgagatttactttcctcaataaagaagctcgcctcgcccacccagcccactcttcctaggagcagcgaggatcgctgtccctccagcacatactagtcaactcgagtcatctgaatatgggcatattgggcacatatttctttgtaatggttcctctcctattacaatatgtatctgttgtttcatcgttagattgaaagctctttaagaattatggtaacagtgttacagctctttcagaatttgtttagcaggttttctggttttcacaggaaaataaaataaaaacaataattat

SEQ ID NO: 241743 - DNA, 423 bp, Homo sapiens
actcaggggtgtgtttatttatttttgtttaataaaatatttattgaacttttattgaagttcaattaactttatttattataaaacaatattatactgatattgtcagaaatttaaagacaagacaatatcctcatcacccctgcactggaaacactgacctgatttctatttttaggtgttactttctgggctatctatacgcttagcttttttttggtagtcatcaaatggtttatataattttgtacataacttttttcacttagcataaaacctttatagttgccattttaatggctacttaacattttattcagttttaattgacttatctattccccagtggtcgacatctaggccatttgcaacttgttattatagataatgttgaataaacattttcatatacatgaaaaaaaa

SEQ ID NO: 241744 - DNA, 1192 bp, Homo sapiens
gtcgcccaggttggagggcacttcagcctcaacttcttgagctcaggcgatcctcccaccttagcctcctgagtagctgggactataggcacgggccaacatgcttggctaattttttttttgtagtttttgtagacagggtttcactgtgttgctcaggctagtcttgaactcctagacttaagcaatctgccctcctcggcctctcaaagtgctgggattacaggcatgagccaccacgcctggactaaattttacattagaaacagaaatgtacttggaaaacactggtaaggtgtataataacgtctgcatccacagccaattctgctaaataaatgatcaattaatgactgtcatttcagaaataaacttttttggggaacttttgccctaggattaaacaactcaacatttctcacgtacctggccttcctccaaggtacaatgtcatcagctatgtcttgctaagatcagccttaagcattaaatttttaaatgctgaaaagcgcagtttaaggtgcggtcttaggaacgactggaaggaacaaggacaaacaaaggcccgtgctgatgagtaacctacgacagcaagcacgcctagatttccactgtcattgacagtcctggcagccagacaggtgagtgaggaatgaaactcccgtcacagttcccgcctccagggccacatttccctctacttgcaggcagccccaagtatgcagccagctctccttcctccaatgctcttccttcctacaaagccctctctcccaccctcctcacttgcttgacacccaagagtcatctctgaccccagtgctgccacccagccgtgcgcacgcttctcaacaaattccaggtcttaaccctacatacgcagacccgtcttccaacattccctccatgccattctcacgtccactgccttgctgcgctcactgctccttctcaggactaaggctatggcttcccctgctccctgctgccgcttcctagtctctgcctgccccactccccgcttcagggctatggcaggcttgtctggggttgtgtccctaataaagactaaactacttattcctgcatttcacactctccacaatccatccttattttccatgtttcatcttcatatttctccaaactgaactctctccttccctgattctacgcatgtgctcaatttgtt

SEQ ID NO: 241745 - DNA, 560 bp, Homo sapiens
atattttaagaacgaaaccgacccagccagcttgtggtcccattattctttatattgtttttcttagcacacgctagcaaagatagatgcctaggacttttcttggctattggagtttatagaaaaaaagttctttgttgaaggttagtcctccaccagaataatacaccctttttccccttagtagaagtccaaatgttaatcttgctatcatatatgtatgaatgcccagatttataaagctttgtaggtatattactgattgtgcaggagactaatctaggaggcttcaggatcattgtcatttgtggatctcattggctaagaccttttacttaacctgactccagtaaggtagcccctttgtttccttgtagttgactatgtgagctcttgccaagcagcagaagtgggatgaagggaactaattttgtaatatagattgcataggcttatggggagaaccagagaccaggaaaggaaacgtttttttctttttaccctttatgccttttcatgtcccctttttgataacatgctgccttggtccagattctgga

SEQ ID NO: 241746 - DNA, 362 bp, Homo sapiens
ttcatttttagtaaaatgttacccattatttaaagataaaataagtcttactttgagtcttttagttgtctatttgccactatgttccagtagaacagaaagtagtaaaacataattttggaattaaactgacatttaaagtaatcagagatacttcaacaacagttttatcacagagcttaatatgattccgatttcatggtgttgtgtgttacagaggataatagaacttatagaatgttttctttcatctggcttttaaaattatctgatttttgacataaggactagtaaacctagagttctgttaatagcaaacattgcctttgagtgctactactaaacctgaggcatcaagaaga

SEQ ID NO: 241747 - DNA, 985 bp, Homo sapiens
attatcagacctctggaatttatttatataggcaaatgacattttagttcacctcggacctagcaattcaccccagaacgatctgagtacagattgtctcagcaatactctggggacaaatctgatccataaaggttgtagggatagtgaaagaggagggaacaattcaccccaggagaagcagtagaattatttgaaaggactaaagttgctctctttctttacatagagttgctctgtttatatcttcatggattattgtcttgtgacaagcacatagtctgttcttaaaacctttagaaggtgagatggggtaaagaattagagccattaaatgtttgtatccaggccaggaggggtggcccatgcttgtaatttcagcactttgggaggccgagatgagaggatcacttgagcccaagagttggagaccagcctgggcaacatagtcaaacctttctctatgaaaaataccaaaattatgggggtgtggtggcatgcatctgtggtcccagctacatgagaggctgagacaggaggactgcttgagtccaggaggtcaaggctgcagagagccataatcatgccactgcattccagctcgggcaacagagcaagaccctttctccaagaaaaaaaaaaaaaaaaaagtatgtgtccatagactcctgcagttgggctgctgccacacgatgggcaatcccttctcagttgatgaaccttcttgagctctatcccaatggttccctcccagtggctgactttatcaacacatcttttgatttccaaaaacagtggaactgaggattggaagcaataccaaggcagagaaaaaaagagagaaaaaaccatgtctatacattgcgtgggttttagaaaggcctgaagttttattgaacttgatactggtgaaacatcaatgccactggaagagttgagattttgctcacttagatttcagcaagtagtaaaacaaaaagaaaaa

SEQ ID NO: 241748 - DNA, 622 bp, Homo sapiens
cggccgccagcctcgcagggcggtggccccttccccgcgggaaagcgggcgcaagagcggaggcgcgcggggcgcacggaggccggggagcgcgggcaggagctgggggcgcaccacgttctcggcgggctccgcgcgccgctggtaaccctacacccagggctcgcctttcggggtggaagctgaggaatgccttttgtgtggacaagttttccagaggagccggccgccctctctgtggggccgtccatcgctccgtagagccgtttcctccgaggtcaaggtcgttggttcccgctctccagaggcgtgagggaaacccggagggaacgcgctccgcgcatcccgtctgccgcggtgccggaattgcccgccgccgccttgggtggggaccggttctcagggtcctgggggctctcgagcagatcactttccccagcgcgggacgggggtcgcaaccaggggcattccctgcagccgcggcccaaaccgacggagcttgctttctccttccacccagagggggtgaccgagcctcacctatttccaagcctattttttcacaaagacgggaagcaataaaagtggcctcaggagattccggaaatctctacaaagagaa

SEQ ID NO: 241749 - DNA, 963 bp, Homo sapiens
agaatgtgtgactttaaaggggggtttcattcaaaagaatcagattttattagaagaggagggaccattagtgggcctacatttatttgcatgaagttggcagcagcatagtagaaaacagttgggtgtacagctgaaaagaaaggaagttctgtgacagagtgaattgagtgatataatctggctacttggccaatgtgaggacaagggtgatgatgtcttcataaattaggatattgggagaaaggtgagacagtaatgatgagggacatcaggaatcctcctatctgtgaaaacatctttctgacaattttgattcctttataataagaaaatgaaatggggaactgccactgtagataaattccagctggaataattggttgttgatacagaagtgaccaaaatttctagatttgataaacacattccttttgagcttataatgacaaaaagaataagacccattaagtcagtgaattttagagaaattaagaaaaagggattttttttttgtattcagaaatcttaaaatggaaagatggcttagatagtagttttcaaagatggaatcctaatgtgatcacagatcattccggtgaggaagcaaagggaaactttcacagaaattctttgataagctctattttaaaaagatggaaagacaggcactttaacaaagttaaaaagttctggaagggttaatcttgggaggcaagatcaagttgtgttctagaatgtttgagaaatctgagtttgattaatctaaaaaatataggagttagggagggctatgatgattctcatatttgaagaggaaggagaaatttgtctttacattttatttctttgaaacagagtctctctctattgccttcaaactcctcggctcaagcagtcgtcccacctcagcctcctaagtagttaggactataggtgtgcaccaccatgcccagctaatta

SEQ ID NO: 241750 - DNA, 421 bp, Homo sapiens
acccttcctcccaggctctctcctgaacaaccctggcttccctggcctccccaggcagcaatcccctgctccctctcctcccctctttccctgagctccagattctagcagattttaaaaattattgttgtaggccgggcgcggtggctcacgcctgtaatcccagcactttgggaggctgaggcaggcagatcacgatgtcaggagatcgagaccatcctggctaacatggtgaaacccgtctccactaaaaatacaaaaaaaaaaaaaattagccgggtgtggtggcgggcgcctgtagtcccagctactcaggaggctgaggcaggagagtggtgtgaacccaggaggcggaggttgcagtgagccgagattgcaccactgcacttcagcctgggcaacagagtgagactccatctca

SEQ ID NO: 241751 - DNA, 630 bp, Homo sapiens
aaagggaagagtcagccaggcaggtagttcgtgcctgtaattccagcattttgggaggccaaggcaggaggattgcttgagcccaggagttcaagaacagcctgggcaaagtctcaaaaccccatctctgccaaaaaaaaaatcagccagtcatggtggtgtgtgcctgtatcccagctacttgggaggctgaggtgggaggattgcttgagcccaggaggttaaggctgcagtaagccatgatcacaccactctctctaaggttttttggcctgagcaactggaagggtcgagttattgtttactaagatggaaaaggccatggtggggcagactagacatctaagtggagatgtctggcgggagttggatccacaagtttggaatttgcagcagttgaagataaaaatgtgtatttggggctgggcgcagtggcccacacctgtaatcccagcactttgggaggccgaggtgggtggatcacctgaggttaggagttcaagaccagcatgaccaacatggtgaaaccccatctctactaaaaattcccttgaggccaggagaattcagttgaatcctggtaggtgtaagttgcattgagtcaagaatgcacccatctgactgtagccg

SEQ ID NO: 241752 - DNA, 509 bp, Homo sapiens
cagcatggagtattgaggctgctgaaatccatgaaatatttttctcgtttccattttctggctttgacatattttttcccaagtgcctgtctgtccaaggcttaccatgttgttctttatgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatttgtaaggttgagttttgtgataggagcaccaaacatatggtatttgttttcagtatcaaaaacacatgaatgttgaatttcaaaagaacagccagtcattaaatgaatccatgtatttggagaatcata

SEQ ID NO: 241753 - DNA, 136 bp, Homo sapiens
gggatacaagtagtttttgattacatagatgaattgtattaatggtgaagtctgagattttagtttacctgtttacccgagtagtgttcactgtactcaatatgtagttttttatcccttgccccacacaccatcc

SEQ ID NO: 241754 - DNA, 556 bp, Homo sapiens
  misc_feature (44)..(45): n is a, c, g, or t
  misc_feature (58)..(58): n is a, c, g, or t
ggccgagggggccgtcagggcgcgcgcagttagagttttagganngggcctttgtatncagcttctcaaaagtagactttatgcagccaaaagacacatgaaaaaattctcatcatcactggccatcagagaaatgcaaatctaaaccacaaggagataccatctcacaccagctagaatgatgatcactgtttctatcaacagtacacactggatccctgaaacaactccaggacacagctggacatgtgctatagatttgttttgtgtccccacctaaatatcatctcaaattctaatccccacatgtcaagggagggaccaggtgagaggttattggatcatgagggcagttttcccatgttgttctcatcatagtgagtgagttctcacaagagctgatagtttaaaactatgtgtcacttccccctctctctcctgctgccctgtgtgatgtgccgtgcttcgccttcaccttccaccatgattataagtttcctgtggcctccccagccatgcagaactgtgagtcaactaaacctcttttctttgtaaa

SEQ ID NO: 241755 - DNA, 465 bp, Homo sapiens
gtggtgcaatcataggtaacttccctctcaaactcctgggttcatagggtcctcctgccacagcctcccacatagctagaactatagccatgcaccaccacacacggctacattttttattttttgtggagattggatctcactatattgcccaggctggtcttgaattcctggccacaagcagtcttcccacctcagcctcccaaagtgctgggattacagacgtgagccaccatgcccagccatatgttgcttttagtgcagtaagtgtatagttagaatcaggtatttagaagtgtagggaaaagtaagaaattaagaatataaaaagggtgaaaaacctaatgctgtctctctgagcccctgagaatcatttggtagactgttatttttaacaaacatgtgcttctaataaggtcctgtgaatatcaactaaatactacttggtgttagtaaaaaaaaaaa

SEQ ID NO: 241756 - DNA, 963 bp, Homo sapiens
atagagaagaatagtgagcctgcttattttcacatgggctagttagtgatttctgtaatataaacttactggtatctttggtatctttcctaacaaataatttttatattctaaattacctagggtattttccctaattctccatggtgcttcaatagcatgttattatcataaaaatgaacagttttgtggaatagatgaccaaatgtgagtaactcaagataatttaaaatgtatttatagttttaaaaataatctcccaaaaagttaattagaattgtgtaatatctgaatagtgagaacagttcatattggtatactttggataattctttgtcttataattttattaatattgaaagctattttctgtcattttaagtgtatttcgtaactaaatactacatctttctttcctcagtgacttaactcactattgtttacaatgtacatagttttctttgatctgaacaaacatgttgaatttgaagcttctttaccattgtttatttacagatctttttaaagtatggtaaaaaattgaaaaaaatttatgtaattaatgatcatttctgtgctgctgtatacaatagctgtatgagtatgctttagggttataaatggataatatgtacctacttaattgatatggggatggtaatacagtttagaatatattttacatataggtaattgcttcttttctgcactgtccagtatggtgaccactagctacatgtggttattactcctgggctcaagtgatcctccctcttcagcctcctcagtagctggattacaggcgtgtgcaccactgtgcttagccacatgtgtttgttgagtacttgaaatgtggctactctgagttgagatgaaggtcaactatctcaataatttgttatattgcttgcatgttgagatgatatggttatattagattaaataaaatatatttaaattaaa

SEQ ID NO: 241757 - DNA, 460 bp, Homo sapiens
cttaaatatactgatttccagagggataaggaatactatgattatcaagggtctgcataaaacagttatatatatacacaaaatatatatgtacacacacacatacatacacacacgcacatatattatacatattaatatacaaatttttctaaaaccatttagttattgtgtaaagctaattttaaagaatctcaattaggaatcagcccaaatagaaagaaaaacaatatttcctcttctctgaaatatggtaacccagatgatatgtggaagaataaaagagtaattacattaagtgaggtagaacaaatggggatgagatctggagcctgacttcaggatctagaaggatgtgaggccaaacactggtaaggaacaggagatggattttattttagatagaacaaaattaagattatggtggcaagcaataggtgctaaacctggaaataatttg

SEQ ID NO: 241758 - DNA, 384 bp, Homo sapiens
cactctgttgagatggggctgcccagaagcccacacaagcccacacctgggggaatcccagccccacgttctggttcaagtcgctgctggtttgggttcagagcccaaacatgagctcctgctcttcttggtgtgatctgaggctgtggatatcctgagaacatctgtctcaacagaacaccttcctccatgttgcctatatcccaaattcactcccaagtggcttttgtctggcagattccggtggattatgcaaagagggactgccagagaatctgagctgttggaagacttctgaaacgtcactgcggtggcggaggcactgccccggggggacaaaagtcttgtctcttcctccaaatgtggaggatcaaattagagttg

SEQ ID NO: 241759 - DNA, 431 bp, Homo sapiens
taccctaaaaagtgtagagataaaaaataaaatacaaaagttaccctgtaactgggctccagtcgctctagctgttgtgcttagtattactcacgcaaggatccaaagggagacttgcctatctgagcatttgtgaaaggcttgtcattctccatcccacagagggattcggaagggccctgtcttggatccagcccctctctcacagccaccaagctatcctgcctatacacaaaactgctaggagacgcatctttttgtgccaactgcaaaaccttgccagcttctatttcaaagctgatcctaaaggggcagtctcactaggctgcagcccctttctgccacagcccaggagttgccaggcctgtttaagaaactcctgagagagattcctggacaggctcgcatgtgtctgtctcacagaagttcca

SEQ ID NO: 241760 - DNA, 361 bp, Homo sapiens
tattacgcagcataattactccttttgtctcaattttctcatatataagatttgaataataattatgcctacctcatagggtgagaaacgatgcttataaaacactttgcatggtgctggtctcatagtaaataccagtaaatgctggatgttgctgttatttccaccatgagagctgcaatttgaataacttgacattcagcaaatttattttctactatactgtattgtatcttttataatgtaagagagctggttacatgtgtgtatttccttatctgatcttgtatttccaaactgatcttaatgtgaaatctgtctttactcaaataaaacaattgccaagtgttgggagatccta

SEQ ID NO: 241761 - DNA, 362 bp, Homo sapiens
actcttttaacaccaatggctgtgggagaaggaaaggctcaaggccagggctcagctcgcagagtccatcttctcccacagttgccacatttgagagggggcctgctgaatgcccttgctgtcccgtatggcagtattgaggcctgcccgcaccctcgtaacacacaccctctaggtccttgcatcccggactgaagcaaacctgtctatttgcatactgtggactgtggcggatctttcacccacgtaaatactcctcaaattgaagataatgtcattgcgctgggttgagaaatacatccccaccgctacctcactgcatctctccacacaagtaaatatccctaagattagggcaagtc

SEQ ID NO: 241762 - DNA, 437 bp, Homo sapiens
acaacttcagggcatgacacatttggccggtcagtagaacccatgctgtgatttgtttttgcagtggtggtgatgactgccttgttgaatccactttttattctattccattttggggacacaattctgcaagatgattcttcattaggaaacagagatgagttattgaccaacacagaaagaaaaagagtttgttgctccacactgggattaaacctatgatcttggcctaattaacactagctagtaagtgtccaagctgatcatctctacaacatttcaataacagaaaacaacaattttcaaaattagttacttacaattatgtagaaatgcctctaaaacacagtattttccttatattacaaaaacaaaaattataattggttttgtcctcttttgagagtttgcatggtgttactccctgcatagtgaag

SEQ ID NO: 241763 - DNA, 471 bp, Homo sapiens
  misc_feature (450)..(451): n is a, c, g, or t
tccctttcctctttctatcaataatgcacagctggtgaggagagatcaaatacaactcaaatcagccacttcctcagccaagggttctaagcaaaggtatgtcagaaatgaagaaaatgccaagttcctgacttcgatttgaaaatataaaatataatatttctatataatatgtgttaagttgttttttatttttgtttgtttgtttgttttgagagagtctcgctctgtctccaggctggagtgcagtggcacaatcttggctcactgcaacctccaactccctgattcaagtgattctcctgcctcagcctcctgagggcatgtaccaccacacccagctattttttgtatttttagtggagacagggtctcaccattttggccaggatggtctccatctcctgaactcatgatccacccccctcagcctcccaaaaaaaaataagnnaaaaaataataaaaccctgt

SEQ ID NO: 241764 - DNA, 385 bp, Homo sapiens
atgtatttttaggaataatcatctgatttttagtgatagatatattgcttactcaaaactaatttagagaaagtatcaatttaagaatcataggtggggtggacacagtggctcacacctgtaatcccagcactttgggaggctgaggtgggtggatcacttgaggcaggagtttgagatcagcttggccaaaatggtgaaaccccacctccactaaaaatacaaaaattagctgggcatggtggcaagtgcctgtgattccaactactcaggaggctgaggcagaattgcttgaacctgggaggcagaggtggcagtgagctgagatcttgccactgcactccagcctgggcgacagagtgagactccatctcaaaaacaaaaa

SEQ ID NO: 241765 - DNA, 93 bp, Homo sapiens
aaaggcgtaaattaaacgctttgcagccttttcctgcccttaaatttgatacctttggtgtaggagctgcataagtaacagttgctgctttta

SEQ ID NO: 241766 - DNA, 395 bp, Homo sapiens
cataatgtttccagttgaggatgtagcgattacttgcaaagtctgtcacattttctgatttctgtctttactttgtcagtgtgtttgctattagacataaagcaaacaaaaaaccaaacatctatctgaactaattttaacacttttaaataacaaacttgctcttgcactacctagatttttttttgtggtacatttgggctgagattgcaatttaccttttcatcaagatttggatggcctcttcttatcagtacgaaaatctatttaagtttacatggactgcactttctcttacagacataaatgacttcactgtgcctaggcatttaaaattctttcaaaacctcaggagtacatccacagtgatgatttctctgtgggtttcactggta

SEQ ID NO: 241767 - DNA, 475 bp, Homo sapiens
gacagcaaagtggcctgtgatcacgtccaggctggtggcacttggatctgtttcttgtattatgtgggtctctgcgcatgagaagaaaatttccaggatagaaaaatactggtttgttcagggaatttcttaatatttgctgactgagtgatcgttttccattgtttcttgcatttagaaaagtaatccatggccgggtgcagtgacccatgcctgtaatcccagtactttgggaggctgaggtgggcggatcacttgaggtcaggggttcaaaaccagcctggccaacatggtgaaaccctgtgtctactaaaaatacaaaaattacctgggcgtggtggcgtacacctgtaattccagctactcaggaggccgaggcatgagaatcgcttgaacctgagaggcggaggttgcagtgagctgagatggagcccttgtacttcagcctgggggatagagtgagaccctatcacaa

SEQ ID NO: 241768 - DNA, 385 bp, Homo sapiens
attgcttgaacctgggaggcggaggttgcggtgagccaagatcgccccattgcactccagcctgggtgacagagcaagactgtgtttcaaaaaaattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaa

SEQ ID NO: 241769 - DNA, 377 bp, Homo sapiens
cgtttatattccaatcccactaacaacagaataattagattctatgtaatattatgtaatgaataataaaattgaaaagactacaaatgtctgacatttgctgtatatttccttcttcccacattctctcaaatgaaaaatgtatttgttttctaagaattgaaactgaaatcaccacagcacaaaagttaaattttagataaaaaacgtattcgtttttgtttgtcccttataacaccaatattttgttcacatattatatacacactgaagtgaagaaaaataagtctttgaaatgaaaatggacagagttcacacaaaaattcaagttgttcaaaaactggaaagccctaaaaactagaccaattccaattaac

SEQ ID NO: 241770 - DNA, 399 bp, Homo sapiens
tgagacggagtctcgctcttttgcccaggctggagtgcagtggcacaattgtatttttagtagagacggggtttcaccatgttagccaggatggtctcgatctcctgacctcgtgatctgcctgccttggcctcccaaagtgctgggattacaggcgtgagccaccgcgcccggccggcctcctttaatttcttaaccataaatatcctccccccacttttattatggacgttctgaagcacataaaaatagggagcatagtataataaatttgtacatatttaacactcagcttctataattagaaacaaatggcccatctggtttcatctaggcctctttgctatcctttcatctccaactagattattttacagcaaattctagatgacattctgc

SEQ ID NO: 241771 - DNA, 886 bp, Homo sapiens
ggacccccttgtctccgggcctgtcctctaccccaccctcttcccccagtgaactcctatggactctgcagagacgtctggtctcccggaagccttccaagatgtcatgctgggtcaggagcccttctctgtgtccaaagcccctggaagtccccatctctgcaccagtcacattgtggttcatggttacgcatctggccagctgcctcactggacggtcagctcctggggggcagggtggggtgtggcttatctgtgaatgtccagggccccttcaggctctgagttcacactcaccagtgtttgtctcatagtcgaatgtgtggatgacagagcagtgctgggtgagcgggtcatctgccccagtccacctggaggctgcccagctggagctcctgaactggaaacttctggcccaagacaacctcccttctaggatgaaaaggtcctggggcagtccccctcccagtccctcaagggccggcctcagccttgttacaggacggttctctcgggcaggagctggagcccacagccctctgaatcagatgccactgggccagatttgtcactgatgaagactagaatggcctcctctcctctctgaagcaagagtttggtcagcaaatcaatggtgcaacaagagttggggtggagagctgcagagggggcaccccacttaacctactcgagaggggcccatccataatcagcaatctccatctgcatgcccacaattaatgtgctcctgcccttcagaaatgttctcttttcattaagggtgtccccatggggccgcagcttggcgatacgttcccagctgttggtttgagctatttattgtaagagcccaagttgaataaaacagcatgattttaaaaggaat

SEQ ID NO: 241772 - DNA, 514 bp, Homo sapiens
aagagatagggtctggctatgttgtccaggctcatcttgaactcttgggctcaagcaatactcccacttcagcctcccaagtagctgggactatagatgtgcaccaccattcttagctttatatatgtagttttaaggaagaccatctatgaacgccaggttaagaatctatgttttctagggaaacaggtcttactagcctagtaacactgataagtaaacagaattctctggaaaatgacctacctaagcttatacagctagtaattgataggaccagcaatctagtctgtcagaggatataccactaaactcttctttctaactttagtttacagtcaaaatgggattgctgaacctgggaaaaaaataaatgcttcccaatttcctatttaaacagtgtaagaattgggggtggcatttgaaggtgggagaagaagggcaaacttgttagtttactagtgtgagcggtagatttttatgccaactggaatcactgagattaaccttatgg

SEQ ID NO: 241773 - DNA, 363 bp, Homo sapiens
caccccagtcggggaggcgcccaaggaggaggtgaattgctttcacaccaagctctgagcattgcctcaagacgccatacaggccgggtgcagtggctcacgcctgtaatcccagcactttgggaggctgaggcccgcagatcacctgaggtcaggagttcaagaccggcctggccaacatagtgaaaccccagctctactaaaaatacaaaaaattagctgggtgtggtggcacgtgcttgtaatcccagctactcaggaggctgaggaaggagaacggcttgaacctgggaggtggaggttgcagtgagctgagattgcatcactgcactccaacctgggtgacagagtgagactccattt

SEQ ID NO: 241774 - DNA, 387 bp, Homo sapiens
tgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctca

SEQ ID NO: 241775 - DNA, 553 bp, Homo sapiens
ggtacaagaggcaattttggggtcatttgacactatttggcaaaacagagaaaaacaaattaggccaatatatccaacagatataaggctgtcatgttccctgtggatagccattcttttggtgacagttttaatatcagtagaactgtttctaaatgaaataccatgctttcaaaatatccctttcattctcatccactggtgttacggtgtatggtgtgatctatggtgtgatccaaactaggcactgtagtttggcttaataactaataaacctcccaacaactgaaaggaatatagtctacttaaaacccatctctaaattccatcagttctctcctgtaaacatttctcatgtttgtgcccttagtcaggccctgctaaattcttgctaatattcttccagcttagctcgttcatctcctccaatctaccctcaaagcctctgccttagagacttcactaccaacaatgaggctgcaaaccttctgtgattatccctaactgcaagctgtatgtgtcagggactagaacctactttccattttagaca

SEQ ID NO: 241776 - DNA, 535 bp, Homo sapiens
gacgacaaatgtgtaaccagattaaaatctcgcgacatttcttaaactgcttttactgtagctctggaaacgttggtttcaaaaatcagtcgtgtcactgtcactcttggaattcgagagcccagagtctaaaagccagaaaggttgttcagagcttggtctctggcctctagagctttcccaacatgggatgggcacacgcctcaggcacagatgacttcactccccaaagactgaaccagagaactccaaggttcaactgatcatctgccttattttatccattagtctactttcatttgttagaagagacacagtttctttttatctctgtcttctcctgactaattctattagatcagccctcaaatacatcatgtgatttgtacagggatatcatttttattcttttttttttcggtcccctttcacgtacctctaatcatttttatccttgaatggcataagtcaaacttttgaattttctaatagaatgcctttttttaaattaaaacttgccttttgacttcctatt

SEQ ID NO: 241777 - DNA, 938 bp, Homo sapiens
tggtcttgaactcctgacctcaagtgatctacctgctctggcttccaaagtgctgggattacaggcatgagccactatgtctggctaaaacctataaacatttcttagagaaatgctgttccccaaaggaatgtgaacagctaccacttttaacaaggatatttaagaaaacagactatgagttaactaagtaaaaatgtaaatatggtttgcatgctgttaacatggcagaggggtaaaaagaatacagtcctggggagaaaggtcacttcactgagaaggcttacttaaaaatgtttttctccctgcactttcatgattattaagtacccctagaaaatgaactcatagcagcaaataatctaatgactccttttaggttacagagcaaagtagctttctacttccacatcacattataatatagccttataatttcttctttcctgcaaccttcactttcctacctaggaaaactcacctccggtgccagagaaacttcccaggatgcactagggccctgtgaacaatacagaagttgtggactctggctctttgtcccacctaagtccttccagaagggctctacagcatggcttagtgacattaaaaaaaaaaactgaacccatgttaatatcaaacaagattttaatcttcattcacacacccttaaaacccagtcacggggctccccggtgccagtttgagaccgtcaacctagccctctctgcttctcattgctggaggtacacacagtcaaaagttttccgtgactgtgaaatccagtgcaatctgcttcccagcagatgaggagcctgacgtggttatgtctggatttagtccaagaacagagcaaagctttaattgtcaagagacccaggcctcattctccacttaggagagtttgctagggcaggtacaggtaaaggtaaccagca

SEQ ID NO: 241778 - DNA, 2421 bp, Homo sapiens
  misc_feature (926)..(926): n is a, c, g, or t
cttgacatttccccagtccctgagctcatcttgaatttaaaaggaggctatctggaggctgggtggggactgagtcaccacctcccgtggctttctcatcctgagcagcaaccagacacacccagagggccactgctggagacctgcagattgtaaatgccacacaggctttcttcccagaagctcagatgggctcttgcgggaaggctgtcatcgtggttctgtatgtatttcttccttcccctagccactttgagaagttgttgcctgtcctttcccgcttcagcctttattaatgctgtcctcttcccctatagtgccctctcttcccctagaggcccacactgtcaaatgccacctcccccaggaagtttgtccttgctggctctggagtcccagcaggactcctgaggatgcttacggcatgaccttggcaggtcacgccacctttctgtgcctcagttttctcatatataaaatttgggtttcttgtctttataaagctccatccctagacactctcatttggcaggtcttggggcaggaatcacatgcccctaggtttttaaaccagctctctagaggatgctggtgctgagagcctgtcggctgcaacctgggaaaagctgaactgagaggaccctggtttgcatgacagcctagcttgttgctgtgtgaccttggattagtcagctttctgtacctccgttttcctccctatcagattggggtggaaatgagaactcgtgtagtaacagcccctcaataaatggcagtcatcaccatcatcagctttgttttgtgtggggattggtggttttcagaagcaagtcacctttcccctacttggtcctggcagcaggcactgtcaagtcagactgggccagggtgcaggctgtggaattgaacacctgagcaggaatgangtcagcctgtctttaaacagccccatcgagggagaggagcttgcccaagggtaaacagctggctggctcctgccagagctgggacagggatccaggactaggacattacagtccagggctctttaacctcctccccactacctggttattcgagaatgcacctgcccttccaatagagcagggagacggctgtttcttaattcaggccccaatcctgcttgttctttgttagtccgtttgtaaagatagatgggcgtgcccatcgggatgtctgtgcagggggacagttggattttccatgttccatcccattgttgtttaagggtgggccctgcttggacagtggcacttggaataaagtcactttgtagttgtgagccttggctgcttttcctgcttcccctgtagagtaggggaacaaagacctcagccgagagaggttctgcagagagctggggtttgctgtcaaggagcttaggatgtcctagaactttggtgcagggaatgagatcagctgttcaagcgccttgtcttacagatgaagagatgaggcgccagaagggccagggacccacagaggtttgagccaggacttctgggtcctgttccatggcgactgcctttgaagaagtcactgtcatgctgttatcacctgcccctggtgtataatgacaatctctaacatcctttgacctttttactgtgtacgctgtgcttggtgctttacttcagctacttgcagtggaaaagaagaagggcttggtgcctggcctggaagtgaggggtgcaggatcccagttcccacatctcacccacttttagggatgtcactttcctttgggcttcagcttcctaatccataaaatgggaataacattccttatcctaagactgattctgaaatcatggaatccctcaagaattgtgtgagcagcggctcactcctgtaatcctagcactttgggaggccaaggcaggcaggtcgcttgagctcaggagttcaagaccagcttgggcaacaagacaaaaccctgttgctccaaaaaatacaaaaattagctgggtgtggtggcatgcgcttgtattcccagctacttggaggaggctgaggcaggaggacagcttgaatccagaaggtcaggaggtcgagactgcagtgagctgagatcatgccactgcactccagcctgggtaacaaaatgagaccctgtcgaccgggcgcgctggctcacgcctgtaatcccaacactttgggaggccgaggcgggcagatcactggaggtcaggggttcgacatcagcctggccaacatggtgaaaccccgtctctactgaaaatacaaaaattagctgggtgtggtggcacacgcctgtaatcccagctacttgggaggctgacgcaggagaatcatttgaacctgggaagcggaggttgcagtgagctgagattgcaccattgcactccagcatgggtgacaaaagcaaaactctgtctc

SEQ ID NO: 241779 - DNA, 715 bp, Homo sapiens
gttcaagtagagtcagggaaggtcctaggggaggtggtctctgaactcaagggcaggttgccaaagaggaggagttgggagagcattgatgaccggcagagaagtcaatgcgcagaggtcagatgagagagtgacaaggaggaaacaaggcaggctggagcagagaggaccacaggagcaccatgtcatgcttcacccagaaatcagtctttgactgcgaaatggagcacaaaggaatcaacagaaccagtgggggttaagttcggattgggggcaccaggagacacaatgctctgagaaagaagagatcagcacgtgggctgctgtgagcatagaaagcttcacatggggatgaaacttgagccttgaaagagggcatggctgagaactgctatgagtgcctttggaaggcccaggggaacccacggtggacgtcacggccaaaagattactgccgaggactgcatctcaaggaatgggcaaggggaagacagaatcaggctaactcagcaatgccagtgtctcaagcataaaagagcatgtaactggactaagggcaatgaggaacttaagaggtgtcaactacatcaagctgcatagagagatggaaatgaacaatataagataaatcaaaggaagtccttcttcatgtagaagaggaataactcacagacctcattaccaaagaaaagttttcattaataaatgtacccat

SEQ ID NO: 241780 - DNA, 765 bp, Homo sapiens
gttcaagtagagtcagggaaggtcctaggggaggtggtctctgaactcaagggcaggttgccaaagaggaggagttgggagagcattgatgaccggcagagaagtcaatgcgcagaggtcagatgagagagtgacaaggaggaaacaaggcaggctggagcagagaggaccacaggagcaccatgtcatgcttcacccagaaatcagtctttgactgcgaaatggagcacaaaggaatcaacagaaccagtgggggttaagttcggattgggggcaccaggagacacaatgctctgagaaagaagagatcagcacgtgggctgctgtgagcatagaaagcttcacatggggatgaaacttgagccttgaaagagggcatggctgagaactgctatgagtgcctttggaaggcccaggggaacccacggtggacgtcacggccaaaagattactgccgaggactgcatctcaaggaatgggcaaggggaagacagaatcaggctaactcagcaatgccagtgtctcaagcataaaaggtattcgagtagaatttggcaaaaaaatggagaaatgaagaagttagatttaagacactgaaagtggtgtgcagcagaaagctttgtggtgatttgtgtattctcttttctccgtgaaacttctgcagtggataaacaatgatagcatccataaagatgtatcttgttttatataagaaaaaaaggattcctgaaaaatattaaataaaaattgaatttcattttccca

SEQ ID NO: 241781 - DNA, 333 bp, Homo sapiens
ttgacttgtgagccatataggttctgttttgactgttgtagttagaaagcagctatagatactatgtaaatgaatggcttggctttgtctcaatggaaaactgtgtttactagaagaggcagccagcccacaggctgaagtttcccagtcgctgatagaaacaattgaatatgccatttaggctaataaatggatttaacctttggcatctcatgaacaatgtcttctgacttacagaacagaaagaataaaaataccaatgcaaggttaacagtgctttgatctttgttccttagttacctattcagttttcatgagtaaatgattataaac

SEQ ID NO: 241782 - DNA, 1158 bp, Homo sapiens
gcctgaatgtacttcattgattcctcaaagcaaccctttgaagtaggtgtcgtgcctgcccattctgcagagttggaagaactaatctcatgttggaatgaacttaatctgaatatagtgcatgttttcttgaatgtctgaaggttatttccccattccattacacagtccagtcctgaatcaatgactgggcatggtgtaggactgtgacatacagagaacatggtccctgccctcacatagaacagagaacaatataaaatgtaacatatttgtcaaaatctgcaattcagatagcagacgctgtaaatctgcctccctgtttttctcctttccctgtctggatgttgaagaagtttcagcgacatatgaccctgtcagaggtactcacagttcagaagtcaatgctggttgcaaaaattggaatttctttggaaaagaagacaagcttttggcagagctggggccacatatgggaacgcagcaccaaggccttgggaatgacggaaaatcgcttctgtattgttaatagcaatatatgacctctgctgtcctcctatctttaaattttatgtaaatatttacaaactgttcatgtccaaactgaaacctgctatgaactaaacattttgtaaactcagtaagattgcccaaaatacaactcaactttcaccttttttttttgtttgtgatgacatttaatttaaaaaaaaaagacagtagttgcttttttttttctttttttttgtcagttcagggtcttttaattttttccctttacttttttttttgttaatttcaaatgtcagtctatctaaaactgaaacttaattttactatcagcatgctacttcagcttccgtaaggctggaaatgtcctgcgaatcttaccactatgtcttttccaagggccatttcatttctaaagaatgtataaattgaacctcatcctgctagtgacactacttccaaattcaggcaggaattttgccatttgtttttccttgagctattttttttccaaaataataaatcttcccaatccaaaagcatttcacatcatccttcattctagtcattggaactacagccaaaatgcctctcagtcttccccagtgacttcataatcaccgtttcttcagcatattccctggttga

SEQ ID NO: 241783 - DNA, 239 bp, Homo sapiens
agtgcaaggagtgcttctccctgctgtgcacaggacacacaggcagtgccattgtgggcagagctggctccagagccagtcggcctgtgttcgtgtatcagctttgccgctagtagctgtgtgaccttgaacaagttacttaacctttctggccctcggttatttgaaatggagataatgaccgtacttaggtcataagttggttgtgaggattaatgtaattaatttgatacttggaa

SEQ ID NO: 241784 - DNA, 381 bp, Homo sapiens
gtccccagtgcttagaacagtgcctggcacagagacggggctctgtaaagatctgctgaatgaacactttatcctcttacttcttatccttcaagcctcagatgttcccccaggatgccttcttcgtttccccagactggttcaagctgcacctccgacgtgctcccacagcccctgagctgcctccctgcagacgccatacctgccgtggctgcttgtttgctgagtagcctctcccactgaaccctgggcaacttgaggtcagggaccatgctgtttactgtcacagtgaattaaaatgtctaaaacggtgtctgaccactagcacatacttaacaaataatttttataagtgaataaacattctcctcttttttcttc

SEQ ID NO: 241785 - DNA, 375 bp, Homo sapiens
ctttggacctcaggcctccaaccatttgtttcaaaagtgggcaatttctttaagctagacatttccttaatgcattaaatatattttttctgcagtaaatggaaattaacatctcaaactgtctttcattcaacctggtgtgttaaagaggacttttctggcacataccaatgaagtttcagaaatgccctgaagtttccaaaccatgtgataacttgtgaaaataagaacaaaagtttgtcttttttttttttttcctgtggcctgggtgatggaaagaataaagggaaggctgtatggcagttctgtaattcagtactctttggcttcttttaaaggaagctggggtttcaataaaagaatcattttcactgc

SEQ ID NO: 241786 - DNA, 358 bp, Homo sapiens
tcccttttactctcctatccatattcccccagatcgtagttccctcacctctttcacacaatcttccctgcaaaactccacccacagctttcaatacctctccccacttctctgctctttattgggaagacaagcacagtttcttccttttgggaccattcctccctcctccggcttttcaggtctaataatgtatccattctctatcacaaaagccaagctagaatcctctttggagcaccgcccaggtcaagaaactgcacagatagagcagagggagaaaggaggttcagaacactcatgcattaattgttttggtctcatcacagtttctttttttttctttctttcttttctt

SEQ ID NO: 241787 - DNA, 389 bp, Homo sapiens
caaactctgtggttatattggagacatatcaaagaataatattactagctgatctccaattttcctttaacaatcttcaggagaacatatttatttatgcttttaggcagatatttatttgttaatttatcaaaaataggtaattcttcagtgtctgctttgtttttggcactctgcatagtgctaggggttttgtgttgaaaagcaggtgaaatcccttctgtactaaaaatacaaaaattagctgggcgtggtggcgcacgcctatagttccagctacttgagaggctgaggcaggagaatcacttgaacctgggaggtggaggttgcagtgagccgagattgcgccactgcactccagcctggtgacagagcaagattccctctca

SEQ ID NO: 241788 - DNA, 242 bp, Homo sapiens
aagcggaaggcttttattccccttccttctattgttgctcacctttcagtcaaagcatgggtctgcttcccaaacttcctccttccttctccgttcctgggtttcccttggagcaactcgccacagggcctctgtttggcctgggcctttccaggatgcgttacttagtcttggttctcaggatcaggtgagggcaactctcctctatgcttagcagcctgcccagctgctgccatttgcag

SEQ ID NO: 241789 - DNA, 341 bp, Homo sapiens
taagattaatagttggcttctcagaaaccatagaggtaagaaaacagtgggataatgtattcaaagtgctcaaagaaaaaaaaaccaacaactgtgagtcaagactcctatatccaacaataatcctatatccaacaaagcttctttcacaaataaaatgatccaaagtataggctgtctagaggaaactcacttagattcaaagatataaatagattgaaagtaaaagaatggaaaaagataatatcatgagaacagtaacaacaagaaagctggagtgactatactaattttattttatttttttattattatactttaagttttagggtacatgtgca

SEQ ID NO: 241790 - DNA, 594 bp, Homo sapiens
aactcccaacctcaactgatccacccgcctcggcctcataaagtgctggtattataggcgtgagccaccgtgcccagccctttaccatcttctaacaaaggtgttaggctaaagagacttcactggaacagcacggcccagatataaaaactggtagttcagcagttaaggtacccacgcaaggagcacccttgccttccactctcactgctaggccttccccaagcagtgcccccttgtctgaaaaattttccctctccctcttcccagcccctacaagctaagctgccacatcatgtcctttacatggttcccacttcctccagaaagattttctaggatggatggatcctaggaaagaatggatgacagatttccacagccccaactcacccagacatgaaaatttctgtttatgatctttctttctttcccacttatggaacctgcactcttattattaatgtatttatttgcctaaggtgctattttctcttgtctactgattgctcagtgcaacgcatctagctccaaatatgagcttctacaaagcaatgttttcagcctcattacatagagaaggactgaaggaaa

SEQ ID NO: 241791 - DNA, 411 bp, Homo sapiens
aagaagtcactagtactaaccccaaataatgaatatgttttatagttaacaaaatttttcccagatcaataaggttaataagtgatactgtcacttgggcatgttaataaattttttaaaaaataggctgagccagctgaaaagctacaactggaaatagattatagcattttgccccaggctttggcagcaattgaaacaaagtattttgaaacacagcaaattggcatttctctgacttccaatgttcagtctctccaagcgggacacctggttcaactacacaaaacagctattcagaattagagtctgggcttttgttatgcaaaaggtaaatgagggtagcatgaacttttccaggaaaagctgtttttactttttaccctagggagacctctcttcagaaagaaa

SEQ ID NO: 241792 - DNA, 394 bp, Homo sapiens
agagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcggtgggtacagctcctttttcggagtgtgatttccccaaagcaaaacaaaaataaacaacatgttaaggtattaattctgtagttgactgtgtaaataataaagtccctgggacttgaacaccaagtaaataaaaatatttgaatatga

SEQ ID NO: 241793 - DNA, 368 bp, Homo sapiens
ttaccatgtgacacgctgctcctctttgccttctgccatgagtaaaagcttcctgaggcctcaccagaagagctgtgcagatgctggtgccatgcttgtatagcccacagaactgtgagccaaataaacctcttttctttaggaattacctagcctcagttgttcctttatagtgatgcaaaacaaactaacacatccccttttgttaaaagaggaaacagattcagagtgaataaataatttatttaaggtcacagaacaagtgagggggttgaaatgtgagcccagatccatctgattccactcatgtgatttttcactgtgctgagaaggggtccagcttagaccagggtcaccaccctcctttc

SEQ ID NO: 241794 - DNA, 266 bp, Homo sapiens
tttttctataaattaaatgatatctaccgtagaggcaaatagtcattgctgaaaagccagttccagaatcctaggctttattcaattcagtggtatttataatcaattgactcacttattaaagtagtataagaaagttaagagcttcagccgggcacagtggctcacgcctgtaatcccagcactctgggaggctgaggcgggcagatcacgaggtcaggagatcgagaccatcctggctaacacggtgaaaccccgtctctact

SEQ ID NO: 241795 - DNA, 461 bp, Homo sapiens
agatcaaccttttcttctgtaaggttttgcacaactgactccagagaaaacacaacaacaccatcctcatcagagctctggacaaattcttccatttcctacagaggaaaaactttcttcattataaagatgcaatgccacatagaataatatagtttatgtatacttctaaaataaaattttgaagttgacatatatatagttatatcatccctattttctgaggtgcattttagaatagaaatgttcaagtttgtgttagaaacatatggcttcagtacataataattatttactagaaaaagcacacaaccaaataattataaagaacatttaagtgagaaatgtgcagctcatttaatatttaatagacatcaaattctaaaaacataatggtttgcaaactcataaaactatttcaacaatatcaagtgtcaatttgctggcattttgtgatgtca

SEQ ID NO: 241796 - DNA, 411 bp, Homo sapiens
agtaaagagttggtatctgactcttccaaggctctgatccagtggtgacctgattagttggttcccagttcataccagttgagtatttttattatcatccctacccttaataacccaggatccttgtagggtaggaattgcaaactaattgtctaggccccttcaggggcctagacagcttatggaaattagtggagtggcagggtagggctgtagcaaaataggaaagctcacacgttatctaaaggaagtccacacaactcaattccatccagttccatgcaagaatgcagacttgatggtgctgtatcgtatgatttttgaacagaaactggaaagacagttttgtagtaaatctcaccaattttaaaaaatatcgactactgggcaacatagcgagactccaactca

SEQ ID NO: 241797 - DNA, 368 bp, Homo sapiens
aactcaatctgctggctgtggagaaaggcaacttcctcttgtctcttcccatgttgtttcagcctgccccactactggctcagtttagctcacccaaagtccattttcagtttcatggctcatcatagacttgcaaatactatgcgttagcttcgtattacagaagagaaaatggtaatgtgatttacgcaggatcacacatgagctacatcctgttttcattcgccataaaccttccccaggtccccgtcaaattcatccgtccatctgtccatctacttattcaacagatacttattgagcacctacaatgagttgtgcacttctctgggtctgtttctggggattcagcagtaaaccaaacacac

SEQ ID NO: 241798 - DNA, 167 bp, Homo sapiens
ctgtgacttgatacatctgtcagatttttgtaatctcgataaatgtgtattgaagttttttccctttttttaaaaagccaaactaatatttttctgtgagttaatacatctgtcaggtgtgtatgtaacattactggacattaaaaaaaaatattacattctcaccc

SEQ ID NO: 241799 - DNA, 217 bp, Homo sapiens
ctaaaccataaaaacactctaaagtggggttagagttgctagtggtaggaatagtaatggatataagcactgggtaaggaaaggaaaggaaaagacagactaagcttttcttagctttaatttggtagggcttgatccaggaacaatggcccatgattctgatgataatggcgtttgcttgactcaggtgtgatgtgtccatcccctttctgctgta

SEQ ID NO: 241800 - DNA, 276 bp, Homo sapiens
acgatgatgaatagaagtagcgatagtagccttgtcttgttcctaacctcagaggaaaagcattcactagtttatgttaaaagatgttagctaagggtttttgtagatatccttcattagattagaaaagttcctttctattcctgttttctggtagtttaatttgaaaaagtgttgaatttgtcaaataatgtttctatatctatcaagatgattatatgctttttctcctttattctgttaatgtggtgaattacattaaaataatgttaaagt

SEQ ID NO: 241801 - DNA, 706 bp, Homo sapiens
  misc_feature (95)..(95): n is a, c, g, or t
  misc_feature (98)..(98): n is a, c, g, or t
  misc_feature (106)..(106): n is a, c, g, or t
  misc_feature (155)..(155): n is a, c, g, or t
  misc_feature (261)..(261): n is a, c, g, or t
ccttctcattcagtctttttcctttacctaccctttaaaggttcatgttcttcaaagtttcatttccttttgcatattctcctttgataacagcnttntccgtagntaaaacactcacctctttgctgatggcagcctgggttcttcattcctcntctggatccctgccatgtctttttgtcatggccctcaattgtgtgcatgtaaggaagtatgtgtgcctctcttagactataagtctccagcacctaccataaggtntggcccatagtagacactcagtaaatatttgaaggaagaaagaaagaaaatgccaggagtagtggctcatacctgtaatcccaatactttaggaggctgacctcaggtgatccacccgccttggccccccagagtgctaagattacaagtgtgagccaccgccctcggctgtgagagggcttctctccggcctgtggtaaagctagagaatcatcctttacacactagagatgtggatttgcgataaactgcagacctagataagacactgctgcctaatcagcgtgtgatagttcatatcctctctcgggctgtctttgaggaggatcctgttttacatcactctccaacctaggaggttgatgatctttgatttcaattgttagctcccctggttttataaattgacagatatctaacaattcagctggccacaaagttctgg

SEQ ID NO: 241802 - DNA, 357 bp, Homo sapiens
tgaagagtacgtacatctggtagtttgggtgtatgaaattaagtatacaaatgctcatacatctaataattaatgtttgatttaattggaaaggtcttgcttttaaggtactagacatttttgaatgaaattataaaataatagtaaggcaactcatttccaaagtctaaaaaagagaaacaaatacatttgctaaattttggccataattcctcaaatcactgccagcattaaaactttcacgccatcttccagccagcaacaagatgtgaccaatgggaacacgaggccatttaggtgaaggagatagttctggctctgagacatggttcgtccccttccccctccccataaatg

SEQ ID NO: 241803 - DNA, 386 bp, Homo sapiens
gttgtttacctctaaagaaggttgagtttttctctagcaggcagtaacttgacttggacaccattttgatgcttggacacctgcctttcagccttgctaggttttctctatagctgccttaattctaggaatacactaattctactcctaaagtctggcttttctggggtctctgctgaatgcccaagatgttcagtgtggtcactctcctctggctggtcagaactccaaccgcccccagtgctatctcagctctgtgagctttattgagctcactgttgccttgtagttgctgttcctcagtagatgtcctttgccctagtctcttgtggaacatttttctgtgcacaaaaaactttatgtttagtcaatgacttgaagagatt

SEQ ID NO: 241804 - DNA, 372 bp, Homo sapiens
caccatgttggccaggctggtctcaaactcctgacctcagatgatcctgaaagcaacaagatggtgccttcccccttttccccttcctttgcttgagtgataccagaggtatctagttaaaatagcaggtttaaataaaatccggtctcataacataatactcaaaatatctaggtttcaagtgaaaatcactcatcaagatccagaaagatctcaaactgaatgagaaataaatggattccaatacagagatgaaagaaatattagcattatcaaggattttaaagcaacaatcataaatatactctaatgagcatgcttaaaacaaatggaaaatttgaaaagtttaccagagaaatagatagtctcagc

SEQ ID NO: 241805 - DNA, 1020 bp, Homo sapiens
cccacgcgtccggagaggtggagggcaccctttgtggaggaggacccctaaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccgagggcagacttcagaccagccctcagatcctgatgccaggttacagggctgaggggagcctgaaatccactgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtgaaaaaaaaaaaaaaaaaaaaaaaaaaaaaaaggggggcccaaaattcccagggggccatcccccagcttttcttgtaccaacagtggcccctatggtgagtgtcgtttatataggctagggcacgcgtggcccggccgtttaaacaaccggtgcgtggcagcggggacaacaccgtgctaaccctggggaatctcggtgaaaaaggaccccttactctggctgtggggtcggcacctctgtggccccactctaccttaccagaagatattaaaggcctcaaagggtaattataaacattccaacggggtctttcatggttgtaacccaacgctgcattgtgctcggccgacaggacaagtttggcattaagggcattatgacttcagcacatttttttccccgtgatctcttatataaacgggccacc

SEQ ID NO: 241806 - DNA, 1824 bp, Homo sapiens
ccactgcccccggcagacccttcatgcagcttctcctgtggggtcttgcccttgaagtgccacttcccccagccccacctctggtcccttccagagggcacccttagccttgtaggtccctgggaagctggcacagcatcaaccagaagtgatgcctcagccaggccaccagtcgctccccgcctgggagctcagctttcctcagaaccaccccccctgtctgaagctctgtcctgggtcccaccagacttctgcccaccaggcctacctacagcatccacatggggcctcaggaagggccccgggggcccagggatgggcaggggcagggtttccaagcgcctggggctccattctcctctgtccacccagccacaccccttggcctcagcctgccctgtacccaagcttccctccccctctcctggggatcttaacggccttgttctctctccctggcacccacccccagggcgggtgatgccgccaagagagagggaggccgttgctaggtgatggcgccgccatgcacacaccctttgtgctggggagtgacacccacccgtttctcagcagacctgttgccacggtgactgaagcccccagctctgtctgtagaaacttcagatgggtgggggagcaggttggagaggggaccaaaggcaggcctgtcgtgctgaagctcttggggaccgtttcctcggcatttccccaactccttctccacccccctgccaggcccggaagtaccaccagcttcctaagggatgcaggaaggggccgggtgaactgaggtgaagtccagggcaggggagtcagacccctcaacatcctgtttaggggtcctcctccacaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccgagggcagacttcagaccagccctcagatcctgatgccaggttacagggctgaggggagcctgaaatccactgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtgaaaaaaaaaaaaaaaaaaaaaaaaaaaaaaaggggggcccaaaattcccagggggccatcccccagcttttcttgtaccaacagtggcccctatggtgagtgtcgtttatataggctagggcacgcgtggcccggccgtttaaacaaccggtgcgtggcagcggggacaacaccgtgctaaccctggggaatctcggtgaaaaaggaccccttactctggctgtggggtcggcacctctgtggccccactctaccttaccagaagatattaaaggcctcaaagggtaattataaacattccaacggggtctttcatggttgtaacccaacgctgcattgtgctcggccgacaggacaagtttggcattaagggcattatgacttcagcacatttttttccccgtgatctcttatataaacgggccacc

SEQ ID NO: 241807 - DNA, 162 bp, Homo sapiens
ctgaggcttggaaagaatgccacatggctaataaagaatagaagcagggcttgaatcaaggaagtcttgataagggacttcacactctcaaccactgcattatgtggccaagtgggagagctgagggatgaaaaacacaagacatttcacaataaatcatga

SEQ ID NO: 241808 - DNA, 577 bp, Homo sapiens
atggagtgctcccaaccagaagatgagggaaatggagataatgaagcacgtccctcctaccaaacacgataaattctacaggcactgtaagatcaagaatttaagattatttttgtcccaccctattttacaggtgaggtatcaagcacagtaactcgtaattttcttttggcccaattgaaaggtatcatataagagaaagctgtgtgtgcgtgaaaaggatccgcctttctttctgaagaaaagggtggttacggcttcggaaacgcttttcaagccaactctgcagcccggctggcggcggcagcggcggcggcggcaacgtcagattcccgcagaggcggcgcccggcaggggcggcaggagctcaggagaggcccccggggatcgggctgggccccacgtgagagctaagcgactgccctcgcgcccgcagaacagcagggcctgcatcgactctaaggcgagaccagaaacttgctagtggagcaattctggtgcccctgcccgggctgtgaaccctctgagatcatccctcaatcaaacgaatagaaatcctcgggaagaaaaaaaaaat

SEQ ID NO: 241809 - DNA, 608 bp, Homo sapiens
ctattatagttctttttgtttgattgctttttcttggtttgaatgaaaaatatctttaagaaagatttgctaatctttttctgttttatcactaagttaaaattatatttatttttactaagtagttttcagttttgtgttattaaattgagtagcctttgtttttttttatttttagcactcccctaaatggtttctaccaattcagtctcattgaagctttctatccttaacatttgtaaaaataatataatctttcattaatagcaaataagctttgtttggttttgctgctcatgcatgcctaatgctgttctgtgtaagatatatctcactagttagcttgactaaaacttcttaatgtaaaggttttattgatttagtaaattaatgtccctaaatattttgtctaagatagtcactgttaataatttggcttttcagaaagtgtataagaaaacaaaaattttttttttgagtttggaaattaaatgttcttaagaatatttgctttttttctagctctttccattttttaaaaaattctttttatttatttatttatttatttatttatttatttatttatttattttgagatggagtct

SEQ ID NO: 241810 - DNA, 409 bp, Homo sapiens
gagtgttgcaatagctgctttgcttgagtttcaccagccacatgttccttattcattccattccccatcacaaattcccaaagtagctgaccttcgccgggaggtaggcagagaggctcacagaaggtaaaaattcccactggccttagttatcccaggaacttacgcatttactttttattaaatttattttgattttttattttatttttaaatgtttgtgggtacatagtaggtgtatatatttatggggtacatgagatattttgatataggcatgcaatgtgtaataatcacatcagggtaaatgggttattcatcacctcaagcatttatcctttgtgttacaaaaaatctaaatatactctcagttattttaaaatgtacaataaattatttttgacttcag

SEQ ID NO: 241811 - DNA, 300 bp, Homo sapiens
tgagcctactggggggctggcttcctgggaaaagctgtgggcccgctccaagcctattgtgaacttcaaagatgacttgaaacccacgctggtgtgaaaagcaacagagctggtctagacacagaggtcagtccaagagaagctgtaccaaggcccacaggagaagagccaatttctggtctttggggaacagattagtgccctgcatttgaccagcccataccatgtttcagctaggctcactgtgttactttgagtacttcttgatctataaaaagagaggcattgcctgtcctgtta

SEQ ID NO: 241812 - DNA, 363 bp, Homo sapiens
caaattgaattgtatccgcaaaaggaaacgttgaagtcctagcttctggtactttagcttctgtgactttacttggaaataggaaatagggtctttgtagatttttttaagatgtaaattgggccaggcgaagtggctcacgcctgtaatcccagcactttgggaggctaaggtaggtggatcacgaagtcaggagttggagaccagcctggccaacacagtgaaaccctctctctactaaaaagaataataatttaaaaattagccaggcatgatggtggtgcctgtatttcccagttactcgggaggctgagtgaggcaagagaatcacttaaacccgggaggcggaggttgcagtgagct

SEQ ID NO: 241813 - DNA, 589 bp, Homo sapiens
cccaaaatatattacaaagttgtagtaaccaaaatgggcattaaaaaacacgtagatcaatggaacagaatagagaacacagaaataaatgcacatatttatagtcaactgatttttgtcaaaactaccaagaacactcattggagaaagaaccgtttcttcaataaatagttctaggaaaagtggatgaaactaaacccctacctctcacccaatacaaacgtcaacttaaagtggatcaaagacctaaatttaagacctgaaaccatgaaattactagaagaagttctttgggggaaatgcttcaggatatgagtctgggaaaagattttatgaataggatatccaaagcacaagcaacagaaacaaaaataaacaaatggcattatagcaaactaaaaagtttctgtgcagcaaagggtacaaccaatagagttgcaagatacataattaatatacgaaaatcagtagcttttgtaggcacatacaatgaactagctgaaacagaaatcaacaaggcaatcccatttacaatagttgcaaaacaaataaactgcccagtaaataatgtaaccaagaaggtgaaagc

SEQ ID NO: 241814 - DNA, 547 bp, Homo sapiens
cccaaaatatattacaaagttgtagtaaccaaaatgggcattaaaaaacacgtagatcaatggaacagaatagagaacacagaaataaatgcacatatttatagtcaactgatttttgtcaaaactaccaagaacactcattggagaaagaaccgtttcttcaataaatagttctaggaaaagtggatgaaactaaacccctacctctcacccaatacaaacgtcaacttaaagtggatcaaagacctaaatttaagacctgaaaccatgaaattactagaagaagttctttgggggaaatgcttcaggatatgagtctgggaaaagattttatgaataggatatccaaagcacaagcaacagaaacaaaaataaacaaatggcattatagcaaactaaaaagtttctgtgcagcaaagggtacaaccaatagagtgaaaagataatttacaatattagagaaaatctgtgcaaactacttatccaatttggggtgaatatcctgaatatacaaagaactcaaacacttcaacagctaacaaaaaat

SEQ ID NO: 241815 - DNA, 1989 bp, Homo sapiens
  misc_feature (578)..(578): n is a, c, g, or t
aagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccgactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacnaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctc

SEQ ID NO: 241816 - DNA, 413 bp, Homo sapiens
aaatctccatctgaaggtactgatgactcaagtctgtggtcctgcataagcaacatctttggagctgttagagaagccctgcctcaggttatctgcaaatctcagcaactgaacagtcaaaaatgacacaaaggaggccaggcatgatggctcacgcccgtaatcctagcactttgggaggccaagatgggaggattgtttgaggccaggagttagagactagtctggtcaacatagtgagaccccatctcaatttttatttaaaaaaaaaaaaaattagccaggcagagtggcacaagcctatagtcccagctacttgggaggctcaggtggcaggattgcttgaaagtttgaggctgcaataagctatgaatgcgccactgtactcctgcctcggtgacagaagaagaccc

SEQ ID NO: 241817 - DNA, 313 bp, Homo sapiens
aaggactttgtgtcagtttctcctgggacaaatctagtctggaccactttgcaacatttgttcaaactgaaaattttgacaaagacattctgttcacaaagagccaacaaatgttctgtgtttcgatacatttggaggttacaaaatgttgcctggtcttggcagataactaagtctggggacccacatagtgcaagccatgccctgtttaatttgtctttcaatggcaaatgtgtttcttctgtgattcagcataagggatgataccctccaataggactgtgtgacctccctgctgcttttgtggtataga

SEQ ID NO: 241818 - DNA, 456 bp, Homo sapiens
agcctttgacaggctcagtttacctgctgcttcttccaagcccaacttcctcctccagctctgcaggaggagatctgcatgacctcaaggacagcacaccccagggtggcagcccctggaaagcccagcaggagagccgtcagcggagggatgtcatgggagccagtggcatccctagcaacctgcactctcccaggtcccagccagatcgccagctcagccaagcaggagaaaatggctccctggaaccctgtaagtgactagcctaggctcctctgcccaaagacctgtgtcgaaagatccaagacacttccctccgccgtctgaacacaactgggcctttgtgtgtcggggccaaacacggttcctaattggcagcataaacaatgggcctctgtgtttgttcccagaagacaacacagttctgcagcaatgacacgtgtttcaatgtacaaa

SEQ ID NO: 241819 - DNA, 451 bp, Homo sapiens
gctggcatacagtggcatgctctcagctcactgcaacctctgccccctcaacctgtggtactctccctgtctaatcctaaatttcaaacgccagagccacacagccctaggagagcgaaccagatggggcagtgactggtccaaggaccaggtccaagagtgtccaggttcctggaccatggccagtccacaagcccatgcacccaggtctccggggcttgcttcatctctgctggacttgtttccgcagggttattactgttctatatctgttatacctcccttcatccacggcagggactcctagaaacagactttcactcccatggaaggcagctccacacttccaacccaccttagcgcaggtgaatggaaggcgaattggaacaagtattcccaatgctgtttcagaatctatccttccatttaaaaataaaaaacagaaacaaaa

SEQ ID NO: 241820 - DNA, 650 bp, Homo sapiens
aaataacagatttaagtggtcaggaattttgttataaatatagaatgatgattatatgaaatcttttcctgtgaaagtcaaatttaagtaaaatctttatcaccatctgcaacatttgtctgcagcctggcttaccaggttatcataaagaacatttattttacagatacattaaagaaagtcaaaaccctgattatgtgtaaacaattttacataaggaaatatatgaattttaattatatttttctaaaatccgtactcagcatgaaattaatacatcttaacccctccctgtgacttcattattatttttaatgtaactttagaagaacccagtagagagagcagcgtgctaagtgtgtttctttcttttccagacaactttgaatggagaggagcaaattagtcttttggtttaattctgtctcagtttgcttatctaaagaaaggaaaacagagtggctacacttgtttagaaccatatgcatactccagagaaagatgctctattaatccaaaaaatacagccacttgaaaccagccaaagcgaaagtgtaagggacttcatggaaaggaggcagttcaccaaagttattgaggggttttatattttaaactccgccagtgaattgacgtgtaatgtcacttac

SEQ ID NO: 241821 - DNA, 395 bp, Homo sapiens
tgtttttactagagacagggtttcaccacattggccagtctggtctcgaactcctgacctggtgatctgcctgcctcggcctcccaaagtgctgggattacaggcatgagccaccgtgcccggccctctttctctttttaaaagcagatctcatctaaatctcattacctcccaaaggccccacttcttaatttcataccattgagggttaggtttcaacaaaaaatgatttaaggggacacaaacctgcagtccataacaagcaggtagtgtgggtcaactatggttttgtttttaacaaatgttttgactgttcaaagcctcttgcaattcatatgaatttgaggatcatcttttccacttctgctaaaaagctgtggcagtttggataggga

SEQ ID NO: 241822 - DNA, 1416 bp, Homo sapiens
agcggggggtctcgggcaggcgcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggttacattagttatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgaccctgatcaacatgagatgaccgccgtgtggtaaactgatgaaccctgaccctgatcaacatgagatgaccgccgtgtggtaaactgatgaaccccgaccctgatcaacatgagatgaccgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtg

SEQ ID NO: 241823 - DNA, 1261 bp, Homo sapiens
agcggggggtctcgggcaggcgcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggtacattagttatacactctggaggtgacttgacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgaccctgatcaacatgagatgaccgccgtgtggtaaactgatgaaccctgaccctgatcaacatgagatgaccgccgtgtggtaaactgatgaaccccgaccctgatcaacatgagatgaccgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtg

SEQ ID NO: 241824 - DNA, 977 bp, Homo sapiens
tgggggttagtgtaagtaataattttagtataagtaataatttccattggattgtaatcagtcagggatgtttattttaatttctaagataatttataaaagaatagtgtatatagtcatgcactgcataatgatattaggccaacaaaagaccacgtatatgacagtgatcccagaagattttaatactatatttttactgtaccttttcagtaaaaggtacgtatattcaaaaggtaagtatattcaaatggtaagtttgaatatacttaccattgtgttacagttgcctgcagtattcagtatagtcacatgctgcacaggtttgaatcctaggagcaataggctacatcatacggcgtaggggtgtagtaggtatacgatgtaggctcttgtaagcatgctctgtgatgttcacacaattatgaaattgcctattgacacatttcttagaacatatccctgtcattaagctccacatgactgtatatctaacaagttaaaagagggaaaaattaaaacaacatttgctaatcaacagaaaggcaaaaaaaggaatataagtaggacataaaataggtgggtcaaattgcaaacaaagagtaagtagctacaaatctatttaagtaattacatttcatgtaaaggattaaatactccaagtaaaagattaggtttttcagactggataaagaaccaaccctcccccaatatactgcttacaagagatataaacacatggatggaagaggtgatataatacgaacactaaccaaagcaaagccggcataactacactagtatcaggcaaactatgcaataatgctgcttttaaataaagatatgtttcttaatgataacagggccaatccaacaaaaagatatcacaaactgaaatctgtaggttacaaataacttcaaagaatataaagcaaaaattggcagatataaaatgacaaatctataatcctgttggg

SEQ ID NO: 241825 - DNA, 211 bp, Homo sapiens
taagaccgggtcttgctctgttgcccaggctggagtgcagtggtatgataatggctcactgtagcctcaaactcctgggctccagtgatcccaccctagcctccttagaacaagcacacaccaccatactcagctaattatttttcttttttagagatgaggtttcagctgacacacgctggctcatgcctgtaatcctgtttccttggga

SEQ ID NO: 241826 - DNA, 635 bp, Homo sapiens
cccttgaggaaggtaggactatcccccctatttgacagaggaaggcaccaaggctgcccagggctgaacccccagacctaactacaatctgagctctgtgatgaccgagatagtgaggcctcctgtccctgaggttctggtgagggagccagacaggcagataagcaagtgcaagaaagtgctgagggctgtgaggtgtgcggaggcattctaggacacctccctctatggtcacttctctgccgtgtttaatactaacagtgaattgtagaatatagtactttagttttattccatgcaaatctacagctccagttagtgaaatggatcatacacacagaagatatggacatcaaaagttgaagaaaagtgagtgcccttgtagttttcctgcttgctgccttctcctcccttaggttgagagtttcttcgttgcacaaaggagcatcaagagaaacaagttcttcagttacccatatttacctgtcacaaaacctgctttgcaaggctgacatcagctaaaacccagtgtcttctgatagaaggatttattgttgagagattcttcttcccacttatggcaactgtatataaacagttacgagtatacctaatgatgggaagatttgtaacat

SEQ ID NO: 241827 - DNA, 1903 bp, Homo sapiens
aacacattgttcaggtttggctcccacttgccacttgctctccgggtctcaaaatgctgccatccacctgccctgcacagggagcctcactcatccactcactgccaccagtaagcaccaccctacacccagcactggcccctgaatggccagagggaagaccacccagaacactggtgaaggcattaatcagggacccagttcaagccaggcccttctgctgctcccgctcggtgtcactgtgaggcactgggagtgcccaggacacagtgacccaggcctggacctgctggcacgtcctggatagagcaggactcacaccagagagatgagggcttcgggtaaggacagacccgggctggctgggccgcagaatgtcatctcctgctagccgtggcttcctcatcaccagatctataaaaacaacttcccacggccgtgagggctcgagcgagatagcacagaggaaatgcttccccacttgtaaaactctctctgtgggccactatcgtgcctggctgccacacttcctctccgctccaactaaggcctcgctgttcacatgcaggcagctccccgaggaggttgtggggccaggatacagggccttgtagacgagcaagaatgcatggtctcagggggatgggaagccttctgagcgcttcctccagacagtgccggagaaggggcctggctgctccttgccccggctgcgggccaggcgcccagtctgctatgtctctagcatgtgcccctccgagatcagtgagagccccagtcatgcatccccaggggtcctgtaacagaggaccacacaccggggggcttcaaacaacagaaatgcatccttgcacacttccagaggccaggagtcctaaggcatcggcagggctgactccttctggggtctccgagggagaattccactccatccgctcccagctgctgctggccccggctcttctctgcttatggacacttcagtccactctgcctctgctgtcccatggattttctcttctaagaacacttgtcattgaattcacagccctccctacttcagaacaatctcatcgcaacatccttaactgaatcacacctacaaagaccctttttccagatgaggccactctcacagtctctgggccgtgggcttattttttggggctgccattcaacccccctcatcacactctcacactttctgagctgagatccacagtaaggaatacactgtttcatcttcgccctaggcacatactctcatccgcagctgaaatgcagtttcagaatgtgaatccttatttcacgttctgtgtggtgatgttttctgttttctctcttgcctcctcctcagcattggctacacacccactaattgattcccagagctcacagcctggatcaaagttgtttctttgttttgtttgtttgtttgtttgtttgtttagagacagagtcttgcttcagttgcccaggctggagtgcagtggtgcaatcacagctcactgcagcctcaacctcctgggctcgggtgatcctcttgcctcggcctcccgagtagctgggactacaggtgcatgccatcatacttggctaatattttcgaaattttcctaaggctgggcgcggtggctcacgcctgtagtcccagcactttgggaggccgaggcaggtggatcacctgaggtcgggagtttgagtccagcctgaccaacatggagaaaccccatctctactaaaaatacaaaattagctgggcatggtggcacatgcctgtaatcccagctactagggaggctgaggcaggagaatcacttgaacctgggaggcagaggttgtggtgagccgagatcgtgccattgcaccccagcctgggcaacaagagcgaaactccatctcg

SEQ ID NO: 241828 - DNA, 398 bp, Homo sapiens
ctaccacccagaatctgaaataaaagccaaagctggccaggtgcagtggctcacacctgtaatcctagctctttgggatgccgaagcgcctggcctgggtgacagagtgagactgtctaaaaatgaaaacaacaacaaaaaagctgtatttattgtctgtgtaagtaaggaaaagttgtgtgctgatcaggcacagtcttatttgaacaaagcgatttgctgatcttagttggggttcttgggaagagtttgttttaggttgaggtggctacaaagacagaaatgagttagtctgaggcattgtttatattgattatacaggcaagaataggttgatatctgccttagaattttgtttattggaatgagtctgctaatgggctgactttcaaaacttg

SEQ ID NO: 241829 - DNA, 287 bp, Homo sapiens
ccattaatcatttctctatagacctctgttatcttttatggagacagtatttagaaactaagtcattgtatatagctgttttttagcttaacattttgtcattgttttccatttaaaagacaatattgcttatgtgataatgattatttagtgtttgttgaaacttgctttatgtcctagagaacatgatcaactagtgttttatgtgtgcctggaaagattgtgtatctaatttttgcgtgtagtgttctgttcattaaatttaactgtgttgtttaaatcttctc

SEQ ID NO: 241830 - DNA, 385 bp, Homo sapiens
cagggtttcaccaggttggccaggctggtctcaaactcctgacctcaggtgatccacccaccttggcctccgaaagtgctgggattacaggtgtgagccactgtgccagcctgattctaacttttttcattctgatttacaaagccctatgtaatcaggtccctgcctacttctcctctctgaacacatttcacttacaagtgtaaatcacaatctgttaagacattcatttagctatgaaattaagataatctttttttgcaacagaaaattgctagatactattcaatcattctatgtcttcatttcaaggaaggtccaagaaaaaaaatgtgttttggaagtcatgaaataagatctaattaataaaatgcctcatctggta

SEQ ID NO: 241831 - DNA, 358 bp, Homo sapiens
gtggggaaagccctgatttgtagtgtttgcccattcttgtggtataagtattctcacaagaatctgaatatgaggccagactcagtggctcacacctgtagtcccagcactttgggaggccaaggtgggtggatcacttgaggccaggagttcaagattatcctgaccaacatggtaaaactctgtctctactaaaaatacaaaaattagctgggtgtggtggcacatgcctgtaatcccagctactcgggaggctgagatgggaggatcactggaactgggaggtggaggtttcagtgagctgagactgtgccactatacccgagactgggcaacagagtgagaccctatctttaaa

SEQ ID NO: 241832 - DNA, 99 bp, Homo sapiens
aagaaaaaaaaaggctaagaaactctaatatgaacagttaaaaagatagctggtttgagagagagtaagggtttgatagtgtaaatgtaaaaataattt

SEQ ID NO: 241833 - DNA, 478 bp, Homo sapiens
acacatcctctttgcctgaggaagttggagtagttctacctctgttatggcatttaaaaattgtatatttaatttttcagtgtatttaacttctctttgtcctcttgaagttgggaacattcagttgtactctgaaccagtggatattgtgacctggcgctgtgccacttgggccagcttttgcttccttaatgaatgcacttccttcatctgttagtgataagcaggcaagtgaggaattcttatctgcatctatggattgaacatctgtttctattccactgtgtttcagttttaacttctttgcttagaaattaatgtgagcaagtgagcctcctctttttaaagccattttggattgagagtatttgttttctgagcattttatatgcattaaattgataatttagattttttttctaatgttttgagtgatacagaaatcatcatcatgtgaaaacatttgggcagtgaatct

SEQ ID NO: 241834 - DNA, 1479 bp, Homo sapiens
acacatcctctttgcctgaggaagttggagtagttctacctctgttatggcatttaaaaattgtatatttaatttttcagtgtatttaacttctctttgtcctcttgaagttgggaacattcagttgtactctgaaccagtggatattgtgacctggcgctgtgccacttgggccagcttttgcttccttaatgaatgcacttccttcatctgttagtgataagcaggcaagtgaggaattcttatctgcatctatggattgaacatctgtttctattccactgtgtttcagttttaacttctttgcttagaaattaatgtgagcaagtgagcctcctctttttaaagccattttggattgagagtatttgttttctgagcattttatatgcattaaattgataatttagattttttttctaatgttttgagtgatacagaaatcatcatcatgggtttccttaaatttctgtggcaatgggcttattaaaaatgtaattttgtgcatggtgatttttggagggatatcaaacttatcctatgggtgttcagttttgtcagagagttatgatacattttattctgcatattaaaaatgttccagaaaggaaagcaaaaaaatcaccatggcaactcagtagaatgcccttattttgtttttctgaaaggaaaattctaaatctgagtaagaggtataaaaaagagcagtgcagattgtgtctctggcttccaggaagtgagctcataaaagaatgggtttgatgccctgggtgactctgtgttatttaggaccccatttgttttttctcataaggaagagctataaaaaggtggcgtatatattgacactactaaaacagatctgccaaagagcctgttgaatttttctttgtaatgcaactttttggagccaactgtaagtgtcaaggctaaggatgaatggatagctgcaggggttggtgggggaaggttcttaaggtgtcatcacaccacttttgacacttcaacactgaaggagtgctactagggtgagtttgattagaatgattctagcagagtgtcaaaaaagaaataatacatagtcaatgaattgatacattgattaatagtaaaaagtagaatcaagccatgtaccatttttgtagagagactggtgggcagatcagttgtcaacatggcatccagtagtagcaccaaactggtcgtgtagaactcagtgtctgacctgtaaatggttgctattccagggcttctgttacccttcttggggaagcaccagaggacctacaggaacatcagtattccttagaggagggatgaagtgctcaggcatagatcctgactgacaaggctggaagtagcttgggaaagttacttaacctctccaaacatcagttttcttatctatgaaatggttatggttataacagctatcttatagggttgttttcaggaatacatgagttaatatgtacaaaa

SEQ ID NO: 241835 - DNA, 1383 bp, Homo sapiens
  misc_feature (1273)..(1273): n is a, c, g, or t
  misc_feature (1350)..(1350): n is a, c, g, or t
acacatcctctttgcctgaggaagttggagtagttctacctctgttatggcatttaaaaattgtatatttaatttttcagtgtatttaacttctctttgtcctcttgaagttgggaacattcagttgtactctgaaccagtggatattgtgacctggcgctgtgccacttgggccagcttttgcttccttaatgaatgcacttccttcatctgttagtgataagcaggcaagtgaggaattcttatctgcatctatggattgaacatctgtttctattccactgtgtttcagttttaacttctttgcttagaaattaatgtgagcaagtgagcctcctctttttaaagccattttggattgagagtatttgttttctgagcattttatatgcattaaattgataatttagattttttttctaatgttttgagtgatacagaaatcatcatcatgggtttccttaaatttctgtggcaatgggcttattaaaaatgtaattttgtgcatggtgatttttggagggatatcaaacttatcctatgggtgttcagttttgtcagagagttatgatacattttattctgcatattaaaaatgttccagaaaggaaagcaaaaaaatcaccatggcaactcagtagaatgcccttattttgtttttctgaaaggaaaattctaaatctgagtaagaggtataaaaaagagcagtgcagattgtgtctctggcttccaggaagtgagctcataaaagaatgggtttgatgccctgggtgactctgtgttatttaggaccccatttgttttttctcataaggaagagctataaaaaggtggcgtatatattgacactactaaaacagatctgccaaagagcctgttgaatttttctttgtaatgcaactttttggagccaactcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgaggtgacctccaggatacatccaacagagtaacagtcaagagccttgattaaagtaggaagctgaaaaatgtattaagttaccatttactggctgggaaaagcagcaaacaagctgcacatcctacagcggaacgacactaaaaccngaaggagtttgaaagattgttggctcaaatgcgaaaggacactgatgacattgaaagtcctaaacgcagtatccgangacagtgggctacatccgactgctgggaattcc

SEQ ID NO: 241836 - DNA, 444 bp, Homo sapiens
ccccccccccagtgcttgttccttcacttacttttccaacctccacttccccaaggagtcccaggcaatgcctgttcagctggtctctcctggggcaagcctctgaggaggaaagagtccgctggacctggggttggctctggggcagttatcttggtccctccatttcctcatctacccaatagcagcaaagaatattgattggcatggtttgggaacatgaacagagatgactgctgaaaacccatgagcaccacggtgagtctttctgatcatttctgggttctgagcactgggtaggctgttcccaccacataatccactcaaccactgctgcaacgggatggaagagtggtccagagcctgggccctgaagccagactgcttgagcctgaattcttgctctgacacttatcagctctggcactatctgcatagtacctt

SEQ ID NO: 241837 - DNA, 375 bp, Homo sapiens
ggtaattacacgtggatctgtccctttataatgattacgttattctgtagtctggttgttgcaaaatatattttgctgttcttccgttaatggacatctgagtcatctccagttcattactattacaagcagtgccataacaaacatctttgttcaaaaaattcttgaaaaaagatgtacatattacagattctagaagtggaatcgttgggtcaggatgggtacctgttttgtttttgtttttgtttttatcatgtaaaatcacaaatatatttaaaagatgtatagagatctagaggaagagatggattatgagaattgcctcaggtgattctagaggctggcaagtcccatgcaagctggagaaccaggaat

SEQ ID NO: 241838 - DNA, 460 bp, Homo sapiens
gttataatgtggtagagatggtaagcagtcaagtggtagtggtggaaatagtatgtggaatccttagctagtgcttatacttcttaggtatagtcatcatagacatgggcaggaaagaaaatagtgctcaatctccagagaaagagaatgtcagagaatttttatccatagtttgcccatgcacatgggtgtacaatagatttggaagcagaactttttccaggtgcatacttttaaaatgtcatcattccctaaacattatagtataacagctatttacattgtattaggtattagtaatctagagatggtttaagtacataggaggatgtgtgtacgttatatgtaaatacttcccaggggcgtccaatcttttggcttctctggaccacattggaacaagaaatatcttgggccacacatgaaatactctaatactaatgatagctaatgagctaaa

SEQ ID NO: 241839 - DNA, 1022 bp, Homo sapiens
ctttgggaggccgaggtgggcagatcacctgaggtcaggagttcgagaccaggctgcccaacgtggtgaaaccctgtctctaccaaaaatataaaaattagccaggcatggtggcacgtgcctgtaatcccagctacttgggaggttgaggcaggaaaattgcttgaacccaggaggtggaggtttcagtgagccaagatcgtgccactgcaccccagtttggatgaaagagtgagactccgtttcaaaaaaaaaacaaaaaaaacaaaaccaaaaaataaaaaaacacatcagcttgacattttggaggcattcccagactcagggttagtcagcagattagcatttaaaagaaagtcttgtccctacagattccctgacctcagctacccatgaagggtgggaagaggagtccttagcaagaagtccaggaagttgacaacctcctcagacctgataggacactcctctctccaccctgcctcctgactgatttaatctcaggggtgtgaggacctctgagataggccccaggagtctcacccgcaccacttatgtctcagggctaaccagagactccctgaaacagatcctagaggattcccaagtgataggataaatagagaggtactgagacttcctggcgtgggtgacctctcccaggctggccaacctcccccattcagaaatttgctgagcaccaggagtgaatgaagtaaaggaagcccctaggagttcaagaagcagagatttccaggtccatgcaccaaagctcatgtgctcaattctcaggaaaggcctcactcagttaaaaaattttgtatcatgaaagggtaaatgaattaattagtgaatctggtttctaagccaatggcttactagaaatattatagtaaatcagaaaaaaaaaaaggcggtggctcacacctataatcccagcactttgagaggctgaggtgagaggatgctttgagcccaggagttcgagactagcctgggcaacatagcaaaccccatctcta

SEQ ID NO: 241840 - DNA, 399 bp, Homo sapiens
cttggtctgactgttctcttatgcgtaggttcaggttctggagtttgggcaagaatagctggacagggcatgtggggttctttttactgcatttgggggcacaaccacccaggttggcaccctactcatgaggctcagtttgcactctcggttaaggtgctgactgccagatttctcctttgcaggggtacattttccctttctaatttgtcagtcatctgtgaggtgccagtgtaagaccctgtgagtatcctgtgccctggcagtctttccatcccctgctttcagcatccttgaggatcatggcctgagtcccctttgaggctggggtttgcaaatggtggtcatccaatttcttgtacattttttattggcattcttctgaaataaatgttctct

SEQ ID NO: 241841 - DNA, 562 bp, Homo sapiens
tgggctctaagcctctccaggtggggatcactcttcggggaagaccagacagggcagatggagctctcaagtcacgtgaacacacggccaccagttccacagggcagagaccggcatgtctccagttgaaaagccacgcccgtcatctttgcacgcccacatgccttaggtcaccctggctgcatcctgtggcaggtccgtgggttcctgggggtgccctgctcccagctgtgcccacgtgtggtgggagccccagagtggccccaaggctcctcaggtgcacctgaaccttctgcacctatggcgcagcctggagaccgtgctccccagcagaagccctctggaggcggcctgcctctgaccatctgccttagcttcctgcagctgctctaacaagttcccatgaacccagtggcccaacagaaacttaattttctcaaagttctggacgccaaagtccaaaatcgccatcacttggctgacaaggtgctggggccatgccggacccagagactacaggtgagcagttatctgtgggcctcccagcacctgcggcggccgc

SEQ ID NO: 241842 - DNA, 452 bp, Homo sapiens
aaaacagagaagaggaagagctaaggtcataatcacaggctgccttcagctcttcggaaaaactacgcttcctctgccattccccagtcctcacccttactccccaagggtggtagggaagggaaacggagcgatggcggcactagggtggcaaggaagcttgaagccatgtcaaataaatagttgaaagcaccagccgctgtggctcacgcctgtaatcccagcactttgggaggcctaaggcaggcggatcacctgaggtcaggagttcgagaccagtctgaccaatatggtgaaaccctgtttctactaaaaatacaaaattagtcgggtgtggtggcgcatgcctgtaatcccagctactcaggagaatcgtttgaacttgggaggcggaggttgcagtgagccgagatagcgccattccagcctgggcaacaagagcgaaactcctc

SEQ ID NO: 241843 - DNA, 341 bp, Homo sapiens
ctaaataaaaatagaaaataccctttgctgcagtagttcagttgtttaaaaatattaaatctgaggcctggggtggtggctcaatgcctgtaatcctagcactttgggaggccgaggtgggaggtcaggagttcgagaccagcctgacaatatgatgaaaccccctctctattaaaaatacaaaaattagccaggcatgatggcgggcgcctgtaatcccagctgctcaggaggctgagacaagagaatcgcttgaacccgggaggcagagtttgcagtgagccaagatcataccattgcactccaacctaggcaacaagagtgaaagtttgtctcaaaaa

SEQ ID NO: 241844 - DNA, 356 bp, Homo sapiens
ttcccacaagatctgactgttaaaaagagcctggcatcttcctctctctttctccctctctctccatgtgatctgcacatgccagctcccccttgccttcctccgtgagtgggagcagcctgaggccctcatcagaagcagatgctggcaccatgcttcttgtacagcctacagaaacgtgagctaaataaacttcttttctttataaattacccagccaggggtaagcctttatagcaacacaaatggaataggactctctctaagcctcagttttcatacctgaaaaagggagataatgaatcccatctcatgacttgtgaagttagtaagtcacatctcacacttagcacaga

SEQ ID NO: 241845 - DNA, 380 bp, Homo sapiens
gcaattggcctgttaactcaattttgaaaatgtgtgggtaagtgtgagcccaggttttaaaagatttggatatttctgcagctgtgaaaggtaaggaagcagaatactagcccctactcctgaacccaaaaaacccatggatggtgtgacatggaaatatcaagactagttaattattgagcagagagtctcccaggtctggtatgtagcagcagaaaatgagtgtgtgagaagctctaaagaagatgggactcaccaaatgtcagaccagcctgtctgtgttagagaaagaacccctgttttttcagatttttctcttggccatcctggactacacaagatgttaaaaactttctagtgttttcatgcttcatgtatac

SEQ ID NO: 241846 - DNA, 657 bp, Homo sapiens
agctgtctctttttagaagcatctcatgagactaatgtttttaggaacctgctgtaggaaattcatttattcaaaaaatatttgttgagcatctgttatgtgctagtgactgctccaggtgcttgggatacagcagtgaccacctccaaccaagatcccgctttcaagaacttccattctagcagaagtgatgaactcatttttatggagcacctactgtgtattaggcatgtgagttatcacacattatctgctttacccctcacaacagcctggtgaggtagatggactattttattttattttattttatgacagtgtttcactcttgttacccaggctggagtacggtggcgcaatctcggctcactgcaacctccagcctccaccaggttcaagcgattctcctgcctcggcctctcgagtggctgggattgcaggcatgcgccaccatgcccggctaatttttttgtagtttttagtacaaatggggtttcaccatgttggctaggctagtctcgagctcctgacctcgggtgatctgcctgccttggcctcccaaagtggtgggattacaggtgtgagccactgtcccaggccagatggaccattttaaagattaggtaactgagctctaggggtcaagagacttggcca

SEQ ID NO: 241847 - DNA, 670 bp, Homo sapiens
tgtgctaaagactcattttaaaatcactttcactctgttagaaaaaaagaatatttactttcttctctcaagtacagaatgtagtagagttcagtttcattaacaggttttacttgctatacatttaaaagactgatttcaactgctgatttaacatatttattaaatgcctactaagtgttaggcactactctagaagatgtgactataacagaaaataagacagacaaggagagacaaaactatataaataagccagaataaatgatcacatggtgacaactgctatgctgagaattaaaatgaatgatgtcatcaacagtgactgggtatctagattgtgcggtcagagatggcctctctaaaatgatggcatttaggctgggatctgactagcaaggaggagccagccatacacagagtggtagaagtacactccagtgtcccagtggggccactaatggatgtaagcattaatgcaaacttgatgtgttggagatacagaagacttgtggagctggagcatagtagggtagcagatagacagtacaaagtggtcttagagaggcaaccacaactccatcatgaagagctgggtgtggtggttcacccctacaatcctagcactttgggaagccaaggtgggcggatagctttagtctgggagttc

SEQ ID NO: 241848 - DNA, 614 bp, Homo sapiens
tgtgctaaagactcattttaaaatcactttcactctgttagaaaaaaagaatatttattgctatacatttaaaagactgatttcaactgctgatttaacatatttattaaatgcctactaagtgttaggcactactctagaagatgtgactataacagaaaataagacagacaaggagagacaaaactatataaataagccagaataaatgatcacatggtgacaactgctatgctgagaattaaaatgaatgatgtcatcaacagtgactgggtatctagattgtgcggtcagagatggcctctctaaaatgatggcatttaggctgggatctgactagcaaggaggagccagccatacacagagtggtagaagtacactccagtgtcccagtggggccactaatggatgtaagcattaatgcaaacttgatgtgttggagatacagaagacttgtggagctggagcatagtagggtagcagatagacagtacaaagtggtcttagagaggcaaccacaactccatcatgaagagctgggtgtggtggttcacccctacaatcctagcactttgggaagccaaggtgggcggatagctttagtctgggagttc

SEQ ID NO: 241849 - DNA, 601 bp, Homo sapiens
cggcccgggaggcggaggcgcgggggaggaggccccgcttggctcctcagccccggatgctgcatgacttcatccttccgccggctcccctgctgaggtagggccggtccggcagcaagcccgccgcccgcgccccgccgcagtcccgctcccgccccgcgcccaccccgcgcccgccatgtccgagatcctgccctacagcgaagacaagatgggccgcttcggcgcagaccccgagggctccgacctctccttcagctgccgcctgcaggacaccaactccttcttcgcgggcaaccaggccaagcgaccccccaagctgggccagatcggccgagccaagcgagtggtgatcgaggatgaccggatagacgacgtgctgaaggggatgggggagaagccgccgtccggagtgtagacgcgccggctcgggcggcgggctccgggcccagcctcgcagcggccaggagcgcgggccggcgatgcggctgccggcgcccccccgccccggcccaggcgcccgcgggcgggggctgcagggccgtgccgccgccgccgccaggcactccggagctgtccgcttcagcaccacggcggccgc

SEQ ID NO: 241850 - DNA, 255 bp, Homo sapiens
gagattcatagaatttatatgagtttatgaagaccacaaagctagtaagtgtcagagttgggactaagaatctgtatcttctaactgttagactgtattttttctgtagtatacttcaacaaaagactggataaaaagtgtggatgggtctgcttatccacccaataaaatggaggcaactcaaaggatttcaggacacatgaaatagtgaaaatcatttttgtttgcaaaatggtttgtcatttttgttagaag

SEQ ID NO: 241851 - DNA, 734 bp, Homo sapiens
tagtctatatatatagtaagcggagaactagttttacagtgctcatttcaggtcttcagtaagtgtgtatgatgatgtcagaagtattcattggctcactttcaaatcattgaaaattcagccatgctaaggttggctattacgtgtattagcgtttccaagcgagtggtcttggctggggtgagattgtcagctgtctgttaggattagtcacaacaaacatggtgcaaatggtttccaacaacagcgcacttcaaggttaccttcataattcttttctgccagaacccaaaaaacaatactcttgagctactcagtgttccaattgttaaaaatttcctgaaattttccttcatgtattcaaagtgaaacataaagatctagaaggatggttgtgaaaagtatggactttatagtatctagtgggcattttcattgagcccaaatgataaattctgttttccaagtcttttaagtgaaaaaaaaaaagattttccttgttataatatattcctaaattctagagtattttcactctacttctatttcatttgttccttgtacatacttgactctgaaccaaaatcagtgataatcttagtttgaataataattcagatttaaaaaattgtatataaaatccaatttggtttatgcattttttagcgtttattgttccttttaaattttatatattgtaagagaatacttttattacagtactaatattattc

SEQ ID NO: 241852 - DNA, 460 bp, Homo sapiens
gtccatcagcagatcctgccagttctgctttaaaaataaatccagggatcagctacttctcaccacctccctggtgactctctgaatgtctaaatctgaccatgctgcttctgctcaaatcctttccaggtttttactcaaaggcaatgccagagtccttagaatgaccttcaactttaggtctccaaataccctttcctaaaccccctcccctaggcccaccctagccaggagcaggtgttgccctcgaggccttaccatctgcccttctctctgcctggaactctcttcccatcatccctgtggccttggctccagtggtgcttctcaccaaggtgagtgctgaccacctctgctaccatcactccccccgcccctgtgactccggattctcttaactcttttttttgagatgagtctcactctgtcgccaggctggagtgcagtggcacgatcttgg

SEQ ID NO: 241853 - DNA, 459 bp, Homo sapiens
ttcgaaaggggtaggacgtcttcaaatcttatttctctgcctttttgtattttatctccactttgtcttagctttcagcctaaggacctagaatgacaagataaatttgtggagattcctgtgagatataagtaaaccctactgaacagggcaggagaagcagctagttatattgtatcccgaatgccagaggatgtcactgtattcataggttttcaggatagggacctgctttttttgcattccaagagcaaagatctaagttttaccttagtctactgatgtaacaataagataaacatcaaccgggttgcatttaattgcttatatttgccactttattacatcaaagtgatttttaactatgaaatcagtttagaactgcttttcaatcctccaaagtagttgtgtgatttcccttatggtcaagattttgttaaaaacagggatccaagaaat

SEQ ID NO: 241854 - DNA, 335 bp, Homo sapiens
agcccagatggtttcactggcaaattctttgaaagaagatacaacactaattctaaataatcttttccaagaaacagaagcagaacaatatcttccaactcattttaagaggccagaattaccctaatacaaaagtaaaacatcatcacaataaagtaaaactatagtccaatcttttttatacacatagatgcaaaaatcttgcacagaatactagaatatcaagtccagcaatacttaaaaaggctacacattacaattaagtgggactgatctcaggaatgcaagtctggtttagtaggtaaatatcaatcactgaaatgtatattagcaga

SEQ ID NO: 241855 - DNA, 320 bp, Homo sapiens
tacaggggatataaaccagatgtgttgtctccatagattcccttctctatcaaggaattattgaatcttagatttggaaagcaccttaggtcattcagatcagtgtcttagctttaaaatcttttttctcttattcttttataaggttttcctatttatcaggcctgaagtatgccttttttgtttccccacagttcttagttttgttctttaaacaaatagaaagaggtttaaccttttctatcttcagattttttttttcctgaagtcacctattctttgtgtgaaacaagtcttgtttcggttgttagcctaagaat

SEQ ID NO: 241856 - DNA, 399 bp, Homo sapiens
tggctgtgtccttccaggaacacagctcccaaagagaggcccatctgcatggccccagctctcactgttctttgctaacacaacttccattcgtgcctctttaggcttggaagtggcaaagcctgtccactcttgctagtctctgagtgcctcatatccctgatttttcccttttgctctatccacaactcaggaagtaatttcttcattagagtcccctgtaccacatggactggattcaactttctgctattttcagtattaaattagttaatatttgtagaatgcttacaatagtgcctgacacataataagcatgctttatgtttgttaaatcaataaaaataaacaccgatgcggcagcctcccatctaatcggccaccactccaatcacatat

SEQ ID NO: 241857 - DNA, 546 bp, Homo sapiens
agattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaa

SEQ ID NO: 241858 - DNA, 351 bp, Homo sapiens
catgcttcgtttgtcagagccaggatggtaacacgggacactactgttgaccaaactacaggctttatttgggttttaccagtttttccacccacctcccttttccgctccatgtaaacgtgtctgtggtgaagatgcggggctcggtctgatttccaaagctgcttttgcccctgtggcctgaagtccaacgattccagctttttattccaatatctggttatttaaaacatatttaatgttctctacatataaagcttattcagaaaagatttaatgtgaattatactgaattatatgctttcctttttgaatgatcatataacttagtgcttaattaccacatctggc

SEQ ID NO: 241859 - DNA, 777 bp, Homo sapiens
cctggccagcgctgctggcgggcgttagggtatttctggaaaactcaaactgtttttcctctactctgataccacaagaatcatcagcacagaggaagacttctgtgatcaaatgtggtgggagagggaggttttcaccagcacatgagcagtcagttctgccgcagactcggcgggtgtccttcggttcagttccaacaccgcctgcctggagagaggtcagaccacagggtgagggctcagtccccaagacataaacacccaagacataaacacccaacaggtccaccccgcctgctgcccaggcagagccgattcaccaagacgggaattaggatagagaaagacggccaccatgctgccactgggctcagagcccgccctgaatgagctgctgcttcgcaaggaggaggagtggagggcgctgcaggcacaccgcacccagctgcaggaggcggctctgcaggacacacggagccagctggaggaggcgcaggggaaactgcggtgcctgcaggaggactttgtctacaaccttcaggtgctggaggagcgggacctcgagctggagcgctatgacgccgccttcgcccaggccagggagtgggaagaggccaggcgggcagaggtgagcgagctcaagatagaggcagctaagctgaggcaggcgctagccagagaggccaggaaggtggaggagctgcagcagcagcagcagctggcattccaggagcatcgcctggagctggagcgcgtccacaggtgagccaccgaccg

SEQ ID NO: 241860 - DNA, 646 bp, Homo sapiens
agtagagacaggtttttgccatgttggccaggctggtcttgaactcctgacctcaggtgatccgcctgcctcggcctcccaaagggctgggattacaggtgtgagccaccgtgcccggccgtggtaactgttgatagggaatgtgaggtaggtactgtggtaggaaaattagggcccctcacggtgcaccctgaacctgatttctctttactgcagcggccaccatgctgccactgggctcagagcccgccctgaatgagctgctgcttcgcaaggaggaggagtggagggcgctgcaggcacaccgcacccagctgcaggaggcggctctgcaggacacacggagccagctggaggaggcgcaggggaaactgcggtgcctgcaggaggactttgtctacaaccttcaggtgctggaggagcgggacctcgagctggagcgctatgacgccgccttcgcccaggccagggagtgggaagaggccaggcgggcagaggtgagcgagctcaagatagaggcagctaagctgaggcaggcgctagccagagaggccaggaaggtggaggagctgcagcagcagcagcagctggcattccaggagcatcgcctggagctggagcgcgtccacaggtgagccaccgaccg

SEQ ID NO: 241861 - DNA, 468 bp, Homo sapiens
caggatgatcccaaggagcagaaggggccagtgatggctgccatggggggcctcactgaaccagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcggtgagtaagccaccattgtgctcatggggaaaatgaggaccacagagagccactggttagcctaaagtcaaacggtaagccaggctgaggactgtgatgttcccatcagattaggctcctgcctttcagtgtgatccttgaaaagtgttatctttttaggcatctctccctggatacagaacaaagtaaacaaagtggattagggggttgaggataagccgtggagtgaagggactctggctcctacca

SEQ ID NO: 241862 - DNA, 497 bp, Homo sapiens
ttttttttttgagacagagtcttgctctattgcccaggctggagtgcagtggcaccatctcagctcactgcaatttccacctcctgggttcaagctagtctcctgcctcagcctcctgagtagcttagattacaggtgcacgccaccatgcccggctaacttttttatttttagtagaggtggggtttcaccatgttggtcaggcttgtctctaactcctgacctcgtgatctgcccacctcggcctcccaaagcgttggaattgcaggtgtgagccaacccgcccagccccctttcactgttttaatagcgtccttggaagaacaaaaagtttttcactttaatgaaatccatttcatctattttttctttgtcatttatgtaattggtgtcatagctaagaaaccattgactaaccctaggtcatgaatatttactcctgtgttttcttattagattgttatgcttttagctcttacttttagatctatgattca

SEQ ID NO: 241863 - DNA, 533 bp, Homo sapiens
aaaattaattaaccaaaagctggttctttgagaagctcaagaaaattctctttagactgatcaggagaaaagatagattaccaatgtcagaaattaggtagcttcactacagattctacagatattacaacaataataagagactattacgaataacttctaggaatacatttgacaatttagatgaacccatgcagattccttaaaagatacaaattagtttacttaggaagaagtggaaaacctacatagctctatgaaagatgtgttatcacaaagaaaacggtagacataggtagctttagtggtaaatgttgccacgtatttaagggaataatactaattctgcacaacctctcacaagaaatataagaggaaagaatactcagttctgtctctgaggccagcattgctttgatccccaaatcagacactgcaagaaaagaagacaattatccctcatgaacatcaacacaagaattcttagagttttatcaagtccaacaagttaaataaaaaggattacactttta

SEQ ID NO: 241864 - DNA, 456 bp, Homo sapiens
ttcttgttacacacgtagatttttcctccctggaatgaatcatgttaatgttcatctcctccatgcctgctaaactgtggacactgggctactccagagagaaacggagccagcttctgtcttccctgctagagcttgtgctccggaaggagtcactcatcaaaaccaattgatgaaatgattattgaataactattatgtaacatgcctccaagaagacatacagaatgcagcaagcatgtgaaataggaagctttcgtagcctggatttcagggagcgagctcagatctcaaagagtcacagtaacgatgagagatgaggggaaagactactcccagttgaagcaaacagcctgggcaaaggcactggggcagggagggctatgcccatgcacagatttggaaactcctcctctttttttcatgaataaattatgacatattttctcatcaaca

SEQ ID NO: 241865 - DNA, 173 bp, Homo sapiens
gctggacaaggaagacaaatgctccaagtgtggtctctgggctctaagttccctctagacaattgcgtcctttatttaatcacttctccccacaatatctgttggatcatacattatgccagttaatacgcaaggactttgggactcagtattgaataaaaatgataataacc

SEQ ID NO: 241866 - DNA, 408 bp, Homo sapiens
atttcaataaagcaatgaggcagaagtcagattgcagtggattgaggattgaaaggtgaggaagtagaaggaacaagtgtagataactctttgtgaggtcctaaattgatagtctttttattaggcactacatataagtttcagaattccaaaagacagatttcaggcaaagaagttttccaataaaacccctgtatcagtcagggaccaatcaggcaaatagaaaccattctaagtatttaaaatagagggaatttaacctttgtgagaattggaatggtgcctcatatgagtcgatgcagctgtgcaggtgcctggcttgttcgttagagagcaggcagagagggttcagctatttcttgccttttggtttggtgcctttgtgcaggatacaacctccatatctgt

SEQ ID NO: 241867 - DNA, 512 bp, Homo sapiens
aggtacttagcaaaattctcagtaaacattggttataatccctccaacattcagacttaagttctgcctattctctttcctcagtattctttattcctgtccatataaccattgtccttttgtaggccttcactaccttaatgtggactatagcaatagtcacttgattggtctcttggcttgttcccctccaatcttgttctctacactactgcaagggtgatctgtctaccacatagattttgaattatcatctacagtagtaaaacagttttcatggcatacaagcttcaataatttagtctagatattccgcttgatctcttttcacctcttttccatttatcttctagcaccactgcagtgcttgtagttccttaaatatgctattctttttgaaaaagcagcaaatctctgtgcagttgcctttctaactggaatatcttcccccttcttgtgttctcacaaaattcttattcatctttcaagttcaagctcaacacccactacct

SEQ ID NO: 241868 - DNA, 425 bp, Homo sapiens
cctaggattgctaagaatcaaatctgaattatgtaacagttctccgtaagcttccagactactaaaataacccttcattatttaggtttgaatgaactgccttgcaagttaaatatggttaaaaaaaacccaaaccatatattgtaattaatgaaagtttaaattataacaaaaaattacatattagtagctgcctattttgtgggaaattcctaacctcttcccttttttttttttttttttgacatggagctccttagacgtggctggctatgtgggtaagacgaagtgagccctcctcatgtggttgtggtagtagatccctgatggattcagtcttgtgggtgaagattaagtgaagggaaaggaaaggagcaggcagctggaactgtctgtgtccatatccgtcctgttctaatattaaa

SEQ ID NO: 241869 - DNA, 368 bp, Homo sapiens
taagacagtctcactctgaagcccaggatggagtgcagtcacacgatctcggctcactgcaatctccaccttccaggttccagcgattcccctgcctcagcctcccaagtagctaggattacaggtgtgtgccaccacacacagctaatttttgtatttttagtagagacggggtttcgccatgttggctggtcttgaactcctgacctcaggtgatctgcccgccttggcctcccaaagtgctgagattagaggtgtgagccaccatgagcggccacatttattgaacatttctattttttctcttttgaactattcatccatgttctttaatcattttgtactgagttggtctttaatttgtaaaa

SEQ ID NO: 241870 - DNA, 682 bp, Homo sapiens
atagaagaatcccatttctcatgagaaaatcaatggataaaattcagtgtttcttcaaaaccaaaacttcctttatcaaaacctgtagaacacaggtttcagcaaacttcgtaaaatattcagatcaaatttgggtttgttattgattttcaggaggattaatctctttatattaaaagctcatttggtcacacacaaaaaagaacatctgtttagtttttttctaggattatggcataatattaataatataatccatatcctttattgtgtgcctattatagccagaaagtttgcaaatatttaactggagaaacagattagttgaatgtgaattcaaattccaatgctgttgtttattactggcatagaaattattaagttttgtgagcatagatttccttctctgtaaaaagaggatgatagtatcttctctttaaaattattttgtggttaactggtacaagccatgtaacatcacattatatataatgtgtgatatgtataatgtgaatatcttatgatatatgtatatatatattatgtgtgtaaaatatctgccaggtacctgccctccaagagttttgaaatttggctaaggtcaccaactgggttgctgggactcaaacccagttcattcagattcaaaatccacaccctttctaatctaccttactgccat

SEQ ID NO: 241871 - DNA, 500 bp, Homo sapiens
gcttccaggctctaagtttcatctcactctgcagagctctttcttatttttgccacctatgtggcaattatgtacagtgatgtcagacctgagtttgaaccgtgattctgtcctccactgtagctgtgttactacaagtaatttatttatacggtcaggtttcctctctgtaagatgggaaaaagaccatctaggccaaagcaggcggatcgcctgaggtcaggagttcaacactagcctggccaagatggtgaaacccatctctattaaaaatacaaaaaaattagccaggggtagtggcacatgcctgtagtcccagctactcaggaggccgaggcaggagaatcacttgaaccaaggaggcggaggttgcagtgagccaagatcatgctattgcaccccaactagtttggtggctatggaaacgaagaaagaattggatgcagaattgttgcctaacctgggtgacaagagcaaaactccatctcaaaaaaaaaaga

SEQ ID NO: 241872 - DNA, 593 bp, Homo sapiens
cttgaacctgggaggtggaggttgcagtgagctgagatcgtgccagtgcactctagcctgggcaacagagcagactctgtctcaaaataataataataataatatttaattaatttaaaaataaaaaccaaaagagaagatctgatggacttaaaagtcatatatctcaggtgataggtgaaaccacaagtttgccttgaaaagtgtgttgataacaatagccatagctaacaagtacttgctgtgttccaaagctctttctgttagcacttcatttgtattaatatcattcttccaccaactttgtaagggtactgttattatcctcagtttttacagataaggaaagcaaaagacagccaggcaccatggctcatgcctgtaatccaaaactttgggaggctgaggtgggaggatcacttgagcccagtagttcaagacctgcctgggcaacatagcaacaccctgtgcttacaaaaaaaaagaaattaaaaactagccaggcatggtggtgcctgccagtagtcccagctatttgggagactgaagcaggaggatctcttgaggctaggtgttggaggctgcagtgagct

SEQ ID NO: 241873 - DNA, 296 bp, Homo sapiens
tacatatattaaaaaaaaaaacacagctggcttgaagaggccccaaatttggggtaatttgagcatcaaatgtagtaatgataataatggatcatgatacaattaagaaaaaaaaacaaatttatgggtgtacagtgatactgggaaggaggatttttcattacagaaaaacaccagctaataaatacggaagacattatcaaaataaatcacccttttgcacccctaaagtaatatctgattcaagcaaggataatcatgtaaagcctttgtatgaaaggtggttggagaaaatg

SEQ ID NO: 241874 - DNA, 343 bp, Homo sapiens
aggtagggcttgtaggggccaagggtgggggctgtatttggcttgttgactccctcgtggcctgagtgccagacctactcattccgcctcgtgcccccagggggcttggcgggctgcttgtgggccttactctcctagagctgttcgcctcttacctggcactgtcaggtgcttgcttcccctgcccctgggtggggatgggtgcagggttgctgcttgcccagggccttagctagaggaccctcctctgccccagccccaggtgtggctgtgagtcagatggacccagacccctgtaccgaaccagactgggtgctctcctctgggggcagagggagtggtg

SEQ ID NO: 241875 - DNA, 596 bp, Homo sapiens
gccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacttaaaaaaaaaaaaaaaaaaaaa

SEQ ID NO: 241876 - DNA, 755 bp, Homo sapiens
gccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacttaaaaaaaaaaaaaaaaaaaaaaaaaaaaaaaaaaaaaaaccggagggacacaaaggcgggggggggaaaaacgggcacggaagggggcggggccaagcgggtcccggcccacgatctggtcacaggggcgaacccggggggccccaaaaggggccgaaaaaccggaaaccggtaccgaaa

SEQ ID NO: 241877 - DNA, 504 bp, Homo sapiens
tcagaaatctaaactttgtttttaacacatgcgtaaatgataagaggactaaatactgtcaaggtccatttcaaatcttgcaactactttccataaacatctcacaaaccagaatttctcactgaagtcgtactacccgctctgggcttcctgcaggctttgagccagtgcatccaaggcctggtagaagagttaagcagactcctgcaggagaaattgtccctgtgttctggatggtgcagcagtacagaaatcactgccatcatgatggcaaggagcttcaattgacgaattccacttcgtgcttaccatgtgctgtccacctggtatgaggtgccatgggaatgcacagatgacacttctggttttttcgggagctcacagatgtgtggacatagataaagtgggttgggacaccccggaccatgggctaagacctaagacagaccttgaaagatgctaacatagaggtgtaagcactaaaaaagcatggtagttgagtgc

SEQ ID NO: 241878 - DNA, 346 bp, Homo sapiens
catccagccctcttcccagcttcctttctccttccagcttcctccttcctgtattccctcaacatctgttcttccctaaaaccttcaagcccttggtcctcccttcctctcatgtctattaggcccatcttggcttttctagatgcacattagaatcatctctctcaccccaaactgctaaacacagatgttcggaggctggggagcaggcagcagtattgaaacctccccagtgatcttgatgcacagtcacgattgagaacactgcttacaaggagcctggacctttgggggatcccctcagtctctctagccctctcttctacttctcccttgctctcttctc

SEQ ID NO: 241879 - DNA, 556 bp, Homo sapiens
gaaatgagtcccagattcccaatgcagtattgattttattacttcagctagtatccaaattgagctccattttgtttttgttaggggttgaggagggggagagagaggcagagacagaagaaggaggagaggaggaaaagaagaaacaggtagaatgaatgtcaatagataagtagagataaataaatagtacttaaaattatttggaatattagaataattcttaaaatcctcagtatatcaggcataagatagtaaatttcagtaatctgagatggcctccttgatgagcataggcagctgaactgggctaatctacattatgctcatacatttgactaacttttctgttactcagacctacaataatttattttgttgcattagtacacaagccacataatgactgtaaaagctagaaaaatgattgtctatgaagtataaatattaattattttatattaagaatgtatctagttgctgggatgacattagttgatttgtacacatcacctctgatgttctcaacattcacatgatgtgcaatatggatact

SEQ ID NO: 241880 - DNA, 473 bp, Homo sapiens
ttttgtgtcaggctccagtgtgactcagcacagtgttcacagcccatgctctcaagaatctcagcttaggaggaggcaaagagccgctctacagtaaggtaaataagtcatttagtcaggaactctgcacatttacctctgcatttatcaaatatttgttgaaggaaataataaaagaagtgaggaggaagaagaggtttcctgggagaaagcactcgaggagcaataggtgtcctctttcatttccactaaatatgctgctcaatgccttgtggcataacagaatcaaaacttttcagatgccctgccgctttaacaagacccaggatatgtcaaaatggctcccacagaactttcatttgatcttatctttcgctgtcacacacatcgacctgcattttcttttttctttttgattctttatgtctgcaaatgaactgatgtaattaaaaaggtgaagaaataaatctatc

SEQ ID NO: 241881 - DNA, 751 bp, Homo sapiens
aagaatagatagcctcaaagatgtcatgcttgggattgctttaaaataatagagtgggtggtaaaataggttagggaggttgaatgtggataatagttgaagacttgattggtacatggaagctcattattggctgtacctttgtgtatgtttaaaatttttcatgataaaaactttaagtcatactcaggtaatctgaacttcattttgtgaagtattttaactttatctttcacttagtctttactagagttatttttgtggtaagtagctactaaggctgtaaaccagcaaattagaaagggaattattctccttaggacttctgtaatacaagttattttaaaaatgccttttcctctggcaaataattgttgccctcaattaacaaagtacattaaagaatttttttgaaaactaagtataaagaagaaaaaacacattaataataccatcacccgagataacagcaaaataataaaaatggctatttctttccagttgtttaatgcatatacttaatataagtaatcttgtataggtttctttaccctgaagtgaatatcctgtatgtaaatctgaatgactttgaaagatgttttactatgtgttaaagacaaatttcaaataatgaaaaagccaacaaaatttctactgagctgtttatatgaaaaccttcatgctgatggtattggttaataatagctagtatttgctgaacacatgctgtgtgccagcaaacctcacaata

SEQ ID NO: 241882 - DNA, 477 bp, Homo sapiens
gaattgagcacagagattatttaatctagttttatatgctagagatgtaagaataagcagtgaaataaccattgttccttgccctttgttctttcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgaggtaagttgtatcagtagatttgggggtaataagaaatttttaggcccttagaagatgctacgaaatgctgtgtgggagaattaaaatcatgccctttgcacgagtgtctaaatgcatgcatcattttgccttctttcttaagcttgaggttttgataacttaattataaaaatgtagtcctattcgctgctccatgattgtttataagcacgtgtcaatcttcagttccttg

SEQ ID NO: 241883 - DNA, 659 bp, Homo sapiens
  misc_feature (549)..(549): n is a, c, g, or t
  misc_feature (592)..(592): n is a, c, g, or t
  misc_feature (597)..(597): n is a, c, g, or t
  misc_feature (652)..(652): n is a, c, g, or t
aagaaacagtggtcagcccaggaattgattaaaacgtatttggataatttaataaactgactagaaaaaattatgtatataaatatttgtataatatttaatgattaatacatgatgatgatgatgataagccaaaactcccaaagtatgcattcaaacacttaagagtacctgctagaaatataatctctgtcttccaaaccagtacaattaaaataagaaagtaaaactatcaaaccaaaataatacaggcagaaggaagatggaagtaacaaagaaaaagctggtgacagcaaacaaaataaggtgcatgaatgaatccagcagctttatcagtaatcaccaaaaatgtaagcagattaaactcacctattaaaagacagattatattggataagtaaataaaattcagcaatattcagcttacaaggtacatgtagaataatactacacagagtttgaaaataaagagatttaagaagacttagtagacaaatactgtacttacccaaaaggttaatataaaccaaaatttttaaaaaacaaaanaatccaatttatttggtggaaaaggatgaagggaaaccacctngccanttaaataaaggggttaaggaaaaaacaaaccctttaacctttaggaaagggaaancttaaac

SEQ ID NO: 241884 - DNA, 714 bp, Homo sapiens
cccagctactcggaagcctgaggcacgagaatcgcttgaaccagggaggtggagggaggttgcagtgagccaagattgcaccactgtactccagcctgggcgacagagagagactgtctcaaaaacaaaacaaaacaaaaaagaacaacacactcaacaatggcatatccattttatagaatgagcaactgttaacagttatccttcttgtcagcagaagcaccagagggttaagaaaaaagtttcagatgccttctctgcccaccaggagtttgacattcttgttctctaagggcagcattggtgttgtggaaagagccccgagagtcagcaaactcgagttttattctttgcagtgctactaaatacctctgtgactttacacttgtcatttaccttctttgggctgttggtttcctgtttgaaaaagaaaaaattggggccaagtgtggtggcgcatgcctataatcccagcactttgggaggctgaggcaggcagatcacttgagcccctgaatttgagaccagcctgggcaatgtcatgagacctcgtctctacagaaaatacagaaaataaccaggtgtggccaggcgcaatgactcacgcctataattccagcactttgggaggctgagtcaggcagatcacttgaggtcaggagtttgagaccagactggtcaaaatgatgaaactccgtctctactaaatataca

SEQ ID NO: 241885 - DNA, 507 bp, Homo sapiens
cctaaacataaatcaatttaagcatcataaaataatatataattgtatgtgtacagtctttgggtaggaatgatcttcctaagaacaaagagcaaaagcagaatccacacaggaaaattttgtccaatttgcttatttataaattaaaattttctcaacacaagagacactaatgaatagtaaaacaaataccacactcagagaaaaatagttcaacagaacaaaagggaaattttattaaaagaatatacaaatgaccaataatgaaaatatgttaaatgtcacaagtaaatgccatgtaaaataatgagttatcactgttcacagatcagattggcaaaatatttaaaatgatcaagaatatgcattgatggtccaggagtaagacagcacactgatctcttaatgcaggttttcttgggaaaactgttttagaggaaaggttcgtagaatcagtgaaattttacttctaggattccattcaaaaaaaaaaagttggcaatgaat

SEQ ID NO: 241886 - DNA, 369 bp, Homo sapiens
ctaccctaagggttgagggttgatcagaaagagatatgaggaagttatctgggaagttatctgggaagagagaattgttttatatcataataaagatgtggcttactctggtgtactcatttgtcaaaattgtaaagctaatatgtaggcatttcaaggtatgttatatatgtagtgatagatataggtatatagtgataaatgagagatacaggtgaaaaaagaatgacaaaaataatgatagccattgcagttgtataatgtaggacatgaggattctttatactgttttgtttactttgtacatatttgaaattttcataataaacagtttttcataataaagagcttttaaaagccaaagtactt

SEQ ID NO: 241887 - DNA, 1318 bp, Homo sapiens
tgacccggaaacggattatccggagccaaggtccgctcgggtgagtgccctccgctttttgtggccaaacccagccacgcagtcccctccctgcggcgtcctccacacccggggtctgctggtctccgcggatgtcacaggctcggcaaccgccctcctgtcggcggggagtcccgcgacgcccggaaatgctccgaagcctgtcgctcagctgccagatctgcgtctgtgtccggttccgtcactgaggtcgcccctgtccggcccttcctccctagttctcttcaccgtccgcccatcctgtcgcgcgccgcgtcaggtccccattcggcatgtggcttgtcttccatcgtccccaccctcgcccctcttggcccctcagggcagccctgggattcggcagacgccagtcctccctgagatgcttccccgtccttccctccgccaggccctacgtctccgcaaaccccacgcttcggggtggccgcctcagacaggaccctgagtccgagactggggtaggggacctgcccgatcctgtaacaaccctcgtgcttctgcacaatcgcctcccactagcggtgactgttgggtgtctaccttcccggtgtcccactgagaagcgggctcttccttggcaggggcttcttcattgcctcgctgtggatgtcgaggtggggcaggagagtgaggagaaaacagagaggagggaggtagagccaacgagcgagaaaaggggagggaagtttagatgggaagtggatgggtctgaggaatttgaacaaacaccgacagtgaaggagagtgacctgagcaagcagtagtggggtaaatggaaatagacaaaatgggaatcagcagagatatggaggacagaatacaatgaggaggccttgaccgtcagtagcagagagggcagcagaagcctaattcccaaattccttagatggttttctgatttccaaattagtttcccttttaaatttattgtgtcaggttcagcttatgaggcctcaatacttttcagtcttaattgtatattgaaaatactttttgtttactaaatgctttttacattaattcagtgtgcacttcgtaaggataatgatgatttgagttagtttagtattcaacagcttcctctattcctttatatgatctctgtatttaatagctgtggcataaagtttccaactaagtataagtatcaagttttctttgtgatgttttctgcaaatattgaaggatgacctggattgtcctagaactttgttccaacagattacatgtgttcataacgaataaattgctcaaagat

SEQ ID NO: 241888 - DNA, 546 bp, Homo sapiens
atgaaaatgactctgtaatatcttgacaacatttcagtttattagggataatataccaggaagatctttgatgattaaaaactgtgattatctaagggtaaatatattatcaaagagtcgttatactgtggcattacataatgttataaatattttgtacgtttttaatagtgattaaatgagattaggtatttaaagcactttgctgctgcagccagtatggaaaacaatatgcaagttcttcaaaaaattaagaataaaactactatatgatccagcaatcctacttctgggcatttattcaaagaaaacaaaatcagtatttcaaagacaattctgtactcccatgttcattgcagcagtattcgcaatagccaagatacagaaacaacctaagtgttattcagaaaatgaatgggatagggctgggcatagcagctcatgcctataatcccagtgctttaggaggctgagctgggaggattgtttgagcccaggagtttaagaccagcctggggcaatatagaaagaccctgtctctgcaaa

SEQ ID NO: 241889 - DNA, 472 bp, Homo sapiens
aagcttgaaaacatcacagttagactgtgtcattttctggtctttaggtggagccactgctattgcaggtttcctaaacctaaacctatttatagagaaattcctcttcagtcattttataaccaaagcctcttgtaagtatttaacattacattttagctctagtgaatttcaactatataggaaagaccctgagagaactaccattataaaatatgtagcccattcatacatattttaacattcacaatactacttattagaatttgaatttatttctcagacttttctgagaggttagaagggccctgttgtgtttaacccaaagaccagttcaaaaactagggaaggagctgtttaagaggaaggaatgactaacgtctgaaggtcagaggactaaaatcctggtgattgaacaagttgctttttatgggttttccctctaaaaaaacaaaacaagccgggcaaaaaa

SEQ ID NO: 241890 - DNA, 367 bp, Homo sapiens
atagattcaatgtagtcttaatcaaaattccagcaagttattttttgatattattaaactaattctaaagtttatatggggaagcaaaaaactgagaatagccaacacaatattgaaggagaacaaagtgggaggactgacattgcctgacctcaagacttatcataatgctacagtaatcaagacagcatggtattagtgaaataattgacaaatagatcaatggaacacaatagagagcctagaaatagacttacgtaaatatagtcaactgatatttggcacaggatcaaaggcaatataatggaacaaagacagacttttcaacaaataatgctggaactattgggcatccacatacaaaaac

SEQ ID NO: 241891 - DNA, 133 bp, Homo sapiens
aatactcatactttatggtttagtgatatccctctatattcatttatttagttttcaaaacaattctgtaagtagcttttatgaagttgccagtgataacagaacacttgaagacttgtctaagatttaatag

SEQ ID NO: 241892 - DNA, 395 bp, Homo sapiens
ctctaatcttgatcctccaacctttttactgtgtctcacccccttaatgttctctcttcttccttagccagcttaatgtctgtgggcaatcattataattattcccatcaggctgggtatggtggctcatgcctgtaatcccagcacttcaggaggctgaggcgggcagatcacctgaggtcaggagttcaaaaccagcctggccaacatggtgaaacctcgcctctactaaaaatacaaaaattagccaggcacggcggcagatgcctgtaatcccagctactctggaggctgagataggtgaatcgcttgaacctgggaggcggaggttgcagggagccgagatctcaccattgcactccagcctgtgagacaagagtgaaactctatttcag

SEQ ID NO: 241893 - DNA, 426 bp, Homo sapiens
ctgagctcaagagatcctcctgcatcagcctcccgaagtgctgggattataggtatgagccaccaccctgacctccaaataccttttgaactcaggcttggatttgaactctggttctatcaactattagctgtgatttcagatcagtgacttgagcaatttgtgccttgtttcattaagtggagatgacaatagcacctgccttgcaagaattatttgatgtggccgatgagaaaaatcagaattatgaaaagtgcttcacaccattcctggcatgtgaagagccctctctaaatggccattatgctaattagcaccttaaagggaaatcattttcatgaaattttatttgaatctggctagagaaaatgctcaccttcttccttgtgttttgcttatttgattaaatgtctttgatttctgtga

SEQ ID NO: 241894 - DNA, 2261 bp, Homo sapiens
gccagctgtgtgcggatggggcggggctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggcttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccagggtgaattggaagtcctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggacgctgggcctttgctgacgcagaacgcgggaaggaccctgggcctttgctgacataccagccccagactacttaaattcagctttttttttaatgtgagaaaataaatgcacccctctctggttt

SEQ ID NO: 241895 - DNA, 962 bp, Homo sapiens
gccagctgtgtgcggatggggcggggctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtgagagtttttagccagccagggaattagggtagcttgaggtgaatgaaggcctgtaactcttctctttcattggaagagccatttgggaaaagcaaggctagaattccccgtagaatgttttggtttgcacgtgtccgttgtctggtttgcagaggaagtgggacacttctgctttgtacctgcaaggatttctttctgtgcttttcagggggagccaccacctttgagcaggggataatagtttcatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacaaaataatgtggcctctagagaggggatccgccttgttcacgaagcctctggttttgcagttacctttccgggccaggcattgattcatgaagagggtgaggtgttccagacagacagactcggagtctaagtggttcggctcctggagtgtgaactgggtaaggcttggctg

SEQ ID NO: 241896 - DNA, 772 bp, Homo sapiens
gccagctgtgtgcggatggggcggggctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggcttcagggcaggcagctgtgcatgttctctcaactaaaggtcttgtgagagggaaaataaaaaaaatctcacttttcctataaaataaaaacactcggggggggcccgtacccaatttgccttttgtgagcggttttcaattaattgcgcgccgcttccaacc

SEQ ID NO: 241897 - DNA, 730 bp, Homo sapiens
gccagctgtgtgcggatggggcggggctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggaatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggcttcagggcaggcagctgtgcatgttctctcaactaaaggtcttgtgagagggaaaataaaaaaaatctcacttttcctataaaataaaaacactcggggggggcccgtacccaatttgccttttgtgagcggttttcaattaattgcgcgccgcttccaacc

SEQ ID NO: 241898 - DNA, 673 bp, Homo sapiens
aatttttttggggcaaggaatttgaatagatattctctaaagaaaatatacaaacagatagtaagcacatgaaaaatttcaaagccacaaagacataatgcttcacgttcactaggatggctataatcaaaatatactgctggcagaaatataaaatggtatagctacgttggaaaatgggttctgcggtgtctcaaattatgacaagcaattcatactcctaggtatatacccatgaaaaatgaaaacgtatgtccacataaaaatttaaacatgaatgttcacagcaacatttgtaagcagccagaaagtagaaacaactaatgaatgagtaaataaaatgtggtatattaatataatgaaatataatttggcaacaaaaaggaaaaagtactgaaacctgctataacacagataatccttgaaaacattacactaaatgaaagaagtcacccacaaagagctacgtattatatgattccatttatataaaatgtccacaataaacaaatccatagaaaaaatgtggactataggtagcctagggttgggagatttggggtgatatgtggagtgactgctaatgtatacagagttccttctgggggtgatagttatacaactgtgaataaactaaaaaccactgagttgtacactccataaggttgttatt

SEQ ID NO: 241899 - DNA, 385 bp, Homo sapiens
ttgctgaaactactggaatcagcttagttcatgtgttgaactgaccgaaacatgacttattcatgttattatttataaattggattacagttttctatttaaagatttttatttttatatttataaatattagaagtaatatctcttaacacaaaactttaaaaagtgaattttaatacccaaggaaaaaaactgtatgccattaattctccgactttactaaagaaattggatgtgtattttaggactatttgaacataataactcattatagaaaattttagaattaaaatgtctttcagtgtattgcaagttttgatagttttgtattgttttgcctatttttacaataaactgaatattgttaagtgttcactttgatgag

SEQ ID NO: 241900 - DNA, 399 bp, Homo sapiens
atcaagtggtaagcccgtccgaagactgcagtccttcagatcactaggatgctgctaattgagtaggacacagcagcttacagtaaatattactttctggctactttcttatgatagttgaaattacatctaatttatcaagaaagtgaatgcttatttgatttggctatgaaattatgctgctcagttttaagatgtcttcatgaacccagtctcagtgaagatgtttctgtattttagggtttgtttgggttttttggcctcatcctcccacgaatgtttaaaattagcttggcattttaaatctgtgcttttatgttaggtcttagataattataaaatagaagaaaaattaagagcaaaactgtataatttatttagacaaccagttttgtagag

SEQ ID NO: 241901 - DNA, 589 bp, Homo sapiens
gttggctataaggaaggatgaatcaatggttgaataaatgggggatggatggatgattggatggatagttggatgcatagagggtgatagaggtggatggatggatagaccgatggatggatgggggtggttggatggaagatggatagatggagggtagatagatggagggtgaatggataaatggatggatagatggatagatgaatggatggatggtgatgaatggatatgaatgggatactcattctctttgattcagttaaaaggctgagaagtggtgtaatgggatgtgcagtagactaagaagaggggacacaggttccaggccaaacttttgtggttactttactgtgtgccctaaggcaagttatttaagttgtctgacgatcccttttcttagtgtaaaacaacggacttagataagatgatttatatgacatcctataagattttagtcttgtaattctatgaccccatggagtagaaagtagagcaatatatttatttttaacttatctttaaaaatagatagaggtatatgtaaatttagtttttttttttctagagaccaaagcagagaaacaca

SEQ ID NO: 241902 - DNA, 312 bp, Homo sapiens
tcatgcttccagcacagaataaaaagtaaccattttgaaatatgtcagaaatgtctgttcttgaaaaggcctgcccacaggagaaactatcttcccagtgcctaaccaacctgagggaaggcaaattcctatttccagccccttctagcaatcctgtctcatgtaagtggggagaaaactgagaagcactggtaaagtccacggtccaaaggcacaggctcaccaagacctaatcataaaactatagagcacttgccttccctctgccccttactactacatcactacatgtctcattaccagacttcctta

SEQ ID NO: 241903 - DNA, 740 bp, Homo sapiens
gttacagctcacattttttcagtgtttagtgttagaagtgtttggggtctctagaagtttggtgatgtttttgtgaccagaaatatgccatagaaactttcccacttgtttacatcaattggcctatggtaaagttggttttaaagtcaaagtttctcttattgtgtaacttgccattgacatctactcatgttacttaaataagcgttttgtttgtttgtttgttttttgtttttttgagatggagccttgctctgtcacccaggccggagtacagtgccctgatctcggctcactgcaacctccgcctcccaagttcaaacgattctcctgcctcagcctcccagttagccgggattacaggcacatgccaccacacctggctaatttttgtatttttagtagaggcagggtttcaccatgttggccaggctggtcttgaactccagacttgaggtgttctacccgcctcggcctcctgaagtgctgggattacaggcatgagccactgcgtccagccaaataatgagtattaattggctgaatagcaagtattctctgaaaacattatttaataatacaaaacttttaaatattttagcaataactgtgttttcagatttgcactcagaaaactagtatgacttttaatattgtatcccagcttttctccttttaaaaaacagaaaaccctaacttctgtaacttgactgagattaagcgtatctgataccattgtt

SEQ ID NO: 241904 - DNA, 453 bp, Homo sapiens
gctacagaattttagaatggaaaacatcgtcttgctgagctgagctggacacttggttgtcaattctgaagaatctgtaaggcaggacattctaatagcttcatttttgttttttttttttttttttttttagctgcagttaccatcctcaaatacaaaagtaattgatactcagcaatgaaagctgcatgtgcatgtaggggagagaaggaggtttcaccagactgacaaatggagtcatggttctgggaaggagcaggtaaggaggaatttgacatttaccctaagatcttatgcagtctggactgtgatgttcttgtggagggcacgttggcttgtgaaacaagtgccatgaggccctcaagccaaactcttccaactgaataaatgagctaattctacgataccagccagtagatgtctctctctgttatatcccttctgatcattacc

SEQ ID NO: 241905 - DNA, 766 bp, Homo sapiens
gcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggctgggcacgggttctcacgcctgtgatcccagcactttgggaggctgaggcgggtggctcacttgaggtcgggagtttgagccagcctggccaacatgatgaagccctgtcactgctacaaatgaaaaattagccaggcatggtggtgagcgcctgtaatgccagctgctcgggaggctgaggctggagagtcgcttgaacccgggaggtggtggttgtagtgaaccaagatcacaccactgcactccagcctgggcaacagagtgagactctgtgtctaataaaaggag

SEQ ID NO: 241906 - DNA, 500 bp, Homo sapiens
aatcctaagtgtgtacgcaatagagcttcgaaataaaggagcggaaactgaaaaaaatacatccataatcagagctgaagacttcaataatccactctcagtaattaatgggacacataaatagaaaatcaggaagaacataaaagacccgcaaaacactatcaagacctaatagacatttatagaaatgttccactcaacagcagaacatactttttatataagggtatgtggaacattcaccagtacataccatattctgagctacaaaataaacctcaactatttaaaatcagtagaaaccatacagagtgtgtttttacatgaaaacagaattaaaccagaaatcaattaattggaggatatctgaaaaaccatcaaattattgcagaattaaagaacacatgcatgatactggtacaagaacagacacatagatcaacggaacaaaatagagaactcagaaataagactgcacaccagcaaccatctgatcttca

SEQ ID NO: 241907 - DNA, 285 bp, Homo sapiens
atttgggttaatttctgaattttcttctttgtgaattgatttttctcctatatttgcatctgctattatgtattaattattgaggctttgtaatgtgtcacaggttctgtcaaggctgggctgtcattgttctcctattacatattttttcctagctcttcttgcttgtttattttcccatttgaacttcaaaattactgtgttttattaaaagacccttgtaagatagaagacagatttgatttcattaagaaaaaacagaaaaaaaagcaaattcaaaagaca

SEQ ID NO: 241908 - DNA, 589 bp, Homo sapiens
cacatttctaagctcaccaccacttataattacagaagattgatggctatataggacatctcccaccaagcctgcagaatgtccagatgtcccaagtacagcccactttactcagagataacgtcaatgagcagactcaagttgaaggattaatggtcactagagcaccaacagcccctacctttagtgagcacatctgcacattccaagtttaatcatagctccttatagcttcttataagcagagatgttcctaaaggacaggggttcctcctcctgctttctgggcatgccctactctctaatggagtagtttccaataaatttgcttctttgtctgtgctccaattctttcctgtgtgagatctaagaacccactcttggggtctagattgggatccccttttctggcaacatcttgagtatgtgaccatgagaaatgttagaaattggagtgaaaggtacgtaaacatttgaacccaataccattctctggttctcccagaggcacagtaaaaaaaagtattgacatagaagaaggaaacaaaaagttgtcaggagttaaagaataaagatttttttttctgga

SEQ ID NO: 241909 - DNA, 507 bp, Homo sapiens
attggctagtcttttgcaaattcttactttggaatgacctttagaacctgtggcatatttttttttttaatattgtccagagtggcatttcttcagggtagatctcatttgtaaatatagacaaaagtcattcagagctgagttcaatgactaaaagtagatgaccaaactgggtgatcaaatctaggctccacgctgaggtgcacttctaagataaggtgcctgattttcccatgtgggctttttgcctatactcttgcccacccacccgcccacctaggggagcaatggacacctaccaatggtcatagctcttctctaatcatactcctctgccctcagcttgtttaacagtatttctcaactccatctcatcttcattctactccagactcgtagatcttgaatccagcatttgattctacctctgagtctttgaaccaggtgttagcaatgattttcccaatgtttgaactactacttttccaaataaactctgactttaaa

SEQ ID NO: 241910 - DNA, 389 bp, Homo sapiens
tacttggcagggatatggaaccagatgacctttggtcccttctggcctggagaatctgtaatgataggggtctaagcctgccctgactacacccgggatttgaatctagatttctcctactcctaagccacagggttacgttaagaatattagtcgcacgcctgtaatcccagcactttgggaggctgaggcgggtggatcacccgaggtcaggagtttgagaccagcctgcccaacatggcgaaaccctgtttctactaaacatacaaaaaatcagccaagtgaggtggtgggtgcctgtaatcccagctactcaggaggctgaggcaggagaatcgcttgaacgcgggaggcggagcttgcagtgagctgagatcatgccattgcat

SEQ ID NO: 241911 - DNA, 276 bp, Homo sapiens
tctgtcctacaaaacctcagctccatacacaggagactttctatcacgctgctgaagttggagctgaagaacaaagaacaagcttgagtgtcccatcacctgctcagaataaagttgggtgaaacattctgtataaacactgctgtctacagggcctgcctactgagaggatggtctgggagtatagatgtggctaaggggataatgtagttgtggaaaggatattcatacacagaataaatgcaagaaattcctccactaattctagacagcatc

SEQ ID NO: 241912 - DNA, 337 bp, Homo sapiens
tgccaccagcagtgcttgctacagcccacagccttgttttcttctctcccagcctcctcccctccccagcaggagcttttcagcccccactcaccactgcaccacagtttctttcttttgtcctctctggactctacttttttcctaacactttccctagctcaggctagttctcacccactctgtcttccactttcttcaccccacagagctgagacactggggccttctttctttttctcctgggctcttaatcgtgttcttgaccagaagatagcagaagctttggccttcttcagcttgattccaccctgggttccaaattcagtccttccca

SEQ ID NO: 241913 - DNA, 317 bp, Homo sapiens
ctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccacc

SEQ ID NO: 241914 - DNA, 149 bp, Homo sapiens
tccttttactgttttaatgtggctactaggaaatttaaaattacatatgtgactcacatttctcctggacagcaccggtctaaaggctggggtgcagtccaaggaagtactgcaatataccactagggggaagcattatagcagactcc

SEQ ID NO: 241915 - DNA, 327 bp, Homo sapiens
gaaaacaaaagaaaagcactcatgccttctgtgaacaggcacagactgagctctcctgctgtggccagggcaccagagctgccaccgccccccaccgatggctgctctccttgctagcatgtcctcacctgtgtgtactgggaagagcagaggactaatctttgtctagccaatgtaagagaaagaggccattttgacggtgtgtgactgcccctggcagttgcaggtcacttcagctcatcctggcccagcagcgtgtgggtaggtctacaatttaaacccacagagttggcgggcggatcacctgaggtcaggagttcgagacca

SEQ ID NO: 241916 - DNA, 464 bp, Homo sapiens
gctgaggcaggagaatcacttaaacccgggaagcagggaggttgccgtgagccgagattgcgccactgcactccagcctgggctacagagggagactccgtctcaaaaaaaaaaaaaaagaaagaaaagtgagtggaagagaaatctttcgagttagaaaatataataagtgaaggctgggtccggtggctcacacctgtaatcccagcaccttgggaggccgaggtgggtggatcacctgaggtcaggagttggagaccagcctggccgacatggtgaaaccccatctctactaaaagtacaaaaattagacgggtgtggtggcagatgcctgtaatcccagctacttgtgaggctaagacaggagaatctcttgaacctaggaggcagaggttgcagtgagccgagatcgcaccactgcactccagcctgggcgacagagtgagaatctatctccaaaacat

SEQ ID NO: 241917 - DNA, 348 bp, Homo sapiens
gctaatgaataaaagtaagttgtaagcttcatgctttaggtgttttaaactttttaaatatgtttggaaaatgtggcctggcacagtggctcacacttgtaatttcaacactttgggaggcagagatgggaggatagcttgagtccaggagtttgggaccagcctagtgagaccctatctctacaaaaaataaaaataaaaaaattagctggatgtggtggcatgcaactgtggtcccagctactcgggaagccttatgcccaggagatcgaggctgcagttagccctgccactgtattccacccttggtgacggagtgagtaagaccctgtctcaaaaaaataaaaa

SEQ ID NO: 241918 - DNA, 372 bp, Homo sapiens
aatgagcattccttgtgccagactgtgattgccaaataccatttcctacaaaaaataaccagggctctttgaaacaatggctgctttcagatttggagcaggagatatacaagatgtgcctggttcatctttttacaacagcaagcagggaaactctggaggactcccagggtcatgttgtagaaggactcaggaaccaacgtgaagaggttcctactggtcaagtttgaacatcatattggataatacagcactggattgaaacatatcacacaggtttaaatacatgagtttgtagtgatactcaagaaaaaaaaatcagtcacttttgcaggatgctaggaaattaatgaattactttgaaaactggta

SEQ ID NO: 241919 - DNA, 443 bp, Homo sapiens
tctctttgttgattggttgtcagtccctctcactgagagtgagcgccacctcccatgcagcactgcacatgtgccggggactcttccggactgttggcaggtgttaccagtcttgcctcccttttcagagggagaggtcggggaattgcccaaggtcacccagctggtttggctgggctggctagtgacctccgcgcttgctgccctgtccactgcagagctccagcatgggagtccttccaggcacctgccgtggtgaatgttgaacttagagcaggggccaggaggaagccgctaactccctctgtgtgtttgcattagggttacagatgtcaggaatggctccaggggaggtgacagttcaggtgccttggaggctgagtaggagtccagctgggagatggaaggcagggcagcccaccaggggaacagcgtgtgcaaag

SEQ ID NO: 241920 - DNA, 557 bp, Homo sapiens
cagagtagaagtttcaactcctttccatggggactgtcaggagccctatgccatcaatgactccaaggttcccagtcaaacccaagagcacaagccatcgacccaaaatttgcagcttcagaaggatgagcttgacagacaaaatcccaagcgcattaacgcagtctcccatttgccttcgagaacacccctgatccagacaaaaaagagcacttcctccagcagcagtgagtttgaggatctgaatgcatatgcttcccaaagaaatttttacaagagaaacttaaaccgctactgccaggagcgctggccattccagccatgcctcactgggaggccctgagcattctagccggcggctgcacagctgctggggcatctccatgaggaagagggcggtggacaggagtcatgaagactaattcggaaactcccctgaaggaggagaagacatctgagccatccttgtgccaccaagcaagagtcactccagctcctaaaaagccaccatgggaagagctgcctccaattaaagttcttgattgcaccagaaaaag

SEQ ID NO: 241921 - DNA, 506 bp, Homo sapiens
actttgtacagaataggaaaaaatggcctaggcagaaggatctgctggccatgggaagctacagaagatttgggagaggggaggagtattatattaatgccttgggagaggctgacccaatgatacccccaccacagtcaatttccaataggcatctggaattcagattccggaacccatgcccctcattcctttgcctccaacagcagcccaccaaaacctgatcttgaagatcttctgtttatgctgcagggactgtcaggagccctatgccatcaatgactccaaggttcccagtcaaacccaagagcacaagccatcgacccaaagtaggtatcagataaggacactctgcatggcctctctaaacctcactttgctcactctctgcctgctgggatacccccaaactgccttcatcactatcactgagtgataattccaatttaaaatgaggtgggtgttggatggctaagtactcaaaccaataaacaagagagcttaaa

SEQ ID NO: 241922 - DNA, 591 bp, Homo sapiens
cactcacagctctgatttactctcatcaaagggtatggagccaagtcagccaaaaggaaaggtgcatggagtgaactcgggaaaccaggcatgcacttccagaggccacacctaattcctccagcagtggatcatggtgacgtgtgaaatgtcagccagggacactctgatcctagcctcagcgcccttggtttcatgggggcggccacaagagcaccttctctccaacatataccaaaatgccaggctcccagaaagaaggcctgtgcctgcacgaacagcctagatagatgcagcaagccactctaggcctgcacgaacagcctagatagatgcagcgagccactctatcaggaagtgataagaccccccccccaacacccaagttcccagccaaggaccaactgtgcacccaggcctgtctaaggacagcagtctgttgtggagcctgccaggttaactcttttctgcacagagaaagttcgggaatgagttgtgggttaaagagggtgaccagaaaaggcctccctgacgtgacattcaccaaagacctaaattgagagagggagcagcccagatcctttggaggaa

SEQ ID NO: 241923 - DNA, 446 bp, Homo sapiens
gaattaggtgggtttctttttgctgttaaggtctcatgtattttaaatgtatatttttattatgaatgacaaagcatcttttggtatgttttagcagtttccatttcttctgtgaacttcatcatctgttaccttttaaaaaattgaatatttcaaaatatatatttttttgagacaggatcttgctttgtcacccggttagagtgcgtaagtgcaattatagctcattgcagcctcaacctcccaggctcaagtcctcccgagtagctaggtctacaggcatgtgctatcgcacccagctaattttaaaacattttttgtagagacagctctcgctgtgttaccaggctggtctgaaactcctggcctaggtgatccccctgcctttgcctcccaaagtgctgggattacgggtgtaagccactgtgcctggcctcaaaatatta

SEQ ID NO: 241924 - DNA, 311 bp, Homo sapiens
atattcttgatgatagacatatggtcattcttcccatttctaatttactgcaaaaatatcatttatatgaatccagataatgactttttcttaaagaactacgtgtaaaatatggacaaataaactttgagtgaaggcctaaaaaatacctctaaattaaagtgggaaaatttaggatatagattttgtgacatcatatcacttctgcctattaatcccttatttatatctttgtccttgtttgaaatccctcattgatacaactaacactgtagctatctaaaaatttagctctcttgctaactcccttc

SEQ ID NO: 241925 - DNA, 567 bp, Homo sapiens
ctcgagggctctcactggatttgatggcagaggctgtttctttatccttggctgaacgcccagttgctactttccttaagcttcccctctgagaagaggaggatggtttggtcccaattggctgactgctgagggaagcccctgatgaaaatccttcatctgcatcattcaggtttacagactcctctcctccatttacaccctcagcacctaagaaaacaaatcagacagactcagcaatagctaaattaaataagaagcagctgtgaataacaacactgaccttatctcttgggcaatgttcgctataggttgtcaatggccctactatcaacacttcccctaaataatttaggggaaatcttaatctacacagaattctactatgctaatagatgttagtttagctttatttagtccagtttttgtacaactatccacaaacatatctagtatactgtcaatatttaggcatgtaaaacgactaggtaaaatacaacagtttgttaacataaatttttataatacactatcattcttcttctgaaatgaccatatctacctact

SEQ ID NO: 241926 - DNA, 495 bp, Homo sapiens
tgctgaaccatttgaaaggaaattgtagcggacattctgacgtgtttcttcaaacacttcaggccacgtcaactaaggacagtctgatacaaccacagtagcattatcacatctaagaaaattaacaataattcaatattcagaatagggcaggaagatcaaaacctgaacccatgccaggtgctgagagcagatgaggggcatcagagggtgggcgcccgagccgaggggtgtcgggcgcatccgctgcccagcggaagcggcggcctgagtggagtcaccgtgcaatgggtgggtgtggctttgtgagccaagccccaggagaaccagaacccaccttttcctcagtgccctgaccagctgtcccgcagctgtggcttaaatgccaacttccagttcgtaaatttcttcaattattcctccccaaattatttacatatgtatatgtatttaaatcaggatttaatcaaagttctcacgctgcatttagctgtt

SEQ ID NO: 241927 - DNA, 775 bp, Homo sapiens
aaatttcttcaaacaaagaacagcctgaaaatcaaactgcaggccccagataagaaagagcccatgccttgaatagaaatgttcactttgtgaacccagatgaacaaattccattcctttttggacaaatttctctctcctgggcaggccttagtatcttacttttcacctattttacatatgcttacatttctgtaactggctgtaggctaagtctacatttacatagggtgaatcatcacttcagttgctgattgttcccaggacaagattctgggccaagccttcacctctgtctccaattggtcctttacgctctcatacctctttctaagtgctgctttctcgaatagagtctgcagcccagtcagcacattcctccccttcccagtccatcaaaaccccagactcagcttcatacttggctatcctctttcaggcctaccctccactgtggagagctttcttcttttgcttattaaactttcactccagcctcaccatttgtgtccacatgccttaattttcttggccgtaagataaagaattttggatgatacctgaaacaatgagaccactacactgtggcgcattggtgagactgtaacaaaacaaaatatattctcaaaccacaatagaactaaactagacatcaataacaaaggtagatggagattcctaaaatatccgaaaataaaataatactctcttgaaaaacacatgggccaaagaaaaagtgtaatgaagaaaatgttttaaatatttgaattaaatg

SEQ ID NO: 241928 - DNA, 800 bp, Homo sapiens
tcaaaaaaaaaaaaaaaaaaaaaaaaaaaaatctgcgagcatctgtgagaacaccataaattctaaggcagaaggaaaatgtcacctctttgacattgttaacgtgcaccattttgattcttaatatagcagaacattttcccacatatttatattctcttgtcagttggtcttgtcttttggtcatttgtcaaatgaagtcttacattttattgccaatttatgtgaatttgtttaatcaacatattaccctcttttaaaaaatttttttgagacagggtctccactcttgcccatgctggagtacagtggcatgatcacagctcactgcagcctcgacctcctgggctcaagcgatcctcccacctcagcctcccaagtagctggatacaggcacatgccaccatgcctagcaaatttaaaatttttttgtagacatgtgttcttactatgctgcccagtcttgtaatcaacaaattagcctcttgccatatatactacaaatatattccctagcctgttgtctttttttttagtaatgtttctttttttgacttaaattttttattgttgagtctcttgatctcttctacttcaatatcagcatttttccttagaaattttttattctctactttcagaggcttgataaatattcaattctaattatgtgtgtgtatttgaatatagtcaggcatttttgtgatgttttagtgaattttaacatatgtataaaaagtgctcaaatcataagtctacagctcgttgaatgtttatgaactgagagtcttttttttttt

SEQ ID NO: 241929 - DNA, 1050 bp, Homo sapiens
ctttatctccgccggactcggggtacctgccggattcgaggtaaccgccagctggtgtggggctggtttccccaacatctggtggccaacgcggggctccccataatctctacaaataatccagtgaaggaacgccagagcgtgcaaagtggaggacgactgacaaaggacacctgaatatgttttcacttcaagctctacaggaggacaaggactcaggggtctgctggtccatctctgcaccttgaaacagcagctggggcaccagaagtaacccttacagccaacaccatgtgatgatgaggaggagtccatctgggttaaagagcccacgtgtgagccaaggcaggaaaccccgggatccagaaagccttctgtttttgcgatgctgcctgggatcggagccgcacaacctgtcctcattgctctctccggaggccgggcaggaacctctgccaaagcttctacctcagccgctggcaggccatgcggcctggggcattcacggagttccaacgagtctgttactggctggggagtgctggggccagggcatggccgtgcccgctgatcctcctcctgcctctccatatcggacttctcctcgaccaccacctggaccactgccacgatatcgtccacagcagcaccttctcctccccctagggcgcctccacgctctgtgccctggctgtcctctccagcagagcctccaatttgaacggggtacactgtccgctccacgtctgtggtcatggatgaagctggaaaccatcatactaagcaaactatcacaaggacagaaaaccaaacaccgcatgttctcactgataagtgagagttgaacaatgagaacacatggacacagggcagggaacatcacccaccgaggccggtcgcgggggtggggggttgagggagggatagcatttggagaaatacctaatgtaaatgacgagttgataggggcagcaaacaaacatggaacatgtatccctatgttacaaacctgcacgttgtgtacatgtaccctagaacttacaggataat

SEQ ID NO: 241930 - DNA, 415 bp, Homo sapiens
cattgagaaagtaggtggaaagggtgcgtttgcggctctgggcttgccgcacttcctttttttctcggcgtccttgcagccctgaccccgtccagtcatctgccccctctcccactgggcaggaccatcatgttggccaacccacctcccccagacctgccaccctgtggccactgggctccttcccttcctctctccagacacctgtctcgaggacccgggttgtaaaatcaagtgtctgggagggccagcccgcagggaaaatgagcggggctgcagtggacagctgagaggaggggacactggtcgactggatggcacatgcttcgtctgaaggggcgagtccccacgccacacattctgtgcacccagaatgacaagatcttttttttcccaaagaaaagccactaatctg

SEQ ID NO: 241931 - DNA, 541 bp, Homo sapiens
  misc_feature (410)..(410): n is a, c, g, or t
  misc_feature (458)..(458): n is a, c, g, or t
aatgctctcagaaagcaggacgtggaaacggtcatcacagaccaacagaacggaaggctaagtttgtccttttaaggaacaaagaggaaagtgtaattggataaaagtacaaatgcattaggaagatactatgatcatggtctattatgtaacatggatattataatattataatatataaggcaaaaactatatataaatatataaggcaaaattcttaaatttataaggcaaaatggaaattcaagaagaaactggcaaagtcacagccattgctgaagtctttgcagatttctctcagaaattaaagcaatcaagaagcacaaggaagccaggctggtcttgaactcttgacctcgtgatccgtctgcctcggcctcccagagtgctgggattacaggtgtgagccnccgcgcccagccttcattattcttttgacatttgatgataaatactgnttatgattttctttctctttttttttttggtagagacagtctgggcaacatggcgaaaccccatctctactaaaaatacaaga

SEQ ID NO: 241932 - DNA, 407 bp, Homo sapiens
tgcagtcagatagtgatcactggaagtcatagtcaattacatctctggtgtctgggatgggaaaccagacagctgagggctggagcagataggagtcctctggctctccctcacctccacgtagcctctctacagtgcccacagcatggctgcttcagggtgtacaggcctgtacatggaagtcagggctacctagacatgtgtcccaagggaaggagggggccaggcagaggctgtattgtcattgtcccagccctagaaagcaggcaacatcatcttctaatcattgtattcactggggcagagacagagaccctccccgattccagattctggaagagcatgtggcgctgaaaatattattgaagccagctttggaaaatacaatctcttacaaatcctttaaa

SEQ ID NO: 241933 - DNA, 1006 bp, Homo sapiens
agtagagagagcatttcgctatgttgcccagtctggtctcgaactcttgggctcaagcaatcctcccaccttggcttcccaaaatgctgggattacaggcatggtggcatgcacctgtggtcccagctacttgggaggctgaagcaggagaatcatttgaacccggcaggcagaggttgcagtaagtcaagatcacaccactgcattccagcctgggtgacagactgagactctctcaaaaaaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggaggctgaggtgggagaatcatttgagcccgagagtttaagaccagcctgggcaacatagtgagacattgtctcaaaaaaaaaaaaaaaaaaaaaaagttggggggtagcaccagtcttccctgtcattagtcaattaccagtctttcaattattcaaccatgaccctcgaatacctattgtgccaattgtgcttggaggagacagagaagaagacatgatctctgccctccaagagctcagggtataatgggaaagataaggcccaaataaatataataaaagctagaaaaacagatcacaaagaaagtgagataaagggctttgggaggaagaaagaacttttagcttttgggtaggtgaaa

SEQ ID NO: 241934 - DNA, 790 bp, Homo sapiens
agtagagagagcatttcgctatgttgcccagtctggtctcgaactcttgggctcaagcaatcctcccaccttggcttcccaaaatgctgggattacaggcatggtggcatgcacctgtggtcccagctacttgggaggctgaagcaggagaatcatttgaacccggcaggcagaggttgcagtaagtcaagatcacaccactgcattccagcctgggtgacagactgagactctctcaaaaaaacaaaaaaaaaagatcacagatcatgctgggtgatgtgtggactggaagggaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggagcattcaggtcgatacccatgcatccttagggcacggactgtagttcaagaacgcgatgtgtctgtcagacccagagatgttccctgatctcaa

SEQ ID NO: 241935 - DNA, 487 bp, Homo sapiens
catccagatcagggagattgatagagaaaaagcagccctgaagagatttttggtaaagcttcacaagacaactggctattttcctcaaaagccattgtggtgactgatgctgtgccaccataggggacgagttcatctgaaacatccaatacagacagaacacacctgggtctccttctgtatctctctgtgacccaagaaagcagtagaagtggctactgggacaagccaaaaaagaaaaaaaaggactagataattgaggacacaaatggactgcctctaaaataataaacaaaacctcctacaaaagagagaataatgcgctgatttttttcccagctgattctatttctttacaacttgaggtggtaatatgcagtgcacgtgttattttcttacagattctcctggaggcaagaataaagctgagctattttagagatctttcagatactgatcatgaaatacatattatatttgccttaat

SEQ ID NO: 241936 - DNA, 403 bp, Homo sapiens
ttttttttgagatggagtctcactctgtcacccaggctggagtgcgatggcgtgatctcggctcactgcaacctccgtcccccgggttcaagcaactgtcctgcctcagcctcctgagtagttgggatcacaggcgcctgccaccatgcccggctaattttttgtatttttagtagagatggcgttttgccatgttggccaggctggtctcaaactctggacctcaagtgatctgtctgcctcggcctcccaaagtgctgggattacaggcatgagccgccgcatccggccctccattcctcaattttttagaagtagatagatgctacataatatgtacaactcatttgagagaaaaagcataaccttgtatgatgaaagcaaatgtcgacgcggccgcgaa

SEQ ID NO: 241937 - DNA, 623 bp, Homo sapiens
gttgccatctccattgctagtttattcccacttttggaccactctttttttttgagatggagtcttgctctgttgcccaggctggagtgtagtggcacaatctcagctcactgtaaccgctgcttcccgggttcgagcgattctcctgcctcagcctcccgagcagctgggattacaggtgcgtaccaccacgcctggctaattttatgaattttcattgtggtggccctggcaggatgtgcaacagggcgatctcggctcaccaaaaccaagcaatccactcggcttggcctcccaaagtgctgagattacaggcatgagccaccgcgtgcagccttggaccactcttaaaacataaattatagctctgatcatgtcattcttctatttaaaatctgtcaattaattccatagtccaccaaataaagattaccttagtcatcacgttattcaaggctccctaagatcagtgactctagcattacctatgatttccctttatggtttccaaactcaagtacacatccctccttagcaacttacatcttactctcccagctctctgccttgttcatattgcaagccaacatattcacctccttgcattacctaattcatctctt

SEQ ID NO: 241938 - DNA, 319 bp, Homo sapiens
actgggtctcagaagaggcttgggccccattgtcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactctatcagtggagaaatggtcacacaggtcctagtacagttagactgtggaatactatacagtggtaaaaaaaacccagggtggagcttattgggatgaaaaacatactgcaggccaaaa

SEQ ID NO: 241939 - DNA, 353 bp, Homo sapiens
atacttatgtttatctgacagaagaaatgttatgatcacgaaggtggtttttccagagcaaggcttagcaattttgctgtggatgtgctgacccctgtgatttccccgaatgtgggaatctccattacataacttgtggcagtggggaactgtgtctgtgttttcccctgggttgttgtcgttctaaaagtggattttgtttgctgtggaagcatatataaggcgttagtataaactaataaacaggtctttgttcccatctgtaacttactttcaaagtaaagattttgccaggtagtggttggttctcacgcttgtaatctcagtagtctgtgagatgcattgataacttt

SEQ ID NO: 241940 - DNA, 446 bp, Homo sapiens
atcaaaggtgttaatggggttgtcatgatgggcatccatggacaagcagacctagactccaaccttattgaggtcaagattgtctaaaacgtgtttcctcaactcctccagacatcatttcaaaaatctctctggatcttcatttccgttcattcaatcttgtcttggaggaatggatgtttttccccctgtgaagatgaatccctctatgtacttctcattcgatccttccttatcaccacattaccttgtctctcctgcccttttacatctccattgttggctcattgggcataagaacatgttcagaaaactacacacaagaatgtggataaaccttcaaaatgttgagcaaaagaagcaagacacaaatatacatatggtataactccatttacaaaaaggtaaaagccaggcaaaagtaaactatagtgtttagagataca

SEQ ID NO: 241941 - DNA, 324 bp, Homo sapiens
gtcttctcaagggctccagcagcaaacctgcctgcagacactaccagacagccaacctaaaatctctggaccagtagtccagtgaagggctttccctaccaaacccagtctgtaaagactgtcataggtacctgcttttcaaatgcacagaaaccaatacatgaccacaaggattacaaataacccaagaaatatgacaccatcaaagaaataagagaccataaagaaatgaaaagttatgagctccctgacaaagggttcaaaataatcgtcctaatgaagctcagcgagctcaagagaacatagacaactaagtgaaatcag

SEQ ID NO: 241942 - DNA, 637 bp, Homo sapiens
aaaatttattttttttaaagtgtggcccaatatacataataaaatttaccatgttaaccattatgaagtatacagtacagtgacattatgtatattcatccttgttctgctctcatcacaccatccacctctggaactcttttcgtcttgcagaagttctgtacgcattaaatactaactctcatcgcctcttacccaaccctctggaaaccaccattctactttttgtctctatgaatttgtttatttattcatttattttgagatggagtctcgctctgtctcccaggctggagtgcagtggtgtgatctccactcactgcagcctccacctccagggttcaagctatccttccgagtagtagctgggattacaggcatgcactaccacacccggctaatttttgtattgttaatagagacggggtttctccatgttggccaggttgatctcaaactcccaacctcaggtgatcctcccgccttggcctcccaaagtgctataatccaaagggattataggcatgagccagcacgcctagcctgtatttgactactctacatatctcatataagtggattcatagaacatttgctcttttgtgactgatttatttcacttaacatggtctcaaag

SEQ ID NO: 241943 - DNA, 463 bp, Homo sapiens
gttatgcttcattagacccatacctcatcctgtaccgactccacgtgctataaatattatcttagatattaatcaaatgcaaagtgtgatagaaagaaagtggccattagatttagacagatctcaattcaaatcccaaactctctgcttactaccatggtcaaattgaataatccctttgcatgtgtgttttatcattagcaaagtgctgattagtgctggaacaagaaaagtacaagatgcaattggaccatgaacaagaagctactaacttctttagagaaagcattctcacaggtaacttcagagaaagcattcccacagaaatgatgtttaagcaaattcaagaaggatgagtagaggttaactaggaaaaattggaaggaacagtgttcccagcacaggcaatagcttacacaaaggtccggcacctttcacaggctgaaaaattacatggtttaag

SEQ ID NO: 241944 - DNA, 442 bp, Homo sapiens
aacatctagcatggtctctagcatgcagaacatgctccaaatttgagagctaagtttgtttatcatttgttagcatccctcctctccattccttgctcttcacaagccccagcccaaaatatcacttggagttcagtagaagtgagcaatggataagatttagaagcatagttagaatggatccagaaaaaaataaatgttcctttttccttcttttccccttcctagatccccaccataagcatacatttcttgtattagtctgttctcatgctgctaataaagacatacctgagactgggtaatttataaaggaaagaggtccaactgactcacagttccacatggctggggaggcctcacaataatggcagaaggtggatgaggagcagtcacgtcttacatggcagcaggcaagagagaacttgtgtaggggaactct

SEQ ID NO: 241945 - DNA, 575 bp, Homo sapiens
ggaggcagaagaagaaaggcaggagagaagaaaggaaggaagaaaaggataagtcaagcaaagatattgaggagcaattcattcatccatctgtctatctatccatccattccttccttcgacaaatatctgctgagttcctatcaagcaccattcttggcactaaggatataacagttaacaagcggaagctaccagcagctgaccctcaacatttccaggtgactttggtgtgtgcatatgtgagtgtgtgtgtacacgtgggtgcaagccctctgtctgcacaggcctgttgccagggcacctgtcttccctagggtctggtgcttttagcctctggctccagctcctattgcagcccgaaataaggctgtgacccatggcaaggcaggaatgattctcatcagctgaagccagagctggctgcaggggacaccctgctcgctgcctactgactgctgaccgctgactgcctacagggacgccacgcaactctcagcttcccgacagaggtgttaatcttgagggtctaagattccctcctgcctattgtggtcccatcctctcaggtacca

SEQ ID NO: 241946 - DNA, 379 bp, Homo sapiens
cccatcccctaggtctggcattcatcagcattcacacatctgcagaaggggtatgagggagaaatgacttcattaattattgtgtcaccaagtttttcttctcttgattcctaagaagaagaaacagagattacatgtgtttacttaagggtaagcactaactgaatgcttactgagtggctagatgaatatctaaaaaaaaaaatggtttctgtaggcgttggattctgctcaatgcttatgcccacccagaatgctctataaaaccttcactgttgttctcaggatcagccttcctgaattcatcctataaacttttaatgagtgacctgtttgtaaaactcccttccagattggcaaatacaagttgatagagaac

SEQ ID NO: 241947 - DNA, 266 bp, Homo sapiens
ttcacaggcaggtggatcaagcctccctttgaagtatcttcgtacagaaaagtcagccctttgcagactcaagaagggcccagtgcctaagtcttctctgcattcacatcaatgaatcacattctttaatcgtttatgaaggggcacagggggccatgaaaataacaagacctaaggtttgactgactccggatatctggctggaggagctgaacggaccaggagacaggcttcttgtgggggtgggcatcttggataaagtaagt

SEQ ID NO: 241948 - DNA, 443 bp, Homo sapiens
cttatttattaagggatcttttgtagagctaacttaaaagttgctcatctaaataagctatttgccatacataaaacctagtataagagtggaggtaatatcaggtctgtgaacaaacaggctaatgatatttattttatctcttgtgtagtatacataatatgtggttgcaaaaacctggcagtgttttagggataatgacctgactgctttatgagtttccgtatctctgggactgctaggaaaaactgtctttttatgttattctgtaataatgaaaaagtaataaataattaagattgattcttatcatgcttttttttaataagactttattatcctcccttctcagttggtggtagtttgattacacaggaattctatattgtgttttttaaatctgaggatagagtgctgactttaaatgtattatggattctttg

SEQ ID NO: 241949 - DNA, 414 bp, Homo sapiens
aatcccagaagagagagagagagaaaggagcagaaagactatttgaagaaatagtagcccaaaacttcccaaattttatgaaaacattaatcttcgtatccaagaaattgaacaaactccaagtagggtaaactcaaagggattcacatttagatgcatcatggtcaaattgttgaaaaagagatctcaaacgaaagaagcaagtaaagctaagaagtgacttctcttaagaaacaatgcaggcctgaaagcagtgagatgacatattcaaagtgctgaatgaaaaagactatcaaccaagaattatttttgcagtggtgcaatcatagctcactgtagcttcaaactcctgggctcaagcaattctctttcctcagcctctcaaataggactaccagcatgtgccaccacact

SEQ ID NO: 241950 - DNA, 732 bp, Homo sapiens
ggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattagaatagccaggtgctattttaattttacagattcacaactgtaatcccagcacttgggaggccgagcagggaggatagcttgagtccgggagtttgggtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggag

SEQ ID NO: 241951 - DNA, 544 bp, Homo sapiens
tgagaccctgtactatgaagataaatgaagaaaatgattgaaatgatctcccctaaaggaaacaattttaggtttagatattattactgtaagggaaaataaaatccccagactacactatactaaactcaccatctctacagaattcaaaagatatttataaggacagaaaacaccactacaagtacacactacatgaacacatgtcacattttaaaaatttcatatatgcatgttcaggatacaagaagataataaagtttacactttgccaatttctgcagacatatgatcagctctcattagagtgccgtcaaaatgagtactgtgaatagggaactcttaaaattgaattggctaaatgtagtcttaaaagctatagtcttaattggctcactcgctacttacctaagctgtatttatcagaaagttctataaataccatgtcctaaaatgtactaccagtgcagtgaatattgtggttgctttctattaaactctccatttctttgatttctctatgaccacagttggcatttactgt

SEQ ID NO: 241952 - DNA, 377 bp, Homo sapiens
agatgttctcaggcgtacgcttctaaagaaacattgtagactcttctactggcctttatctagtcactgctttaagcaaggaataaaacatctgtggctaaaatttgtaaaactgtgtttcccacccacccttcagacctgacagaagagtttttaggattttaagggaacagctttttcgtgacccaaaagggaacagtggtgcaaagaccaatgtcacgtaggtacattttccccatctgtaaaataactttccgatacgattcccacacctggaatcagtacaatgttttgactgaggtattagaaaaacttatgagttcattatcatttgaacatatgagtaatgtaaaatttaggcagaattttatttgaaa

SEQ ID NO: 241953 - DNA, 461 bp, Homo sapiens
tttgaggaaactcagaaaaattcaagataacacaaagaaggaattcagaattatgtcaaataaatttcacaaagagattgaaataaacaatcaagcagaaattctggagttgaaaactgcaattggcatactgatgaatgcatcagagtcttttaatagcagaactgatcaagcagaataaagaattggtgagcctgaagataggtttttgaaactacacagtcagaggagacaaaagaaaaaagaattaaaaaagaaataaagcagcttccatgttagctaggactacaggtatacatcatcgcacctggcttagatgtcctaccttttgtgggaaagcctcctaaaatagaattgctaggtagagatatatatatataatttttaaaatttataataggcattgaaatattgcttttgaaagaccacaataaataaaacaaacatctaagagcaatgaa

SEQ ID NO: 241954 - DNA, 459 bp, Homo sapiens
caaaaaggttgggaggaggggggagtgaggggagacaggtttgaaaaggtaagttggaagacattgaatgtggatgtgacaatgctaaattatccatcagtgtgtccactgagtgtttttggagtataggagttgtttttgacttgctgttttctctcctgtccttcataaccatttgtctacagtatagtacttctatgatcctcatctctttgttcatctgactgcagcctgctttactgtttggcctgcagcaatggttttcaaatctttttgactagatactgcattaagaaatatattttattttgtagcctggcatgcataaactcctaaactctctgcttctcagttgaaacaaaagtttaaaaaccagtatttaacatttctaagcaaaatgaattctgatctttttatttccattcctttctaattttcttcactcctctccattcctta

SEQ ID NO: 241955 - DNA, 157 bp, Homo sapiens
cataaccctcatatagcattgttatgtgtgtttgtgcatgtgtgtgtactcactggggtaagatgtttatggagacatattaagaactgagaaagggaaaaccccacttatttgagagtttgggaaaaagagaagcagggataagatgaaagagaaa

SEQ ID NO: 241956 - DNA, 387 bp, Homo sapiens
ctgaagttaggtcataaaaggcatgcggcttccttcttgtgtgtgagaacacccatcttgaagccctgagcctccatgcaagagtctgattacttgagaccactatgctgtgaggaagccccagccccgtggggagaccacacataggtgcttggtctacagttctagttgagcacagaccagtccagatgccagacatgtaagggaaaaagctgccagacaattgctgcctccagtattagcatccaagatgctatcagcttccgagtcctcccagctgaagccccagacatcatggatcagagagaagccatctccagggtgtcctgtcggaatccttgtcccattgagttcatgagcataataaaatagttgttgttttgtgcc

SEQ ID NO: 241957 - DNA, 298 bp, Homo sapiens
aggattagggccctttttaatcctattgcagtcaccactagtgcaatctccccagatctccctggaataccccaaatgacagaaaaaagtaaatgtgttcctccagcagcttcttgctataagtgcaaaactccagtaagtcttattttatcttgaaaaatccatgtgactcttatattctgttatagaattgtatttgttttaatgtaaacattttatgttaaattagttagcaattagttagcaaatgcaaatattttaaggatgtactgatgaacaaagaagcaatgatcccatc

SEQ ID NO: 241958 - DNA, 429 bp, Homo sapiens
gtaaaagagcctggcatgtgctcctggaatcaggaggaatcaggaacctgtcacatgtctgaaaatggctaaacaggaggaggctcggtgaagggacatgtggtggcagggtgaatagacttggtgtgatggttaattttccacgttaacttgactgggccacagagttcctagatacttggtcaaacattctgggtgtgtctgtgagaatgtttctggatgagtttaacatttgaactggtacactaagtaaagcagattgccctccctaatggatgggtgggctccacccaatcaatagaaggcctgaatagaacaaagagatggaccctcatgtgagtaagagggaattcctcttatgtaattgcctttgagctggaacatcaatttttttcctgctgtttgacatgaactgaaactttcctggtt

SEQ ID NO: 241959 - DNA, 487 bp, Homo sapiens
tactgattgtgtgagggaaggaaataacttgaacttcagactcattcggcaggtcctgattctctttcactatcagcctccccacctattctgagccgctccgaaacaaaacaaacaagacccaactcctgggcagaaagggaacagcagctgagctgagcagcacatgcttggagcgttcctgccatcgacttcggattatttctgctttcttgagacgcagccatcagcatgggactcgatgcagcccggagagcaccgcccgcgcagcgacgcgcacagaccctcccttggagacgcgctccccggcgcgtgcggccgagcccgcgtgaaatgcacagaccctccggtgaggctctgcccacgtgtgaccctgagcactgcgaagcccttcccttccatcctcgcgtggccacccaaagtcttgcctacacctcgtacgtgcagatgccaattccatagaaataaatgatgtaaggacagaaat

SEQ ID NO: 241960 - DNA, 535 bp, Homo sapiens
gagaaacccagcagttccacctcactgctgcacactgattccattacccagggcttctggaggtcttcattcatcaaggcctgtctgctctcactgagtgcgctactttaccccaatgttatcacagacaaccaggactatattaaacttgtcaaagtaagagtcttttagagggatggaacatcctgaacttttttttcaaatggagacattttcctgtttcttgagtgtgttaagagggacaggggtcccccacctttagtttttggccataacagaaaaaaaattttgataaagatcagatattattattaccatttaaatatttacctatgaaatttagtgagtggcaatgaaacttcttggcatttaatttttttgatgttctgccattgggaacttatctttgcaacactttttgttaagagatgtcatgattctgggttggaggaagataggaatatctaaaatgctatgtcatggttcaattgtacagaaaaaaataaggtaaacatgaaaagaaaatccatttgac

SEQ ID NO: 241961 - DNA, 258 bp, Homo sapiens
tgcatccccggcctctattacccatgtttgagaatcactgttctagattgataccaatacaacaatttgttaacagctgttgtattgtggcatcactagaaatttcaaagtctaggtgcagtggctcatgcctgtaatcccagcactttgggagactgaggtgggaggatcacttgagcccaggagtttgaggctgcagtgagctatgatggcaccactgcacttcagcctgggagacagagcaatatcccatcttta

SEQ ID NO: 241962 - DNA, 449 bp, Homo sapiens
actgcagtgtgcttctttctggaaatgccttctggagatggaaagaggtgaccttcaatccagctccctacagaaaactgcctgctctgctgtgaggcagttagactcaaagtccttggctaagagcttccagggagccaagcagatggcagctccgtcaactgcagctgcaaacagcttcatcttcggtttatttccaggaaccagaggagctcggggatggctaacagctgtctacctgtagggactcaaatgatctctgggccatcaaaccatcatatactaaatagtgacttagcaatttatccaaatgcttcctggtggcctgaaagagctatccaaaacttccttgatattcccaaagagggactttcgctggttcaaaatagagtaaatatactctttattgaagatctttcacaaatgaaaagattctacaaaccatgact

SEQ ID NO: 241963 - DNA, 391 bp, Homo sapiens
acatacatgttgtacctcccatcattgaggtggaatctatttcccctcttctcgcatctgtgttgagtttttgacttattttgaccaagagaatgtggcggaaataacattgtgctagttccaggtctagatcttaagaaaccaggttgcctcagtttttgctttcttggcatcacgcttccctgtagaggtttagtaagacttctgaataatggaagaccacttgtcggagagagtctcagccactcctgaagctcttccaactactctatctgaagtgccagacttgtaagtgaagacatctcaaatcctctagtcccagttaagccatccaggacaatagcatgcagagcagagaaaagctgttcccctaaagccctacccaaattgc

SEQ ID NO: 241964 - DNA, 468 bp, Homo sapiens
agctcatatagatgcttaaactgatttaaaaattttaagcacatctatattttattttattagctatgtttaaaaaatgatctttggagtttctacacatattcgctaatgtctttttctcccaaaaccttttaaagacaaataatgcaaactagggttcataaactaagttgcctttagagaccacagtatgatgtaatgagaaagatgttgccataggctgtggtaagtactaggcataatagtcatggcatgcttcaccaagtcattccatttgaaagaaaaatttaaaatatctgcagccagtcaaaatactctcgtggattgcattcgttctgatggtgagtagcttgtgatcctcggacaaaactttctgaagctattatctcattagccttattttttatacaatatatttctagttttattactttaagattaaaacatcatttttgcccctttttggaa

SEQ ID NO: 241965 - DNA, 549 bp, Homo sapiens
attcattgtgtaccatcagcgcttaaatagtatgtctcaaaggactttctttaaaaggccagattcacccctggagtggagctgggcctgaggttaccagatgtctctgcaagtcatctgaatttatcatcttccctagttcagccatctggctcacatgctgggcagagactcattggctccttgccagaggtcgtgtgacttgaatacccatatcttaaacaagtctagaatatgaaagagggagaggagaagaattgatagaaagttagtcttcacccttagaattctgtactttcaaattttatttcagagatttgcatatcattgatttagggcagcattttacacttaattcatcttgattatttaaactacaaaacaaggatagaaacttaagacattttatcttgactgtatgaaatatataggaaaatatgagggatggagaggaggcgccttcttttgttttgtctttttcgataatttccctccataagccagttggcttatctttggcaaattaaagagattaagctagttaacaaa

SEQ ID NO: 241966 - DNA, 387 bp, Homo sapiens
aaaaacttcgtgggagtgtactgtggaaaatagtgtacttaattaattctcattgtaatcaggctaccaagagccttgtgttgctttaagagttataactgccaggcacagtggctcatgcctataatcccagcaccttgagaggccgaggcaggtggatcacctgagatcgggagtttgagaccagccgggccaatatggtgaaacaagctgtgtctctactaaatacaaaaaattagccgggcgtggtggcacatgcctgtaatcccagctgcttgggagactgagacaggagaattgcttgaacctggaaggcggaggttgcagtgagctgagattgcaacattgtactccagcctgggcaacaagagggaaactccatctcaa

SEQ ID NO: 241967 - DNA, 430 bp, Homo sapiens
actctctcaaaaaaaaaaaaaaaaaaaagagtgttaaaccatatgtccacagacggggagagggcagtgcttgtttcctagccactctgaaaggctgaaagctgttaaggaggcttagtgtcatttcaagcagtcttccttgcctctgtgagtagtttttccatatttatgcttaaaacaaacagaggaagcttttcattccaataatgaaataaaaggctaaattcaaggtaacaaacgttttagtgggaaagattgtcaaggataacaaaccaacaaagggaaatatctcttattagctcttttcttcttttgattagagaaaaaagccaaagaactacttttggggctttaagtggctagtggactaccccagaggacacaaagaaagagggttctcagtgtttctagggcacttcctgttttcttt

SEQ ID NO: 241968 - DNA, 912 bp, Homo sapiens
aactggactgttccctcacaccagacagaaagaaaaattaacttaaatcacagatccaaatctaagacttaaaactataaacctcatagaagaaaacaggaaaaatttttcgtggtttttgggttaggtaatggtttctcagttaggacactaaaactacaaacaaggaaaaataggttatttgaacttcatcaaaattaaaaactttagtgcctcagagggcatcatcagtaaaatgacatgacaatttaaagaatggaagaaaatatttccaaattgtatattgataagagacttgtatctaggatatatgaagaactcttacaactcaataataaaaagacaaataatctaattgaaaattggcaaagatctgaatagacatttctcaggagaagatatgcaaacagccaataagcaaatgaaaagttgcccaacatctttagtcattagggaaatgcaaataaaaaatccaaagaaattgaaatcagtgtgttaaagagatacctgcattccagtattcattgaagcattgttcacaataagcaagatatggaagcaatgtaagtgttcatcagtgaatacatggatagagatcatgtggtatatatgaatatatacaacagaatactattcagcctttaaaaagaagaaacttctgtcatttggaacaacatgggaagacctggaggacagcatgctaagtgaataaacatgttctcacttatatatggattctagaaaagtcaaactcatagaagtagagaggagaacagtgattaccagaggctggtggtggggtgtggacgggtaggaatgaggaaagcggagatgttggtcaaaggatacagtttcagtttgacaggaggaataaattttaatggtctttcgtacagcagggtgactatattt

SEQ ID NO: 241969 - DNA, 445 bp, Homo sapiens
tgtgaaaataaatgaccaaagaaagacaagacactaataaaaaagaggagcagagccagaagactgtcttctagtcatcagggtttatgaggctatggaaatgaaaccagtgtggtattagcagtaggcagagataaattggccaatgggatagaatggagagtccagaggcagacccatgggaactttgatgtacaacagaggggatgatgtgccttgtcagctggggaagagagaccaccattcagtaaatggagctggagaaaatccatttgaaaaaagattaaactgggtctttaatgcctcatgccacattaaaaaaaaaagtcaactctaggtggtttaaagacttacatatccaaaccaaaatcttaaaaccctttaaaaaaaagttggagaccttaagataaggaaggccaataagacagtgaaaggcatccactag

SEQ ID NO: 241970 - DNA, 259 bp, Homo sapiens
taatatggtgaaaccccatctctactaaaagtacaaaaaattagccgggcatggtggcaggcacctgtaatcccaactactcgggaggctgaggcagggattgcagtgagccgagatcgtgccattgagccactgcgctccagcctggacaacagagagactccatctcaaaaagaaaaagaaaaagaaaaagaaaaaaagatatagtctacgtcaaagaatttctcctccaaacaaaaaccaatgaatataagtatat

SEQ ID NO: 241971 - DNA, 1118 bp, Homo sapiens
tttattattattatattttaagttttagggtacatgtgcacaacgtgcaggtttgttacatatgtatacatgtgccatgttggtgtgctgcacccattaactcgtcatttagcattagatatatctcctaatgctatccctcccctctcccacgaccccacaacagtccccagtgtgtgatgttccccttcctgtgagttcttaaagtagaagaggaaggcagaagaatgagctagagagaacgaactcaagaagaaagaggagagagttcaaacatgagaagggcttgacctggtgttgctggccttaaggatggagaaatggggccataaaccaaggaagatgtcatcttccagaagctgggaatgggcctcagttaacagacagtaggggaatgaggaccttggtcctataggtaaaaggaactgaattctgccaacatagcaaataaacaaggaaacagattcttcctcagagcctcctgaaaccttgactttagcctagagaaacctgtgtcagacttttgacctagagaaatgttaaataaatttgtattgtttacatcactaagtttgtgataatttttaagtcagcaagagaaaacttctctacattttcaacttataaagttgtatacagtagtctcttacagcaacttatccttcttctgtatcttcagttctttcataattcttattttgaatgtgttagtatttttctctcatttattcttgatcggacttactgaatgttggattacttcactgtttttaaagaactaccttttggtttcactcatgtaatctgttttattatgtgctgttcatcttttcttttatctttattcatacctttacttactttagttgtattctgatgttcactttctatcttcctgagttgtatgtttagatattttacagtctttcttgttttctaataatttcttttcttctgagtggccttttatctctgtctttcagggttttggtaattggcactatcattatcatgaacttctacactggtaatttttaaacatttccttattagttcaacagttctttagaagaatgattttacctttacaagtgatgggatatgtgtgtgtataaaat

SEQ ID NO: 241972 - DNA, 1065 bp, Homo sapiens
tttattattattatattttaagttttagggtacatgtgcacaacgtgcaggtttgttacatatgtatacatgtgccatgttggtgtgctgcacccattaactcgtcatttagcattagatatatctcctaatgctatccctcccctctcccacgaccccacaacagtccccagtgtgtgatgttccccttcctgtgagttcttaaagtagaagaggaaggcagaagaatgagctagagagaacgaactcaagaagaaagaggagagagttcaaacatgagaagggcttgacctggtgttgctggccttaaggatggagaaatggggccataaaccaaggaagatgtcatcttccagaagctgggaatgggcctcagttaacagacagtaggggaatgaggaccttggtcctataggtaaaaggaactgaattctgccaacatagcaaataaacaaggaaacagattacttttgacctagagaaatgttaaataaatttgtattgtttacatcactaagtttgtgataatttttaagtcagcaagagaaaacttctctacattttcaacttataaagttgtatacagtagtctcttacagcaacttatccttcttctgtatcttcagttctttcataattcttattttgaatgtgttagtatttttctctcatttattcttgatcggacttactgaatgttggattacttcactgtttttaaagaactaccttttggtttcactcatgtaatctgttttattatgtgctgttcatcttttcttttatctttattcatacctttacttactttagttgtattctgatgttcactttctatcttcctgagttgtatgtttagatattttacagtctttcttgttttctaataatttcttttcttctgagtggccttttatctctgtctttcagggttttggtaattggcactatcattatcatgaacttctacactggtaatttttaaacatttccttattagttcaacagttctttagaagaatgattttacctttacaagtgatgggatatgtgtgtgtataaaat

SEQ ID NO: 241973 - DNA, 190 bp, Homo sapiens
agtgcacaagctcggcccttctgggtacaaatcacaattagatggacagttaacttcagacacttatatgattaagtaattgtgtgttcttttatgttcttagctaatgttaatgttttcccttagggtttctgccctgtggtgatttcacttcttttccccccaaaggtttgataaataacagctaaaa

SEQ ID NO: 241974 - DNA, 399 bp, Homo sapiens
tcccacatggactgtgggtttggccatgagacttactttggttgatggaatgtgagtaaagagaatgatgcatgcagagactccataaactcctgtgcattagggcttgtgctcttggaatgtttctgcatcatgaacagctgccaatctagtctactagaggctaatgaggggctgcatggagcacagcccccattactgaacccagccccccaccccacctaccagttgaatttggctgtaagagtgaacccagtcaacccatagaattgtgataaataataaaatgccattgttttaagtcactaaattttagtggggcttgttgtgcagcagtaagtaatgaccacactttgtcaaacccgagcatctctttctgtctgtggctcctcaaaagga

SEQ ID NO: 241975 - DNA, 316 bp, Homo sapiens
tattttttctttttaattagatcttccaaggaacttcacaaacttctgtgtttataagaaataactggagttactttttcaacatacaggttcctgagccccactcagaccactgaattagtgtttggggatgggcataagcatcttctttttttaaccccttgtagagatggagatctcactatactgcccaggctggtcttgaacttctgacctcaagagatcctcatgccagcactttgggaggccgaggcgggtgggtcaggaggtcaggagatagagaccacggtgaaatcccgtctctactaaaaataca

SEQ ID NO: 241976 - DNA, 980 bp, Homo sapiens
taagttacaaaatagtgttaatggtttattggtaaaaatccaaactctagagtttatggaattcgtagtttggttggtatattaacactccatcttaatctttgctgctattacaaagaatgaggaaagctagaaatatctataaaaataaaataccttaaaaccgacaagcaaaatataaaagttgcatacaaattgccaataaatataaacatcacaatagaaaaattaatcttaacaaaaataaactcataattgctattaagacattataaaaacaaaaaagtttaatgtgcatgtatatttgcaaacagacacagtacactccaaacaatataattttactatcattattatataatgcagcatacaaggttactgaggtgtggtattttttgttgttgttgttgtttgcttttagtcttcttttctggaagaatgctcaccaaattcacaggaaagaagtgcctaggtgatcatttactgctatttactgcttcctggtatggagcaaaattgccctctggtaggtaactacatttctaattagtatgaaaggttctactattttcctttcttttgcttatttccccttaagcacaatttgcagaccctacttctatttaactgatcatacccttttaaatgccttgtcatcatttttcatagttcctgcatcctagaaaaaataaaaaatcatttaaaatattccttggtgtctagaaaagaaaatttctctaacaatagagattatcattttgctttctcacttaagctgatctgaatgatgatttggtactgcctttatgagcagtcctccttaataatgactaattagggccgggtgtggtggtgcatgcctgtaatcccagctacttgggaggctgaggcacgagaatcacttgaacccgggaggcggagtttgcagtaagctgagattgagccactgcactccagcctaggtgacagagcaagacttt

SEQ ID NO: 241977 - DNA, 629 bp, Homo sapiens
aagcttactgtaaggaagcagggtaaccattcacagacaggacaggcaccaaactccagcccgtgccagcactgtgaggtcaccagtgatagcgagtaaacagtctgtccagctcagcccggattccatcagccctgctaattcattgcagctggacaggagagccagccagctactcaaaacattgttgagtccctttgctgggcagctactcaaaacatcattggtcccttggccaccaggaccagtggagacatgacattgtctccagcagggatggctcacttctgtagatctgggcgccctctagagggctttccccctgggtaccaggactcacctggacagggtctgagtcaagtgctgactctgggaggaagggactcttgggaaaaagacacagataccctgtcatccccacagaaatcagaaaaggattgctcttgtacagctgaagtgcctgggagggaggaagggcctgcactgatatgagcagatggccagcacctcaccggccacttgtttgtcctggtttatttcctcaggcagctttccgggctccagaggtaaattgccagctgtaaatttctggcccttctccaagatgataataaactgtatttgaagta

SEQ ID NO: 241978 - DNA, 1304 bp, Homo sapiens
aagcttactgtaaggaagcagggtaaccattcacagacaggacaggcaccaaactccagcccgtgccagcactgtgaggtcaccagtgatagcgagtaaacagtctgtccagctcagcccggattccatcagccctgctaattcattgcagctggacaggagagccagccagctactcaaaacattgttgagtccctttgctgggcagctactcaaaacatcattggtcccttggccaccaggaccagtggagacatgacattgtctccagcagggatggctcacttctgtagatctgggcgccctctagagggctttccccctgggtaccaggactcacctggacagggtctgagtcaagtgctgactctgggaggaagggactcttgggaaaaagacacagataccctgtcatccccacagaaatcagaaaaggattgctcttgtacagctgaagtgcctgggagggaggaagggcctgcactgatatgagcagatggccagcacctcaccggccacttgtttgtcctggtttatttcctcaggcagctttccgggctccagaggtaaattgccagctgtaaatttctggcccttctccaagatgataataaactgtatttgaagtagcagagagtggtgtgtgaatcatttttgattactcagtggccgcttgagtataggtcttgtgtgggtaactttatatggaaaataaaaaggaattggtgaagtactaactgctgtctagaatcacttagtggttatattggaataacatgctatgaattaaagttaataaaacaccacagagagacattggaaaatagaggtagaagagacaagtgtttccctcccctgcattgtatgtattggtcttgcaatgaatgacccagatgttatggtaaccaagggtgacactagctgaggtagacagatgagcaggtaccctgcttatatgatcataacttggttcaatttttaataagttgacattttgaacatttttcatgcttagaaaaatgatcaaacagcaagccagcaagctcttccaacatgatctaactcagcagtctccaaacaggatgcccctgagttgttcaagacatttttagggtgagaaagaagacagcagagtttatatttttgctgatttttaatttttttccttaaaatttgagtatattttataagatacaccccatgttagtacagtagtatgcacgtattatttataaataaaccggactagccggatgtggtgggacacgcctgtaatcccagctactcaggaggctgagacatga

SEQ ID NO: 241979 - DNA, 1338 bp, Homo sapiens
aaaaaattttttcccccaaaaatttttttaaaaaaaaaaaagggggggtgtttttaaaatttggaaaaaaaaatttttttttggggattattaaaagggtgaaaaaaaaacccgggggaaaaaaaaatcctttttttttttttttaaaaaaaattttttttttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatca

SEQ ID NO: 241980 - DNA, 1874 bp, Homo sapiens
  misc_feature (1266)..(1266): n is a, c, g, or t
  misc_feature (1278)..(1278): n is a, c, g, or t
aaaaaattttttcccccaaaaatttttttaaaaaaaaaaaagggggggtgtttttaaaatttggaaaaaaaaatttttttttggggattattaaaagggtgaaaaaaaaacccgggggaaaaaaaaatcctttttttttttttttaaaaaaaattttttttttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcaaactcccgacctcaggtgatccacccacctcagcctcccaaagtggtgggattacaggcatgagccaccgtgccgagccttccttgaagtttttgtttggttttgatttgttttgtttcgttttgttttgtttgtttttggagatacgggtctcactctgnttacccatgctnggagtgcagtggcacaatcttggctcagagcaacctctgcctcccaggctcaagcaatcctcccacttcagtctaagtggctgggactacaggcacgtgccaccaggcccagctaattttcgtgtttgttagagatgaggtttgccatgttgcccaggctcgtcttgaacaccggggctcaaggaatctgcccatcttcgcctcccaaagttctgagatagcaggtgtgagtcatcatgcccagcctccttgaagtttactaacaatggggataactgagggaagagaagtgacaattccactcagtctattagaggtctggatataaaggtaggcacacaataactctaacttgacttctaaccattctatcttattgacttggaggctgtcttctggccagattttttgtggcttggagattgatattttcggaacccttcttttcactaacctttcttacactttaatgttgccaggcttgaaacagcgatttggaattcctgagctacttgttcggccttcctgtgcgtcacccaagtaatctggtccaacctttcggctccaatcaggtatttcccagtgacacagacatc

SEQ ID NO: 241981 - DNA, 449 bp, Homo sapiens
aaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaag

SEQ ID NO: 241982 - DNA, 450 bp, Homo sapiens
cacactcacaaaaatatacaaatgaatgaaaatggttatgacccacccatgactgcagtgggttcactgtcatctgatgtgatctataccacctgttcctatgtgactgagaggaccactggccatccatagcctgggaggttacatcatcactttgcacctcacactctagaaccagataaggaagaacagtgtcacatgagggaaaacttcctagcagttggagatgcccaacaatgagtgatcacattgttttaaaagtgagactcccattgctgatcaccctggagatttctgcatgggggcaccctgaacttgaaaatctctgaagtgcctcgcaagattcagggcactaaggtccaaaggagtgaagattggcaaactgataataactccccaaatctattacactgacatgtatcatcaaattaataaattccataaaaatac

SEQ ID NO: 241983 - DNA, 779 bp, Homo sapiens
aatgtgatattcacaaaatattttctaacttgtgctcctttttaattgttgaagaataggatgtctaatatgtattttctatatctagactttattcctttcttactatattcttacgtctgactttggccaattcactatctgttaatcctttcccatagtacaaaagggaaataaaagtagataggttatacctagtcatattaatagagacagaaagtagagtggtggttgtcaggggctagggggtatggggatttattgtttaacaagtagagagtttcagtcaagcaagatgaaaagagttctatggatggacagtagtgatagttgcatcgtaatgtgaatgtaagtaataccactgatatgtacatttaaaaatggttggccgggcactgtggctcacacctgtaatcccagcactttgggaggccaaggtgtggggatcacctgagatcaggagttggagaccagcctgaccaacatggagaaatcccgtctctactaaaaatacaaaaattagccaagcgtggtggtgcatgcctgtaatcccgaggctgaggcaggagaatcgcttgaacctgggagggggaggttgtgatgagccgagatcacgtcgttgcactctagcctgggcaacaagagtgaaactccatctcaaataaaaataaaaatagttaatgggataaatcttatgttatatgtattttaccacaatcttctttttaaaaactttttaaagcctgggcaaaaacttttgtgagatcctacctttacca

SEQ ID NO: 241984 - DNA, 414 bp, Homo sapiens
tcaaagccagaccatgaagatgtcatattttccctaaaactgaaagctccttgaatcaagggaacatggatatttgactcaactgctctagtcttgtagcagacaagacgctgcttccagctacagatcttgagaaggctgcctcgcacctatttaaaataacatgaaaatcagtagctcacattgcaaagccgaaagaaggaaatcctccaacttcagtcacttcagctgttcaaccaaatccttaatacatagggctcttttcatctctctgttcagctgtccactagaacagcagtccccaaccatttggcaccagggactggtttcatggaagataatttttccatagactggggcaggttggggggatgggttcaggatgattcaagtaaattacatttattgcgcact

SEQ ID NO: 241985 - DNA, 473 bp, Homo sapiens
attgaaaaaaaaaaaaaagggggaagcaggaaaaggtgatcatggtggaccacacaaagctttagaatgaattcttttgagtagcttgaaataaatttgttttagttgaaaggagaaagatcatggtaactgtagctaacttgggccccaaatcagggttttattatttctttaacatactcataattaatcaaaattcttattgttagaaatgaggtgttccaatagcacacaaatttcctttacaaagaagaagaaaagagatgaggtgaaggaaaaacggatgtgaaagccctatttataaaatgtaggtatttgacttcgcttagctgtgactgcatgcattaagaaattggagtgattcagtatgtatgtccaaatgatttgaaaagtaaagcattttttggttgaatttccacacatcttatatggagtttacagatttccattttatcattccagtccttgagctt

SEQ ID NO: 241986 - DNA, 350 bp, Homo sapiens
cacagccagtttttaactttaataaattctagcttaccagttaatgaaggacatcttggtttcttccatattttggcaaatatgagtaaagctgctataaatgtctgtgtgaatgtatttgtgtgcacataagttttcaactcctttgggtaaatagcaaggagtgcaattcctggatcatctgcaaagtcatcaccgtatccagggtcatccaggttttctctgatgttatcctctaggattttacagttttgcatgttacatttaggtctatgatctactctgagttaatttttgcaaagctcataaggtctttgtctagactcattttttcatgtggatgtcccatt

SEQ ID NO: 241987 - DNA, 2397 bp, Homo sapiens
  misc_feature (417)..(418): n is a, c, g, or t
  misc_feature (424)..(424): n is a, c, g, or t
  misc_feature (1187)..(1187): n is a, c, g, or t
  misc_feature (1417)..(1417): n is a, c, g, or t
  misc_feature (1483)..(1483): n is a, c, g, or t
  misc_feature (1553)..(1553): n is a, c, g, or t
tagaagatacttggtaaatatagtttattactctaaattaatataattccccacctgaaacaataaatgtagcatgcaatatattgttccctgtttgaggacagatactgctgcttattgatatttgcattgctcatactacccaataagtgatgatggttgaatgaatcaattaatgaatgagcatgagagaaaagccataagaactaacctcccattctaatccctaggccctccctgtttctcttactgaatgcctttccagattattgatgctttgcatgagcaataaggaaaaaggaagcaatccagatgggagcgtagctgtggtcagatgtctctgaaatgaacaaagtatttgcagatgtttcaacaagtggaggggttgggctgagtctaggtcacaggaaacaactnncacacnttggggctactacaataaaggtatcatcacttaccagcacaggattctgttggaaacttgaaaaggcactcagggttggaatgctacatgaatccagacttgtctcaggaatgccacaagtgatcagaactaagtatagaaattaatgtggtttgtaaaaatagcaataaggatcatgtttatctgggaatcaaatcctttaatcactttagacagaactaatgaaactagaataaaccatcattgattgtgagagtctccttctaaattagttggcctttggcttttagagagcaaagttcaaattccagttcctgtctgacaggaaagtaagtcagacacaaagtagatagtcttttagacttcaaactgaaacagcagggcataaaggagatctgagtcttgaagaacctttgctttcagagttgctgagttcagtattgctaatgcagtatttttcattgtgccttttgaggctgttcattttagatttatgatatttgcctttgttggtaaatatgttcaaatataaataaaaattttatatttcctaatgaaaaaattctaacttctactcttttgtgcatgccctgttctgaagcatgttaactttctagctgcatggtggataatagggcccatgtttatagatcccaactgtaaagataataagacacaaaggcatcttaaaaagtgatctgagcagcttctcgttctcgcctgcctgcccgctcgctcccttgcttgctcgcgctttccctcnccctctcctcgaggatggaggggactctgaccacagcctgtgactgggaagggagacagaggcagcggcggctcaggggaaacgagattgcagtggtggtagtaggaagatgtcgggcaaggatgagcagcaggagcaaactatcgctgaggacctggtcgtgaccaagtataagatggagggtgacatcgccaacaggggtacttcggtccttggtggaagcatctagntcaggtgtgtcggtactgagcctgtgtgagaaaggtgatgccgtgattatggaagaaacagggaanatcttcaagaaagaaaaggaaatgaagaaaggtattgcttttcccaccagcatttcagtaaataactgtntatgtcacttctcccctttgaagagcaaccaggattatattctcaaggaaggtgacttggtaaaaattgaacttggggtccatgtggatggcttcatcgctaatgtagctcatacttttgtggttgatgtagctcaggggaccaagtaacagggaggaaggcagatgttattaaggcagctcacctttgtgctgaagctgccctacgcctggtcaaacctggaaatcagaacacacaagtgacacaagcctggaacaaagttgcccactcatttaactgcacgccagtagaaggtatgctgtcacaccagttgaagcagcatgtcattgatggagaaaaaaccattatccagaatcccacagaccagcagaagaaggaccatgaaaaagctgaatttgacatacataaagtgtatgctgtggatgttcttgtcagctcaggagagggcaagcccaaggatgcaggacagagaaccactatttacaaacaagacccttctaaacagtatggactgaaaatgaaaacttcacgtgccttcttcagtgaggtggaaacgcgttttgatgccatgccgtttactttaagagcatttgaagatgagaagaaggctcagatgggtgtggtggagtgcgccaaacatgaactgctgcaaccatttaatgttctctatgagaaggagggtgaatttgttgcccagtttaaatttacagttctgctcatgcccagtggccccatgcggataaccagtggtcccttcgagcctgacctctgcaagtctgagatggaggtccaggatgcagagctaaaggccctcctccagagttctacaagtcgaaaaacccag

SEQ ID NO: 241988 - DNA, 223 bp, Homo sapiens
gaggtattatgtggataagtcacaaacatgatgcggaatggaagaaaagtaagttgcagaatgatacaaatagtttaatagtatttatgtcaggttttaaaactctcagcataacccagcattacctttgtctcagaatttattacagtcttgcccattcctcatatgcatactaaagacctaagaaatattcactctaaaaataatagaaaatcaaggttaa

SEQ ID NO: 241989 - DNA, 319 bp, Homo sapiens
acacgtggctccaatggttctgacttgtttttttcctagtatgaccctaatacagggggcaagttagaaaatcagagttgcccgggcatggtggctcacgcctgtaatcccagtactttgggagccaaggtgggtggatcacttgaggccaggagttcgagaccagcctcagcaacacagtgaaaccccgtctctactaaaaatacaaaaattagttcggcatggtggcaggcgcctgtaatcccagctaaaggaggctgaggttgcagtgagctgagatcaggcacttcagcctgggcgacagagcgagactgcttca

SEQ ID NO: 241990 - DNA, 291 bp, Homo sapiens
aaaggtcatttttggatatcaagtttattaatccctcctgctgcctccacaattatttcctctacaaaaatatcaaatcccaaagaaagacattcctacaatttataatttagtttatgaaatgtattaattacatatggattttatcattaatacatcattttgtattccttaatcctttctaaccaattagactatcaagtcctgtggccaggcagtaattacctatatatctttttccttccttagcaccagagtgaatataataaaataaatatgcacttgattcta

SEQ ID NO: 241991 - DNA, 292 bp, Homo sapiens
cagaggaaaagctaagttactctttattcatagagggagtacaaggaagtttaaagttaacatatgagaaattggaagtataagcgtattcttggagttatggaagtagctatcagaaaaagaagaggaaatgttcaacaatagctatctctgaggaattagactggaagaagaggattaaatgaaaaatgaaaacctctggttttcattttgtatctttctgttctctttgatattttatttctatgtgattatattatttttataattaaaaataaattgatctcttttg

SEQ ID NO: 241992 - DNA, 447 bp, Homo sapiens
caagagctggagatcgagactatcctggctaacatggtgaaaccccgtctctactaaaaatacaaaaaattagctgggcgtggtggcaggtgcctgtagtcctagctgcttgggaggctgaggaaggagaatggtgtgaacctgggaggcggagcttgcagtgagccgagatcgtgccactgcactccagcctgggcgacagagtgagactccgtttaaaaaaaaaaaaaggaaagaaagaaaaagaaaagaaagaaaagaaaagcaagagctaccagaggtgagagcacacaaaggaatgaccaagtgaagaggcagcaatagggcagccatctgcaagccaagaaagagtctcagaaggacctaaccctcctgaccccttgatcttggacttccagcctctagaactgtgaggaaataaatttctgctgcttaatctacccagtt

SEQ ID NO: 241993 - DNA, 626 bp, Homo sapiens
  misc_feature (575)..(575): n is a, c, g, or t
catctccaccgtgggctacggagacatgtacccagagacccacctgggcaggttttttgccttcctctgcattgcttttgggatcattctcaacgggatgcccatttccatcctctacaacaagttttctgattactacagcaagctgaaggcttatgagtataccaccatacgcagggagaggggagaggtgaacttcatgcagagagccagaaagaagatagctgagtgtttgcttggaagcaacccacagctcaccccaagacaagagaattagtattttataggacatgtggctggtagattccatgaacttcaaggcttcattgctctttttttaatcattatgattggcagcaaaaggaaatgtgaagcagacatacacaaaggccatttcgttcacaaagtactgcctctagaaatactcattttggcccaaactcagaatgtctcatagttgctctgtgttgtgtgaaacatctgaccttctcaatgacgttgatattgaaaacctgaggggagcaacagcttagatttttcttgtagcttctcgtggcatctagctcaataaatancgatcggccgaagatatctgaaaataaaatccaaacatttagtaaaaagaa

SEQ ID NO: 241994 - DNA, 417 bp, Homo sapiens
atatatcagtcagcatataatatgaaaatgacatgtatttgaatataagtaatcacaacaattattgagataaagcataaaggttaaaattttaacattcaaaatgaaaacaaaaggaaactggaccaggcacagtggctcatgcctataatcccagcactttgggaggccaaggcaggaggatcgcttgagcccaggagtttgaggccagcctggacaacacagcaagactctgtctctacaaggaataataataaaaaaaaaaacgagccagacatggtggcatgtgcctgtagtctcagctactcaggagctgaggccagaggatcacttgagactgggaggtcgaggatgcagtgagccattactatcccattgtacttcagcctgagttacagagcaaaaccctgtctcacc

SEQ ID NO: 241995 - DNA, 384 bp, Homo sapiens
gtagggaatgtagaacccaataggtagtttttcaaccctttccccctcctcccttccacttttggaatccccagtatcaattgttcccatctttgtgtctgtgtacccaagtttagctcccacttataagggagaacatgcagaaaatacccattttaaaactgaacattttacttttatttggatatttaacagcatgtatttatgtatttacatatgcccccctacttccccaaagggtttgagatggcaacatcataaagaaagccctaggttataatttgctctagaaaacctctagcgtaatgccttacaaaaacagtgtttgaaggggaggagtcatgagcttatgtaaacacagcaccattaatttaagtagtaaac

SEQ ID NO: 241996 - DNA, 554 bp, Homo sapiens
ctgtctcccatcatgccaacatgtgatcatctagttgcaggaaaacaagctcagggctcccattgattctacattatgcacttgctacaggggaagtgaactgctatgtcctgagataactgagaggttgtggagagtgactccatgagtctgtggagaggtcaatatgacaaagaactgaagcttgccaatagccatttgagtgagcttggaagtggacctttccccaggctgactcatgactgatgactccagggaaaaatcaagacacaggagaggaagggtattcccgttcatcccagtaatgctaatcgaggaaatggtcctcgaggaaatgacgctgcagcaacagcatcacctggggacttgttagcaacagaagttctcagactccgccatagaactactgaatcagaaattctggaataaggcccagcattccatgttctaacaaaccttccaggtgactgtaatgtacattcaagtttaagaaccactgtaatagacccatttcttggttgattaaatggatcttatattgtaaataagcagaa

SEQ ID NO: 241997 - DNA, 362 bp, Homo sapiens
  misc_feature (35)..(35): n is a, c, g, or t
tgtaatccttataatgcgggtaggaataaagtaanaaaatcagctgctcagtctgatgctccagggaaatatcaagaccaggagaggaagggtattcccgttcatcccagtaatgctaatcgaggaaatggtcctcgaggaaatgacgctgcagcaacagcatcacctggggacttgttagcaacagaagttctcagactccgccatagaactactgaatcagaaattctggaataaggcccagcattccatgttctaacaaaccttccaggtgactgtaatgtacattcaagtttaagaaccactgtaatagacccatttcttggttgattaaatggatcttatattgtaaataagcagaa

SEQ ID NO: 241998 - DNA, 358 bp, Homo sapiens
gactgccactccctcccagcctttcggttctttaaaatgaaagataaacctcaggacaaccaagacctggggaaaagacagtctttgggaatgtaatttggaagaatggatccagaaaaacaaccaggggctcttaactctagtttcggcaggagatcccgagttacagacctgagctcgtaaacaaacgctcaccactttacagtcgccgcctcatcctgaaactccggtcagaaatgctggaaggcctttgctaatgcgcagtgaaaattaggggcacagatgtggacggactgtgcttggtcagtaattgttctcctccaaatcaagtttatgagaaatttcatataaggaaaaa

SEQ ID NO: 241999 - DNA, 332 bp, Homo sapiens
tgtagtccctctggtcaacttttcagaatttccttttcaaaaactgggataaatatatgatttaccattttaacagtttctaagtgtatagttcagtgacattaaggacattcacattgttgtgcaaccatcaccaccatccacctccagaacatttcatcatcccatactgaaactctgtactcattcaacaacaataactcccagctgctacagtggctcatgcctataattccagtgctttgggaggctgaagaaggaagatcgcttgagcccaggagttcaagatcagcttgggcaacacagtgaggccctgtctctacaaaaaaaaa

SEQ ID NO: 242000 - DNA, 401 bp, Homo sapiens
ctacaaagctatagtaaccaaaacagcatggtactggctaaaaacagacacatagacacatggaccacaatagagggtccagatgcaaatccatgcattaatagccacttgattttcaacaaaggcaccaagaacatgtgttggggaaaggacagtttctaataaatggtgctggaaaaactggatattcacatgcaaaagaatgaagttggacccataccttacacgatacacacaaaaagctcaaaatggattaaagacttattatgaaactactagaagaaagcataggggaaacacttcaggctattggtctgggcaaagattttatggctgagatttcaaaagccctggcaacaaaagcatataaagaacttgaacaactcaacagcaaaaaatcc

SEQ ID NO: 242001 - DNA, 439 bp, Homo sapiens
ccagactgctgaatggggccttaatctccccatctggacagtggaggagtctgaaccgttcatctgaaatttccttccggctctgtggtttcaggtatctctgggagagtgggcatgttcaggagcagagatttgtcacgggggaagggagttggggagccggaagggacaggagaagctttcagtctgggtgccacagtctcaggttcaactcttgacattatcttcaaatgaggtaatttctcctgtctcagtgctgcccagttgggtaaaagaaacagttcatcctataatgttaaacttggtcctattaacagaccacaccatctgtagcatattatgaattaattaaaaataaacctgtaattatcttgttaacatagcaattatattacattgtaatttttttgttaaagcattaaattgttaatattcaaga

SEQ ID NO: 242002 - DNA, 272 bp, Homo sapiens
gagacggagtctcgctctgtcgcccaggtgggactgcggactgcagtggcgcaatctcggctcactgcaagctccgcttcccgggttcacgccattctcctgcctcagcctcccgagtagctgggactacaggcacctcatgtttcttaaaagaggagcctacacttcctgcccgacatcttaaactgtcacccatttctcaatccaacataatctgtcttttattaatattttaaaatgacagatatcttttcacccttcactattttttc

SEQ ID NO: 242003 - DNA, 448 bp, Homo sapiens
gggctgcttttcataaagacagagtcagtgttgctgagacacaggtggaaagtctttgtgcttgcttctttgatcagccccactcccttccaacagagcctatcaagtttgcttcctaatgagggcccccgagtgccggctgtgatgggtggaccaggctgagggagggccgggagccaggggagccactcccagctgccacccctgaggtctgggaggcaggagccccacccgtgatcccctttcccttcttttactctcccttccctgtttctcagtgcatgtcagggagaggtcccccactgaacaatttttaacttcaagatggtgcagaagcgatacacattcagtagaatctttactttgagttcctacacaatcactctatttttcactttcagggcagtgttcaataaactgcataagttatttaatactttattataaa

SEQ ID NO: 242004 - DNA, 597 bp, Homo sapiens
tcggcttactgcaagctccgcctcccgggttcatgccattctcctgcctcagcctccccagtagatgggactacaggcgcccaccaccacgcctggctaatttttttctttgtatttttagtagggacggggtttcaccgtgtcagccaggatggtctccatctcctgacctcgtgatctgcccacctcggcctcccaaagtgctgggattacaggagtgagccaccgcgcccggccgacaaatacttttatgatagtttgtctagcttgctagtgtctcctcctatgaaaaaaggtagatgtttggacattgatgtttttgagaaattaaccattttcaaaatctattcttcataaattcagcatttctcatgggaataatcttagatctagcccttgtaagctaggagccatatgattaaatattcaaaataggtcctatattaaatatatgatccaaggctcagaatattaatactatataagatgcatcttgtttataatcatttattacctgtggtaaagaatgttgaatttatagagtatcacagatgcattctccacccctccccctcagattatcttctgtctcaaaaa

SEQ ID NO: 242005 - DNA, 473 bp, Homo sapiens
aggggaggtggaatgactaagaatttacatagttggcagagaaaaccaactccctaagccaaagaaagtaacttttgaaccatatgctttggtttctatcacacataattttatttcacaactttggagcactaggctacataaagacttggatcccattctcaaaaatctgagagagaagacaagatgagtgcacacaaactgtattataaagtacaggacataatgtgaacgtttataaaggtgtaaggtgtgtgtgtgtgtgttcaagggagagatcacttgcagtcctaaattctatactatataggattttcacttctatgtgaaaaatactctttccttaacaagtcatggatgaacgttttgaaaagtatggtctatagaccacgcacctgcattttaacagcctcccaggtgtgatctctggcacaataaagattaagagccgctgacgtaaacaataaatgtta

SEQ ID NO: 242006 - DNA, 426 bp, Homo sapiens
atgaatttgggacttgtggagaatgagggaatggagagctagcaaaaacctaggatatatggatcagtatgaaaaccagaaataaaatgagctaagcagtgagctgtgtgcctggaacagagatgaagcaggaagcatggccccttccttgagttaaggaacccacaggaaggtatttgagcagaggcgagacagtcaaaagggcattgaaacagagacaagctgcccgatgaagcaacaccatccagtgcagctggactgtggacacctgtgtccttaggttttcatacattgtgagagcttcgtttacaaagtgcatgggataagaggaggggcaccccaaaagaaggaaagcaggaaaaggcagggaccccagaggctcagtctctgcagagggtattactgcctcacagatgttggccaaag

SEQ ID NO: 242007 - DNA, 838 bp, Homo sapiens
gactttgtaaactgatttcagagaagcgattaaggaattgtactgtctttaaacaatatttagaatgcttcagtaaaagcatttttaaaaaatttttctaatgatgtagtaaatgtacctaatataaagttaagtggttttatttaatacttttcacctgaccatgattatgttataaataagaggatttatagtttgcatgcctgatataatctatttaatttcctttacaaaatttttgtacatgaaagataaatgtcttcattttaccagctacctccttccagattgaatgcttcagtgcactttgattttcaaattggctattattttttaatgtaattaaccttcacaatttaaattgaaggatattctgatccttaggttataaatatgtgacttgatggtttatgtaacattcaagtagcatgttttctataacaatatgataaaagttttgatacataccttgtatgttgcttgacagatctgttttagaaaacattcctctgccttttgaaatgaagccatgtatttgaaattatttcccaaacaattatatcttaagcgtgtgctacatagtaatcatagtcattttaatttagattataaagctatattttaactttgaggtttgtgaattttcttagacatattaatgactttatagttaatggtgctctcagattttatttttaagttaaaaatttgccaggcgcggtggctcacgcctgtaatcttagcaccctgggaggccgaggcaggtggatcacgtgaggtcagcagtttgagaccagcccagccaacatagtgaaacccccatctctactaaaattaa

SEQ ID NO: 242008 - DNA, 828 bp, Homo sapiens
aaggcatagacttttagacacttgtaatctctgacttaagccgtgtcaatgcccaaaggccaccaataacacacccgtagttaaacaagttgggtttattactcattgcattgagagagcatactccatggggaaccctggggtgtttcattaggagggtgttagaactgattataggatttgggtgttggtgattaggggaggggagggttaaggaggttgggtttcacttcagataagatcctgtaagaaaatatgggagtttcgtggttgggtatctgaataaatcttacctgtagggcagggagactagtataagaacaaaactgtaattgctacaggagtagcagtcactcaatttggccagagggtgtttggtatttcgtgagtggcatagccactatgtatttgtctgtgcttataacaaaattgtgaaatggcctttgtctcattttatgaggatttcagagtaaccttgtctgaggttggtattctgtgagattgtttatgtcccataggagaataacatggcctggctgtgagtgctatgcctgcttctggagtgtcacgggttgccttttttttttctttctcaactgattgctctatgcagggcctgttgaaaccagtggttttacatgtgcagatttgttatttaaaaaaaaaaaaaagaaagaaaagcagccgggtgtggtgggggcgcctatagtcccagctaccaggaggctgaggcaggagaatggcgtgaacccgggaggtggagcttgcagtgagccgagactgcgccactgcactccagcctgggggacagagcgagactccgtctca

SEQ ID NO: 242009 - DNA, 331 bp, Homo sapiens
agtataaagtaatattaaaattgacattatattttgacatcttgacttttatgtttgtagttcagtatttcatccaaacatttctcaagaactttacaaagatgattatatatagaagaattgatgcaaattttacagaacttaacagaaatgattttatacagaagattgataaaacgtcagttctcatcagttgaaagtggaagagataacatttgtatgtgttacattttttcatgttagcaattattattaaacacttattttcctgtagtactgtaaaactggaaaacaatgagacatgtaataaagtatttattctctctctctc

SEQ ID NO: 242010 - DNA, 586 bp, Homo sapiens
catctcaaagagccttggtgtatgtgcaaaacggggccatctgcatgggcgttgggaagatcacagaacctggacccttaggatgacccaagggtcagttgcatactgtttgtttttgtggagtcaatgtcccatgacggttttcgcgatgctttgctagtaggagcagtggcgtgtgaggctcccggttaaataccatgagattctaagcggaattctgggtctcctggtatgcacaggtaaaattacagtagacctgtcccactctttgccagaacctcgtacttgtctgcagtttgactggaataaggggtgtttgtgttccacctccctccaacgtgtgttgagacatttatttatttatttatttatttacgttgctcttgttacccaggctggagtgcagtggtgcaatctcagctgctcaccgcaacctctgcctccctggttcaagtgattcttctgcctcagactcccgagtagctgggactacaggcacgcgccaccaggcctggctaattttgtatttttagtagagacggggtttctccgtgttggtcaggcgggcctggaactccgaacctca

SEQ ID NO: 242011 - DNA, 807 bp, Homo sapiens
cttggtaaaactctattttattttttccgtttttttcttacctaaatgaacacttaaatttttggttgatacgatgaaaggattttgacacagtagaaacaaaacagacgtgttgtgagttttattctacctcccctgacattgcacagcttcctcttctgcactcgggagataataacgtgcacctgccttgctcataaattcatttaaataaaatacccaaagtcaagcctgaaattgtaggcactcaggaaaggccggtcatgattttactcctgagttttaaaacattgataaaactgtcatgggaaaagagaagtcagtgtaaaaaacgagacacatcacaaaaatgaaagaaatgtaaatggagagcccttccttgggtttgcccagggagacaggcgggtaggaagaataaaggagcccaagatactgttactttttcctgccttggacagtgttcccggcagctgctgcaaccctccgtggctccggctctcactggatagccctgcacttccccccgccctaccccgctggagccctgaaactacctccttcccttattccttcaatcttgcttagaatcggaggactcctcaccatcatcacaagcttgaagtcttggatcttccagcacgtatgcaatccttcccccggaaaaaatttccaatatttaaatacttgcagtggtttctgtttttccactgggactcagaatggataatttatgaacatggttaaatattaaatcagtatgtgtaaggttaggtgaaggaagtatctgaagacatgaagcaaagagca

SEQ ID NO: 242012 - DNA, 621 bp, Homo sapiens
tgtggtgggtttaggggaggaagtatgtttttctgtgttgctccaagtttttctgtttaaagcatgtattttgtaatgtttgggggaaaccaaatccatcaaaataaagtgcaagttttgtaacctgaaccactcattgaggtacagaattgaaatgtatttagatgaaactcacaggtattttttcttggagaatgtggaatattttatctatagtgcagctgtgctgtcatttatgccattttttcctcctcattgtgattcttactgtttggggtgaaagatgagtagtattttaaagcccgtaatgtgtgtgagtacacacgtgacatcttagtaagattcattttgtgtgagaaataagggaatttaggcttttgggttacatttgttttcaaaacatgttaataggtgacaaaaatccagtttgtttagatttgtatgtagtctgcctggaatgaaacttttttatacttacatgatagccctgattaaataaaagtttggtgaaagccagcagggtggcatgtgccccatgatcccagctactcttgaggctgaggtaggaagatagcaagttcaagcccagcctgggcaaaatagcgagaccccatctcaaaa

SEQ ID NO: 242013 - DNA, 424 bp, Homo sapiens
cctaaacattcctggttgaaacactgagtagtcttgatccaaacagtaaagatattttttggctcatatttgaaatactcagaaccaaataaaaataataatgcttggaaacttggaagttttttaaatgcttaagaaatgcttaatttatcactcacattctgtattggttttccaagttcattctcttgtaattatttggctttttttttttttttcccagaaagcacctaaaaagtaatggatgggtacttagtactcttatgcttttttcttcttagtcacactcatggatattgataaactgatgtgttctcattggtattaataatgataatccttatccaaaatgtacttcataccaggtactgtgtaagtgctttaaacaaatcatctcaataaaataatatcattatgtaagaaa

SEQ ID NO: 242014 - DNA, 319 bp, Homo sapiens
gccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgtt

SEQ ID NO: 242015 - DNA, 429 bp, Homo sapiens
gttctctccagaatctgtcagtttcacctaccgactgcagagaccctgcaaaacactcatgagacatatacattgggtgcatgaagcccttcctgtttctccctctactggggcagagagagagctgattccaagcctcgggggagctcaggaggcagagaaccttctccccgtttccacacctagatttcaaatcacacccttccctgcatactgcagaggccagcaaggcccccttccagaccccctggcctgggcctcggctcttgtaattgtaggacctgagtggcccaggatcctggcaccagctccgcctgtttggtctttggctctcctggcactgccagagaatggaaaagctggtctgtttacaggacatggggccagaagcgcattaaaaaataaggagcaaataaaatgtcataaaca

SEQ ID NO: 242016 - DNA, 680 bp, Homo sapiens
tagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactcgcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcactttatgaggccatcgttaccctgaggccaaaaccagacagagatattctaaaagaaaagtctacagaaaaatgttcctcatgaacatagatataaaacttctaaacagacgtttagcctatcaagtccaaaaa

SEQ ID NO: 242017 - DNA, 332 bp, Homo sapiens
cagtgagccaagatcgcacctttgcactccagcctgggtgacagaacaagacttcatctcaaaaaataataaagacctttgcaagttctgttgcttgctcactgttgcaagggttttggagctattggctcgcccgaggccccttctgagctcaaatgccttcaggggaggtttttggcatcaagaggagagctctttccttctccagagaaacctcagatgaaagtgacaatatcctagaccctgcattgtgaaatggggcttgaattttagttctgaatttttattttgaagattatggaataaaaagcaaacagactggtcaaaaatta

SEQ ID NO: 242018 - DNA, 371 bp, Homo sapiens
ctgagtttataacttagtcctattctagtttggtacagtgaaaaaaggacttaggtctggattcttattccatgctttctgtctttctatcttgatgccattgttattttggatttttcatcactctcagccaaaataatcttgatgcaaaagactgggcttaatatctaccagaatttaaaattcacatttttttaacccagcaataccacttataagattatatcctataaatatactggaatagcattaaaatatataataaaaatatcaaaagactgtgatatcaaaagaatggaaacaaactaaataaagatataataaaaatatcaaaatactgtgctatcaaaagaatggaaacaaactaaata

SEQ ID NO: 242019 - DNA, 342 bp, Homo sapiens
caactggttgactgattgattgaatgaatgagtgagtgaatgaatgactaaacagagtgaactggcatggggatcaaagggaagcagagagagaaattgcagtggtgagaggtaatggacaagtgggaaaaaatggggagacagaacatttttctctaaagattttttttcttgttgttttctgaataaaatggggagggagggccagattgttccagcgagtgttttcattcttcaataatcccttaaacaagccatcaacaaaaccaacaatccaatttatacgtaattatacttgtaaatttatttgacaaataaataacatttgtaaaataatttaaa

SEQ ID NO: 242020 - DNA, 196 bp, Homo sapiens
agttttagacataataatggcatgaatacttagcaaatggctattttgaaatttaccaaaaacaatggcccatggtagggataggaccatagaaagggagattatttggagaaactagtggaaataagatttagagttttatttatgttggagtgacaggtagcgtattcaatggccaccagagagaccggtaaga

SEQ ID NO: 242021 - DNA, 380 bp, Homo sapiens
taattttttttctccacgtgatgcattcccgtggcacactccgcgcacatcaaaccccttgcgcctttattgccggcgatgccccggcccgcgttatcagccccacacacgcagccctctctgcccgccatcaagaggtcacttctaatgactaatcgatctcattagctttcctaattaaaaactttactaccgcaatggaagacaaactacaaagaaactgctggcatcatatgtgaatgggatatgagcccatccatcagcagggtttgagctcttgcacacggcaccatgccctcaggccggggaccaggtgggacagccctcaggcacctcgagagccctgctgtgtaccaagcaccacatgcccaatgacgcat

SEQ ID NO: 242022 - DNA, 697 bp, Homo sapiens
ccatatcacccttctcttgccaagattctcttgtcattggatggaaacctggccaaacagcaggccttatcgcatattcttacagcattgcaaatcatgtatgccagagatgccgtagtgggggccctgatgccggccgccatgatcgccccggtggagtgcccctcgttctcctcggcggccccttcggacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcc

SEQ ID NO: 242023 - DNA, 506 bp, Homo sapiens
ccatatcacccttctcttgccaagattctcttgtcattggatggaaacctggccaaacagcaggccttatcgcatattcttacagcattgcaaatcatgtatgccagagatgccgtagtgggggccctgatgccggccgccatgatcgccccggtggagtgcccctcgttctcctcggcggccccttcggacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagagggtggcagatatgctgttggagctctgtgtcaccgagttggaggatgtggccacagactcgcagagcggccgcc

SEQ ID NO: 242024 - DNA, 1636 bp, Homo sapiens
gggagggctgactttgggaattagggaactgcagaaatacacatcccagggcagacaggatgtgcacagaggacaccaggaaggcagggagtaagaaagaagcatcaaaaatgaggtgaggatttcgaggaaaactgttcttttagcaaaggtggcatgaatgctttgcttgaatgctgcttgtctttaagatattgctaattctcaatcaactagaaaaagctgacatctctataaagagaataaattcataaaatgcaaaggacaggcacaacagagtatttagtaagtagtgcgtcatctttattagagaggtacatctaaactaattggaggcaaagttagtttgaatgaatgatagttcacatggcccaggcaactttggtttttagaataagtgttagtaaatgatgtttttttgctttcaagggcagagagtaactggaagtgggtttgtgattagcatatctaatgtccatttagggtgaaaccaccattctgaaatcatgccgcatgatttgtcctgcccctggtcatgttcctcctcctctgccattctcatgatatctgtgtttgcctgggtgccatgtgaccgcatctcatggccacttcacgctcagtgcgttccaggcctctgaggtcattcccagtctctgttacccacaggactctgtgtacccgcttctctgacctcatcttcatcattctctaccttctgaaccccattcactatcgtcttctgaaaatcccaatatcctcaatctttgctggtattgtttgccttcccttcttgttttaatggaaacttggctcttccccgatgctttaccatgaaaccctctcaaggggagctgttttctttcccaaatatcacatgccactatctatgaaggtgaggtaggtgtcctctttgattcccattcatgttcccagtctgtgtgttctctctagaaatgtccaggtttgattctcatatagtactcctctttcatgtatctactcccatcttcaatttattggtcctatgtccatttcacaatccttcacccagttcatgtgttcacttccttctttacccagtttaaattatatgttcaattattataatcactcccatgcatatagtcatctctcttgcactaccctcaccatatacctatttatccaactaccttggataaacctggctcttcccctgttctgtccctgcacagaggcagttaaggcagaaaatcacacaccaagttcataaccaactaacctcggtgggccctgagtgtttccaggcaatcatgctattttctgactttgtttactcactctgctagacaattatttcatcttttcctcctttttcttccatttttgctctataacaatgtatatacactctacaggccatcattctatacctcatttaagccattgttatcaagggtttacccttaaagatcattgttgagtaatcacctgggcctgtcgtggggtcggcggaggggggatggatagcgttaggagaaatacctaatgtaaatgacgagttaatgggtgcagcacaccaacatggcacatgtatacatacgtaacaaacctgcacgctgtgcacatgtaccctagaacttaaagtataataata

SEQ ID NO: 242025 - DNA, 421 bp, Homo sapiens
tgctccccaaggctttctgcttttatttttttgagatggaatcttactctgtgccactgcactccaacctaggcgacagagggagaatccatctcaaattttaaaaaataataataaggagggctgggtgtggtggcacacacctgtaatcccagctactcaagaagctgaggcagggccaggcacagtggcacacgcctgtgatcctagcactttgggcagccacgtttgaggccagcctggccaacatggtgaaattaaaattacaaaaattagccaggcatagtggcgggcgcctgtaatcccagctactcgggaggctgaggcaggataattgcttgaacccgggaggtagaggttgcagtgagctgagatcgtgccattgcactcagcctgggcaacagcaaaaactccgtctcaa

SEQ ID NO: 242026 - DNA, 294 bp, Homo sapiens
gctacctctgtgccggtggccactcaatgccatgtgctcccagatgctgaggggctccacagctggggttcaggtggcagaaagacggtgcgctgcctgttgctgtccatgccatcccatcgcatgagaggcacaggactgattcctcagaaaccccagcccaagaagcttcgggcacgggaagacccagctcacacagggctgggctgggcgtcacggagcacgggaggagccagttaccatctgtgctctgaggcctgggccctctgccgctgtcccctgctctgctgcaat

SEQ ID NO: 242027 - DNA, 378 bp, Homo sapiens
acaatggaacagagtagaaaacccagaaataagaccttccacctacaaccgtatgatctttgacaaacttgacaaaaacaagcaatggggaaaggattccctgtttagttagtggtgctggggtaagagttcaaaacagacacacacactctcacacacacacacacaaacagcaactcactagacaaatccgccccgcagatatgtttggtttggactatgcaatatttgtaatatgaattagttactaacatttaaaaattgattgcattaaatgagaacatctgagaacatttggctttgcttgaagaatctaaagatgtggctaaattgggcctgcattctatgtcaattttcatgcaaatattgaccagaact

SEQ ID NO: 242028 - DNA, 466 bp, Homo sapiens
tccttagttggcattgccagtttaatatccagcaaacattaatcactaacagtaaatgtatagaagacgtttcatatacatgtccaaggatgctttgtcagtgaaagtgtattgttacagagtcctccagggttgctaaataatcactagggaaaatcttagtttgacctcccccatacccaccataagattaaatgtagcttctcttctttggctggccatgaagaattttaaaaagaaatatttagtgtggctaatgtgattgactggaatatgtatttggattatcagtgcctacttcctctttctcttcagcgtccatcttttgcatatttaagagtacttcggctgggcgaagtggctcatgcctgtaatcccagtaccttgggaggccgaggtgggtggatcacttgaggtcaggagttcaagactagcctggccaatatggtgaaaccctgtctttact

SEQ ID NO: 242029 - DNA, 415 bp, Homo sapiens
tggtgtaacagtatcgcatgagccaagactgtcatgaaactatttggatactgtactctggttccttcatctcctccatctgcatcagcctaaattgtcctattgttacaggagcctctgccatgaacccggggataagtgaggaaagaaatttttcctccttcacagtatcaagtgccaggccagggcactttgtccaggcctcactgtgaagaaagagtaatgttcaaggatggcagcaggaaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagactctatctg

SEQ ID NO: 242030 - DNA, 513 bp, Homo sapiens
aatatgggaagctcacagcttcacagtttgttccatggattggattacattggatttctgaacacagaaaaagatggacattgactgttgtgttgacatttctgatgatcacttttaatgatcacatctgtatacctggagcctcaacacctaaatggtcgtttttactctttgagaaaaaaaatcagggttcttcctacagagaggtgctgctggttacatgtgcccaaaatctaccataaatacagcggcacatgactttagcctcttaggcatcaacagcttgcaggctgctctcagaacccacacatcctttaaccacccaggaagacattcttcctttctcagcattctttaaggatgataaatttagatgcttagtaataaatagcatcccactcattgctgacaatgcagtggggatatttccattccaaataaggttctttttttatgtttttgttttcttttctgataaaagagggaagttctgctaacttctgatgtctatct

SEQ ID NO: 242031 - DNA, 507 bp, Homo sapiens
tgcatagtggttatagaactttacctgtgtgataaaattttgagaattgttgtgaatccttgtgttccatatgactttggaaagaatgtatagtttctgtatactcccttttaaatatgttatattcatttgtttttaaaagtgttggttttgtgctttaaaaatatctcttaaaagtattcctatctattgggtgcaaaattctcttatatcaggctttctaatttggttgttgaaaacttttcactccttactaatttctatatgcttgatccatcagtttctacaggggcccattaaaatctatttttcttcttgatgttattctgtaaggtattacttattttgagcaataataagtgatatttatttgttatcctttaatcaaatattgtgaaattcttcatttcccattgttgccttattcttgagtgccaagatctcacacattcgcctcagtatgaactgtatcaaataccaatttataaagataatatgaaagacgaa

SEQ ID NO: 242032 - DNA, 2481 bp, Homo sapiens
  misc_feature (863)..(863): n is a, c, g, or t
  misc_feature (2296)..(2296): n is a, c, g, or t
aaaaaaattgctctcatgactcccaagcagtatccttatcccttaaccattttgattagtacaagaaagaaggagtttgaattttattgctgtttttggaagaggattttgttggtcatccaatcctttgcaacaaatatgtcactgcctcttgtgagaggcacttcccagcccagaagggggttgagcctgttgtcttactaggttcatctcaccctccttattggacatttcaaatgagtttcagtcttttggctgctgagagagccaggattgatcttgtttttctcctccctactccttagctttctctatatttgactattaagaataaaggttaggatttctataagtggccttgccctgccttcctatttcctattctgtcatggtgcattacaagtgacatattaatccagactggctaaggcagtgtggtggggatgaagatcactgtgaagaacagtgatacccagaccacattcacacggcactttcagcatgcacagcatctccaccgtcctttcttcactgacagtcaggaaaggcagctagtgtgataggtgaggatgcgtagaggttgtgacatcctttaggtgagaactgatgtcaaagcaacctgcttctgactcagaattgctgtgacttgagaagtctttgaaggcataataatatcatgaagctgctagggcattttgaacattaacttcagcccaaaaaccacacctgcactttcttttcctctcttcagggtgccaccctgaccttccttaataagaataagaatagctaacattattgcacacttactgtgggtcaggcactgtgctaggtgcattatttgttccttttctctcctttantctccacaactctatgggataagtgcaattattatctctactttccagttgagaaaattgaggcttgagggaataactggcccagtgtcacagagttaactggtgaagctagggttctcactcaggcaccctagcactagatcctgtgctcctaagcaccaagccatggtgccctgttgagcatgtaacatttaaaaggccttgactaagagttaggagaaatgtgttctaatcgtggtcctgccattaaacacagtgactctgaccagtcacttcccttctctgggtctcagcttcctcaagtgcatgatgaagtagaatgagatagctcatctttaaggttcctttgctctgtgtggctcttgacggtctaggttcccttatgtggacagagatgagaggttgtgtattagtgtttcctagagggacagaacttacaggagatacatatatgggggtttgttaagtattaacttacatggtcacaaggtcccacaataggctgcctgcacgcttgaggagcaaggagagccagtccgagtctcaaaactgaagaacttggagtccgatgtttgagggcaggaagcatccagcacgggagaaggatgtaggctgggagaggttggttattgcaggaagtgatttccaagcccattttcctagtgttattggaaaatttcaatttgtcagtttctcagcttggaaaagtcacctgaatgactcccacacctctacccactcatctccctgtcttgtggggggtatctgacctctagtactggtgccaggaaaggtgatagaacagtggttctcaattttgatttaattcatatgaactgtggctcgggcatcagattaaggcacatcaggtgattatggtgtacagccagggttgagggtcactgtcttcaaggaaacttctacacctcttacacagtggtttcacctgcagaaggaggcacctgtcctagactgctctagtgttcacaaccaatgataaatctgctgtgggtggagaatgcttgttgagccaaaagcctgcatccttcttgcttctgtcttgactgatctcatattccttcttgggcatagctcttggcaagcagtaaatcttcactctcccactgccgtcagccaagtgttcattttgtccaccacaaagataggtgtttttgggatttgataggttgcatgaaggaagcaaatagaccgtaaatgcagaatctctgtgtttacttggaaacaggctagtcattgacaacacctttaaggatagattttctttgaagataagttgctgggttatgaacatgctttaaaaagtgagcaccaaggccaggcgcagtgtcttgagcctgtaatcccagcactttgggaggccaagacgggcagatcacaaggtcgggagttcaagaccagaccagcctgaccanggtggtgaaaccccgtctctactaaaaaatacaaaaattagccgagtgtggcggtgcacgcctgtggtcccagctactcaggaggccgaggcagaagaatcgcttgaacccgggaggcggaggttgcagtgagctgagatcgcgctgctgcactccagcctgggcgacagagcgaaactctgtct

SEQ ID NO: 242033 - DNA, 558 bp, Homo sapiens
aggtgaggggacagaagtgtgtgcaggcatgtaatttgtatgtggttacagtgctacttgttttttgttttacacattgtctctgacttcctccttttcaggtctctgacatcttctagagatggaggtggaagtcagagataatgtgtaaaactgaaaagaaacgaaggagtactctaagcttgttttttgccaatgtgtagatcagaggtgtccaatcttttttttttgagacgaagtttcactattgttgcctaggctggagtgcaatggcgtgatctcggctcaatgcaacctctgcctcccgggttcaaatgattctcttacctcaccctcctgagtagctggaattacaggtgcctgtcaccatgcccggctaactttttgtattctttttttagtggagacggagtttcaccatgttggccaggctggtctcgaactcctgacctcaagtgatccgccctccttggccttccaaagtgctgggattacaggcgtgagccactgcgcctgaccggggtgtccaatcttttggcttcccagggccaccctgga

SEQ ID NO: 242034 - DNA, 669 bp, Homo sapiens
  misc_feature (573)..(573): n is a, c, g, or t
  misc_feature (576)..(576): n is a, c, g, or t
  misc_feature (595)..(595): n is a, c, g, or t
  misc_feature (599)..(599): n is a, c, g, or t
  misc_feature (616)..(616): n is a, c, g, or t
  misc_feature (625)..(625): n is a, c, g, or t
  misc_feature (628)..(628): n is a, c, g, or t
  misc_feature (658)..(658): n is a, c, g, or t
gagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttcccccccaggcctttaaccnttncccccaaccgggaaaaacncccnccccaatgggaatgccnatggggggnggngggaaagaaaaataatgggggaccgccaancctggggggga

SEQ ID NO: 242035 - DNA, 214 bp, Homo sapiens
acagtcccaagcttttctcataacacttttaactaaaataaatgggcagcctaatttgatccacataatgaaaacttataaatagagtgaaaaaaggcctgacttcagtcaccctagtagaaaatcacagcctcatacaagccaggtacagatgtggaagacctacaaagatcaccttccagtcttccccaaacaatccgtagctatttactgc

SEQ ID NO: 242036 - DNA, 382 bp, Homo sapiens
aaaaattcaggatgagtttattgagagcattatttttgaaagtataagatttgtgattgtaatataaacttaaatcactttgggaatgaatttaaaaaatctatgtgacacaaattaatcatcattctcattgtaaatttggcaaagtatttgtaattaggaatatctgtcatactggcactgggcaaattattctgaatgttcccatgctgaagattctctcaaaaagggaaaaaacaagatcctttgtttgtataagtacaatcagtttgctgaataaaacctttatagctacaattataacaggattgtttctacattttagcttggagatcccatgactactctgttttgctaataataaaccaatacagtgctacag

SEQ ID NO: 242037 - DNA, 406 bp, Homo sapiens
tgatgttgattcattggctttcataatgagtcaatgcttctgctgctattcacaagcttgggggattgtgagatgctcctctttcttgagtatcccatgtaatttttattgttgtacttttcctattatttctaagataatctctctagcttttcttttaacccataaatacaatttctgccatgattaattagcttttaattgtcctgattatacttttgaaataaagcgttcttagtttttgttaaatttccaaataagtttgttgatctcacaatctttcaattgtctccatctacttagaattttaatcctttcttgaatttctttacaaaaattaaagttgtattacatgttatcatgtttgaaagcaactatttaataaaagaaatactagttctaacat

SEQ ID NO: 242038 - DNA, 513 bp, Homo sapiens
tgtggagagattctcatcccacataaataagtcttcaggcgccctggtcaggacttctcaggcaaagtctcttccagcctcaataggacacagctgcactgatgttagtctcaattgatggagtgaagaagcctcatctttattcagtgtaaagcagctgccaagagaaatggcctttgagaggggtaataagttcatgaatatcacctgtgtcgtgcaaaacaatatttgatttttttgaaagtttaaattgattggaaagaacatatgaattaagtgctatctcgtgagtgaaaagttttgctgcagggtgacagagtgcgccatcaaggtgatgcatttcaaacattaccttcctgtgacacaagggagtcatggaccaaatggaacagaggaaattatgacccgctggccaggatggatctgtaacataggaatgccacaccaatatcctgcattcctatttcagagaataagaccttgagcaaataaaacaaacactgaagtagagtt

SEQ ID NO: 242039 - DNA, 199 bp, Homo sapiens
tttcctactgatcgtgaattctttagtagcatggacactatttgggagctcttattgctaggaaagttaaaagaacttaaaaattattattgaataaaaatgaattcaaagacccagtatctcatactctggtgggctcttcaaagggttttctctcatgaaacatgagaatatattaaataaaaatatttcaaaatat

SEQ ID NO: 242040 - DNA, 445 bp, Homo sapiens
atatcggctcggtccctattgtgttcggggtgggagaaccgggaaggggggtgaggtgagcccccatggtgacctgggaggacagaggtgcatggagtgtgcaaaatgtcctaagcaatcagacagtgcttgggaacaaaaatgggatcacctgcttctccagacccctgatttgagggctgggctggggggccagcttctgtctggcacatcacaccccctgtgggctacagcaggatcaaagtctcaagacctctcacggggcagtttttaactaaacatccagtcctgacggaaataatttccctggggatgagccatctttcctacttggcaaagaactagacagaaccttccagggactccctgtctggaggagctctgagcctcctgacctctccccaccctttcctgaggtttagattcccaaagccccattcgtgca

SEQ ID NO: 242041 - DNA, 449 bp, Homo sapiens
taaattgtttagcaatcagagtttctatgactgtccatcatcactgcatctcttctatgacatgagacattggtgcgatgtgtcattatgttcaaatgtgtgggtcggccagggtgtatctgtatggactgaatgtgtccccataaaatttgtatgttgaagccctaacccccaatatgaggatatttggagctggggcctttgggaggtaattaagttagatgaggtcagatggacatggcccctgtggttgagattagccctaataccaagagatagcagagagctccaccctactgttggccacgtgcacacatagggagaagggggccgtctataagcaaggaagagagccctcatcagaaaccgatcgcgccagcatgctgatcttggatctgaggcctccagaactgagggaaaataaatgtctgctgttgaagtcaaaaaaa

SEQ ID NO: 242042 - DNA, 387 bp, Homo sapiens
atcttcatttcaatcatctgaaaggcaagaagttttaccgcaaatttacactagtatccaaagttcattagtaagtcgtcctaacatattctctaggacagtgttctgcaactatgaagccattgtggagacaaacgagattgcttagtaatctaatgtgtgttgagaacagggcagtaattaatcagtggctgtcgtgcttacaccactataaagtattacgagaacctccacgccgaccttcccctcccctattatcagaccattagtgaagctctgtacaagtaacaacagtggagccctgcttaagcatatgaccccaatagcttgtggataagctttgtgagcattttcacaacggtcacttgaattctcattatactttct

SEQ ID NO: 242043 - DNA, 287 bp, Homo sapiens
acatgcagaaaagtgcacgtatcaaaagtgtacacagtgatgttgcacaacagtgtgaacgtacttactgccgctcaactgtacacttaaaaatgattaaaatgataaattttatgttgcctatattttaccacaattttcaaaaagtatacagtttgctgaattttcacaagctgaacatgcctgtgtggccaccagccaggtcaagaagagtgttacctgccccccaggagtcctcctcctgtagccacaggaagtttttaaaaaataataaacagctaccattc

SEQ ID NO: 242044 - DNA, 566 bp, Homo sapiens
cccggaccctacagccatcaagatgttgatgcctaagaagaaccagattgccatttatgactcctttttaaggagggagtcatggtggccaaggacatccacatgcctaagcacctggagctgtcagacaagaatgtgtccaaccttcctgtcataaaggccatgcagtctctcaagtcccgaggctacgtgaaggcacagtttgcctggagacatttctactggtaccttcccaatgagggtatccagtatctccgtgattaccttcatctgcccccggagattgtgcctgccactctatgccgtagccgtccagggactggcaggcctcggcctaaaggtctgaagggtgagtgacctgcaagactcacaagagggaaagccgacagagatacctacagacggagtgctgtgccccctggtgccgacaagaaagccgaggctgggactgggtcagcaactgaattccagtttagaggcgaatttggtcatggacatggtcggccacctcaataaatttggagagggttattttgcattgtataaacatccagccaaaaaagctt

SEQ ID NO: 242045 - DNA, 395 bp, Homo sapiens
atgttgtttgtagtagggaataactggcaacaaatatacatgaataagtgaatgattaaatatattatggggctgggagcagtggctcatgcctgtaatcccagcactttgggaggctgaggccggcagattgtttgaagccaggagtttgagaccagcctgggcagcgtagcaaaaccctgtctctacaaaaaatacaaaagttagaggttgctgtgagctgtggtcatgtcactgcatttcaacctgggcaacagcagtatctgtctcaaaaaaatgtattatgagtcatctatgtaatgaatactatagtaggcattaaaacaataggttggctttaaatttcccgaggaaaaaaaatgtacttgcgacattaaaaaacaagatgcagaaca

SEQ ID NO: 242046 - DNA, 443 bp, Homo sapiens
atggaataaaacttgaaatcaataagaagaagaaatttggaaactgtacaaatatatggacattaaacatgctattgaataatcattgggtcaatgaagaaattaagatggacatcaaaaaaattttttaaacagaaaatggaaacacatcatgcaaaacctatgggatacagcaaaagcagtactaggaggaaagtttatagcaataaatgcctacaccaaaaaagtagaaagatttcaaataaacaacctaatgatgcacctcaaggaactcaaaaagcaagaacaaatcaaacacacaattagtagaaagaaaaaatataaataacatagcagaaccaaatgcaacagagacaaaaaaaatgcaaagaatcaacaagataaaagttggttttttgaaaagttaaacaaaattgataaaccactagtgaggctaaccaaaa

SEQ ID NO: 242047 - DNA, 607 bp, Homo sapiens
tgtatttttagtgttatatccctaacatctagcagagggtcagggctcagcacattgggggctcttaatttgtcttggttgattgaatgaatgagtcaatgaattgtctgtgaacagtctcagacgtcagaaagattttagttagaatcccagactactctttactactctctgaccttgagcacgttacttaacctctctggcctcagctgaggcctctctggcctcagcatttctctgaaatgctggtgttattaataatagtacctacctcataaggttgataagaggaacaaaggaggtaatgtacctcatctataggatggcaaaagtgaactgtcatgaacagtgcttgggtccagggcaggggtggtaggaggcaggtcatgggcatcattgtcagcaaagtgagagccactccagctgcttgccttctctgtgcctttgtgtccccaaccagccatggagaagaaggattggggatcataagagagtctccaaagcacctgactttgttcccagagcccttagcccctttccacattctgccatttgatggacgaccatgggcagatcttaccttttaaataacactctgcagcccagc

SEQ ID NO: 242048 - DNA, 343 bp, Homo sapiens
ttttgtagagaaaaggtctggctttgtcgcctaggctgatcttgaactcctgtgtttcagtgatcctcctgcctcagcctcccaaagtgttgggcttacaggcctgaaccaccacgcccggccaaaaattgggttcctaagcagaattctatacgggtggcctcaaccactttacttgctatgtgaccctgggcaagtcacatcacccctgtctcagtttctttttcttttctttcttttttttttgagacggagtttcgctcttgttgcccaggctgtagttcaatggcgcaatctcggctcactgcaacctccgtctcctgggttcaagcaattctcctgc

SEQ ID NO: 242049 - DNA, 538 bp, Homo sapiens
ttttcttcctcatcaacaaagctgatcgatgggggctgaagccccagggaagaagcatctgttgtaactcaaggatcccggcttgagctgaggatggaattaacaggcacagagtggttggcagcccaacgtttgtgcaagtctggcacatgcacacatcattagcaactatgctggagaagaatgatcaaggaggtgaggaggggaatggatctgactaaagggatgttcaagaaaggaaattccaagcacttgggtaaaagcttcatagctaaaatgaatgaactcgtgagcaaagcaaacagccaggtacatttgggagatgctgacagacaatctggataattttgcctctgaaactttcaaaacaaagtcatttcatgcagtgaattccccagagtggctgcctctttcacttagctccttcggctgtgtctccttcactaaaatgaagcccccatgaaggcaaaaattttgctgtcctgttcatggctccaatcttggctcctggttgataatattaaatattcatggaata

SEQ ID NO: 242050 - DNA, 652 bp, Homo sapiens
agcaaactaacaccagaacacaaaaccaaacactgcacgttctcactcataagtgggagtgggggtcaggggactggggtgggatagcattaggagaaatacctaatgtagatgacaagttgatgagtgcagcaaacactatggcacgtgtacacctatgtaacaaacctgcacgttctgcacatgtaccccagaacttaaagtataataataaacaaacaaaaaatcccccttagccctacttcctcctctagtattgttccatttccctcctatcttttacaacaaaattcctcaaagtactatctaaacttctatctccagtttctctcttctcacttgttcttgctttccctttaattaggccttatctcttatcagcctacctaatgcgctcttagcaaatcacagatgacattcacatagcaaactccaatgattgattctaatcctcatctgagtattagcagtttggtagccaaccacctgtacaaacacaaattttttaaccaccttacatttgacagctgttgatttttactacatataacatttccttgagattaaaaacttatgaaaaaactttgtgaatataacagaaattaacaaccttatatactctgtcagaaaataatttaattttaccaaggtt

SEQ ID NO: 242051 - DNA, 487 bp, Homo sapiens
cagtggtccgagtgtcctggctgttggtgctgaatcttagaaggaatgaactaggccaaagtggtagaaataaagaagagacaagccaagggcatctaggcaaaaaccatagcatgtgcaagggtcatgaggcttcaaaggttagtgtgtcaggaagatcagcttggccacaagtaggttgaagaggtaggtaaagtgatgagaaatgtaattggaagttaagcaaaggtgaaatatttattcaggtgataaatattgattgagtgcttaaaattttaattttaattaacattttaatgtgtcaggagtgttctaagtgtagaagtgaacaaaatagcacatgaacaaatgaacaaaatgtagctgaccatgtagaaatgaacaaaatagtcttggagcttacattttaggaagttattttatatgggtcttttatgccagtttttagttttaaggaagcatataataactaaggcggtctgtggct

SEQ ID NO: 242052 - DNA, 696 bp, Homo sapiens
ttttttaaaaaaaaagaaagaaaaaaatttttacatctgtttcatgagggctattggtttatagttctgttgtggtgtccttgtttggctttggtagcagggtaatataggccttgtaaatgagttgagaagtgttccctcctctgagtttgtatggaatgatatttcttcctaaaaagtttgataaattcagtgctgaggccatttaggcttggacttttctttgtggatttttaaaatcttttattttggaataattttagatttatagaaaaattgaaaaagtaatagagttcctatatatccctcatctagtacatatgtcaaaactaagaagcaaacactggtatattacttttatataaacttcaggctttattcagcttctggactttttctgttccatgatctaatccaggatatcacattaaatatatttccagtgtgatgtttattttcttccttttacttactgggtttgatttgttcttctttttctagcctctcaaagtggaagcttacaggattgattttagacctttcttcctttctaatataagctctaaagctatttatttccccgtaagcattgctttgctgcatctcataaatttttttccatacagtgtcactctcaggatatcatactttttttatgttgtgttttcagcttcattaaacttggcatcattttta

SEQ ID NO: 242053 - DNA, 402 bp, Homo sapiens
gcaaagtatatccaagcttaatttttgtgcattggctatatgaattttatgctaaaaactgtacaaccgttttaatgctattaaagacataaacccattgaaccacttcctatttctttgtatttgtactagaaaaataataaaatgctaccattttagtcagaaatgcagtggagagttaaataatacactcagcatctgtgcttttcctttgtatgttgctttgattgcagtacagatggcatacttgggcttgatttatggagaatctttgttcattaaccttgtctcattgtcctgatcaaaactggacgctttatgtttgtgttagaagttgttagttctcttagattattgtctttaggagctttgcattccttcttagaaagtattaaaaaaaaa

SEQ ID NO: 242054 - DNA, 641 bp, Homo sapiens
tttttgtatttttagtagagatggggtttcaccatgttggccaggctggtcttgaactcctgacttcaggtgaaccgcctaccttggtactcccagagtgctgggattgcaggtgtaagccactgcatctggcctcagagagcataatctgtattccctagcagctgtttttactattgtttttcttatagtcttcaaagatgtattgggctttgaaaaccttttggctcctaggaagaagctatttctgcttggtggagtcctagtctggaaagtgaattctctgtttacactgccccattcatatcctgtcccatgaactacagctacagatcctctttgtaacactgctcagaatagaaagtttaattactctacccctaaaattttgcagattgcaagaggctataagctactggtatagcctagagatcaagggatcttgtgtggtgttatgacaactacttctatttatatgtgatgttcactttaaatatacacagacatatctgtacgttagttgaagggggtctcaaaaatctcatctgacctttaattagactccaataagaagtggttaagacattgacgtatgggccaggcgtctcaaaaaaaaaatggaaaaaaatatttaaaaagaa

SEQ ID NO: 242055 - DNA, 445 bp, Homo sapiens
ctattctgtcgtagaatctttcaaataatgaatttaaaagtataaaggtgcaacagcttccactagtatgaaagaacaactgatagctattgagtaatattgaaaatgttaagcaaaattgttaaaaatgtttgcttaactgttggatggtattatttaaaagtattatcattgagaatacatcaataacattaatgcagattatgggggatttcctccacttgggtctctgcatctttgtgatagattcttcctggcaatgaagctaaggaaatcaaatattggaatgagacctcagtagtgtaaaatgtaaactaaggtcctaaaatgtaacgaagaatattcaataacataactctcactaagtagtattaattaataataattgttagagcaaaaagtgcttttttgattaaaacatacaataaaattatttttgaatagt

SEQ ID NO: 242056 - DNA, 583 bp, Homo sapiens
tagcgatatgctagggaaaagcatatagagacggactggatcaaggtgacctgcaaagttgaaagaaccagactgacaagacacttcacaaaagccatgctgaatatgaaagacaaaggaaacaatctttcaaatgtttaaaaaaatatttatgctactaaaagtagcattgatttcagaaggcagaaaaaaattttcagacagaggaaggcctctaaatagtgcaaaccacacattgaactacaaagaattgtagaatcattacaaatatctcaatcagaaaatggttaggggaggatggcaagaatttaaacattgaaaattaggtctgaaaatggagggatgatgtcaaaaaaataattggtaacaattctgaaccaaaattcaacgtatttacaacaggggaagtaacaaaaggcaagtgaaaggaagataaataatatcgtggtaaagttctcaatattttaggggatttaggagcagctgtacagcttattgattttaaatttactttggtaaagtttaatatctttggttaattactagaaaaatagaggctttgtaggtttgaagactgaggaga

SEQ ID NO: 242057 - DNA, 359 bp, Homo sapiens
tgattccattgcttaggttaatattcaaatggcatccttaccctttcattataaagaatgagaaaagaagtaaactaaaaatctataaacatgtgggtatttataaacctcatatacagtccttccagtatcaaatgcctaaaagagctgctgataaaaagtgtgagcccccaaagacaactaaaaatgtaagatgtttatgttcctgcaagatataagcacaggaacccaaatgattccaggacagtagaaagtgatgcttcacaacagaggaataacgttctgtggatattaggaggaagaagagaaaatttgcagttagtgaatcatgaaaggtttcctggaggagaagcatttga

SEQ ID NO: 242058 - DNA, 189 bp, Homo sapiens
tttaaaaatcagaagcctggcagtctctggaagaggaagaccatcttcggattaccctgaaattccctattccaggagaattgaaaccatttgtcctgtctaacagcaaccaagaaaagcatctttgtcaggccttatctttatttgacctcagagctcagttagtgagaaatgccctgtgttatttga

SEQ ID NO: 242059 - DNA, 320 bp, Homo sapiens
gatgtgcctgtggaaacagatctttaattctatttaattttaactaatttaatttaatgtttttattgtttcattatattttaatttttgtgggtacatagtaggtgtacatatttatggggtacatgagatgtttggatacaggcatgcaatgtgaaataagcacatcatggagaatggggtatccatcccctcaagcatttatcctttgagttacaaacaatccaattacgctcctggagttatcttaaaatgtacaattaagttattattgactatagtcaccctgttgtgctataaaataatagttattattcatt

SEQ ID NO: 242060 - DNA, 3645 bp, Homo sapiens
gggccgcggccgccgcagagcgccgggggcgggaggagcaaacgcaggaggccatggccgccgccgccgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaattgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgaagcagttctacagactcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 242061 - DNA, 3630 bp, Homo sapiens
gggccgcggccgccgcagagcgccgggggcgggaggagcaaacgcaggaggccatggccgccgccgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaattgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgaagcagttctacagactcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 242062 - DNA, 3671 bp, Homo sapiens
gggccgcggccgccgcagagcgccgggggcgggaggagcaaacgcaggaggccatggccgccgccgccgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaattgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgaagcagttctacagactcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataaaaaaaaaaaaaaaaacacaaaaaaag

SEQ ID NO: 242063 - DNA, 1302 bp, Homo sapiens
  misc_feature (13)..(13): n is a, c, g, or t
ccccggcagtgcngactgggctgatagaactgcaggttgttcttcgggcattcttgctcagtattatccttttgagtgtcgtagcttctatgaatgatcctgccattaatcggggcatgacagaaggagtaacgctgttaatcctggcagtgcagactgggctgatagaactgcaggttgttcatcgggcattcttgctcagtattatccttttcattgtcgtaaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 242064 - DNA, 2706 bp, Homo sapiens
gggccgcggccgccgcagagcgccgggggcgggaggagcaaacgcaggaggccatggccgccgccgccgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaattgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgaagcagttctacagactcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttggcaactacccctctaggatcttcaagcggtactctgaggagctgcacagcagttcctgaattgtctttggctctgtgagcgatcagagaaaggtgat

SEQ ID NO: 242065 - DNA, 1363 bp, Homo sapiens
gggccgcggccgccgcagagcgccgggggcgggaggagcaaacgcaggaggccatggccgccgccgccgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaattgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaaggtaattaataagagcctatgatactatatataaccttagaaagagaaaactttgatctaggaatagtaagttttgcagattacttttatcgttcatgttacacaacttcgtattttgttaagataggattttcattcactggatacctaggtttggcaatgcagggaatgctaa

SEQ ID NO: 242066 - DNA, 216 bp, Homo sapiens
caccagagatgttagctgctgatgtgagtggttgtgctactaggtggcaggcacttaaaaagaataattttgtctttctccaggagcttgtggaaacacttccgtgctgtaagcctttgtttatttttattggtattccctgcttatatggcttatatgatttgccagtttttccacatggatttttggcttcttatcattatttccagcagcatt

SEQ ID NO: 242067 - DNA, 438 bp, Homo sapiens
tatttaatattttacttctgatttgactcaagtgtttaaagtgtttattgatggtgatgcaagaagttttcctatcttacgtttttatttaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaaggtaattaataagagcctatgatactatatataaccttagaaagagaaaactttgatctaggaatagtaagttttgcagattacttttatcgttcatgttacacaacttcgtattttgttaagataggattttcattcactggatacctaggtttggcaatgcagggaatg

SEQ ID NO: 242068 - DNA, 378 bp, Homo sapiens
actatgcatttatatttaactagtcaatttggaaaaattcatttataaaaaatagcgtaactcacattctctagacatgcacatgcaaacaaataaacatgtttagtgtctttctgttttttctaaaaacctgaaaactggcaaaagctgggacagagaacaagtttgaggcagggcagatttttattgctgtatccgggatgagaaaactgagacccagagaccttaagtgacttttcaggaatccctcagtgatgttgcaagtattttaaactagcgctaatagctgcttatctattatgcgtctcattatttaattgactctacttcacaatgaaatttgttgtttttccctgtccctgtttttttatattttgt

SEQ ID NO: 242069 - DNA, 912 bp, Homo sapiens
ttaggaaatgaaaaggataaattttgtgggtaaatctaaatggctattgaaaatacaaattaaacctgtcaagataaaatacagacagaattaaaacaatgcaataatgacaatgtgaataaaaatgagctcaacagagtatccaggagaggaggaaagtatcaaataatattagattttgatagtaaaagattcatgtttaagtaacttccaagttagaacagcagaacaaacataaaaaataagcatctaaaagaaggcaagaaaggacaggaaaaggtaaaaaacaggtttgataggcagaaagtacttattaacagattgaaactaaacgtcagttactttgtcaaatgccaatagacagatgctctaatcataagaaacacacaagattttttaaaattctagtatatactggctgggcacagtggctcaagctatcttagtttttaacaaaaagtttaaaaagtaaaaacaaaagtaataaatttttaaaatagaaaaggcttacaaaataacaggaagaaagtatttctatacatctgtacaatgtgtttgtgttttaagctaagtactataagagtcaagaaatttaaaaattatgaacttcataaagtaaaaaagctacacggtttctaatacagatgcaagaaaaaagtgtcttcgctgtctgactgtagcagccaagactggattgaagaattgggggttaggggagagtaagctaaggttaagttattattgaagaaaaatttttctataaatttagtgtagcctaactgtacagtgtttatacacagtctacaatagtgcacaataatgtcctaggccttcacattcactcaccactcactcacccagagcaacttccaatcctgcaagctccattcatggtaagtgccctaatacagg

SEQ ID NO: 242070 - DNA, 458 bp, Homo sapiens
ttaggaaatgaaaaggataaattttgtgggtaaatctaaatggctattgaaaatacaaattaaacctgtcaagataaaatacagacagaattaaaacaatgcaataatgacaatgtgaataaaaatgagctcaacagagtatccaggagaggaggaaagtatcaaataatattagattttgatagtaaaagattcatgtttaagtaacttccaagttagaacagcagaacaaacataaaaaataagcatctaaaagaaggcaagaaaggacaggaaaaggtaaaaaacaggtttgataggcagaaagtacttattaacagattgaaactaaacgtcagttactttgtcaaatgccaatagacagatgctctaatcataagaaacacacaagattttttaaaattctagtatatactggctgggcacagtggctcaagcctgtaatcccagcactttgg

SEQ ID NO: 242071 - DNA, 457 bp, Homo sapiens
agagaaaagtcaatgcaagttctataaaatctcttctgtatctgtgtttatcgtattatctttacatgtgtctcctccacagattccaagctcctgaaagcattgagcatgtcttctccatcgtttttctcctctagagtagccattacagatctttgcacaaagtatacacccaacaaatgctagatgggtggatttctgggtagataaatgggtgaaacaaaggaaggcaaagtttctgttttggggccagagcggaggagcaggaggaaaaacacgcatctggttccactgccttccggtgagttaacagcatgaaactacatcacctgcagacccaggagtcactgaattctgaaaatgacagtactttaagtttgttggggggttggggaacagggcaatgaagtttatggaagagaagcgcaaagttcttgataaagttcttgtcttaaag

SEQ ID NO: 242072 - DNA, 209 bp, Homo sapiens
caaagggttaatattttaacacatttgaaactcaaaaatcactgagaaaagcagtagacttccataaatattttatagagtagaaaaaataggccaagcacagtggctcatgcctgtaattccagcactttgggaggccgaggagggtggatcacgaggtcaggagttcaagaccagcccggccaagatggtgaaaccccatctctact

SEQ ID NO: 242073 - DNA, 384 bp, Homo sapiens
  misc_feature (7)..(7): n is a, c, g, or t
tgctgcnagaagacgacagaaggggtctccctgcagggtgggaggaacgctgttgtctctttttcttcctgcccctttgtttgacttcaccattctctgtttccttttcgctccgctgtagttacgtgactcacctttcattcagtacctcccttcaaggaaagccctgtctcctgtccttggactgggatcacacagagttcttgggatgaccctggctctcccgcgccagccgctctgctgccaagtgcaagcattcgctcccagatgcttcgcccagttctttgcaaatgtcatccaatcagtgtccaggtgttcacggctcatcactggcttactgctctggtctacatagcttgggacattgctgtttatgcaggtata

SEQ ID NO: 242074 - DNA, 482 bp, Homo sapiens
ggtagcgatctcaccgacacctccctgtgtcacgattccccttagtagtctgtgctgcagtcactaagcatgaccactagatggcgggagaggactgagttgaggttatggcggcggctcctttctccctgcagggtgggaggaacgctgttgtctctttttcttcctgcccctttgtttgacttcaccattctctgtttccttttcgctccgctgtagttacgtgactcacctttcattcagtacctcccttcaaggaaagccctgtctcctgtccttggactgggatcacacagagttcttgggatgaccctggctctcccgcgccagccgctctgctgccaagtgcaagcattcgctcccagatgcttcgcccagttctttgcaaatgtcatccaatcagtgtccaggtgttcacggctcatcactggcttactgctctggtctacatagcttgggacattgctgtttatgcaggtata

SEQ ID NO: 242075 - DNA, 442 bp, Homo sapiens
actttaaaaaatttttgagatagggtcttgctctgttgcccaggatggagaacaatcatagctcactgcagccacgacctcctgggctcaaatgatcctcccacctcagcctcccgagtagctgggaccacttgtgtttgctaggatgtctggctagtttttgtatttttagtaaagatggggtttcaccatgttgtccaggttggtctcaaactcccaacctcaggtgatctgcctgcctcggcctcccaaagtggtgagattacatgtgtgaaccatccacccaccctgattcaactgactcttaactttaaaaatcacattggtcttaccatacatagttcatcaattgtgggagagaaacttgggtgtcatgctttatttatttattttttttttgagatggagtctcactctgtcacccagggtggagtgcagtggc

SEQ ID NO: 242076 - DNA, 338 bp, Homo sapiens
tagaaaataacaatgagagcgatttacatttgctgagcttggcacgggatggtacccagtggccattcgggtgccagcggagcacgcagagcctggtgtctgtggctgcctccctggtccactaacacgagagaggtgggtcttcctgggtgtcccaggcacgagggtgcagcccaacccaaactgacttggccggtgctcaccacactggggcgcccgccacactggggcgcccgccacactggggtgctgagcaagatggcagcctgcgtcacttccctgtagattcccgacatggacaactcgaattaaacctggtcaagtagcaaaaaaaaaaa

SEQ ID NO: 242077 - DNA, 368 bp, Homo sapiens
gagtgactaacagtgtcaaaactctctgatgtagggatttcctccatcttttgaagcaattaacagaatttcaaaatctgtagattaactgaaagcatttccaacaaatccccagttagacactgctgatgtttggatcaaattttgaataagaaggaccttcaaatatgagttggagaaaaggaaagcctcatgctaagcaagagggcagtggcacattgagccagagtagataattaggcagacttgagcagggcaagagaggccctcctcccttaggaatgtcaggtaaccatcctggatgatcaggctgttggttgttagactctctctgtaaaataataatttgtcatagccagtgccagaaa

SEQ ID NO: 242078 - DNA, 400 bp, Homo sapiens
cttcagttttattccttttgattgcagaagccaaatcagcctcagcatcattagtgttttttggccctatttatagttgttctctctcgcttctgagctcctcatagacaggtacagaagagagtagtccagttttgtttaacagacatacaagctggtacctcctccgtaccaggccccacacttggagctggacaggtagtgatgagtcagcgatgaatccctatgtccccaccccaagttttccaaacttgggaaaacttggcctctaagaagttatacggccaggcgcagtggctcacgcctgtaatcccaacagtttgggaggctgaggcaggcggatcacttggtcgggagttcgagaccagcctgaccaacatggtgaaaccccatctctact

SEQ ID NO: 242079 - DNA, 474 bp, Homo sapiens
atgatttagtcattactccagctcatctcttttcactgcttgccttgaattttatgttgcagccatactgcctacctgaactctctcaactggctgtgccatgctgatcatacatttgtgcctttacatgtactattttctctgtccaagatctctgtctccagtgatctttaccacccatttatctgtctcatcggttacatgctagctgaggatgttacctcctcagggagccttacttttctttctacttcctctgttgcagtgcagaccattccagctcaatgtgccacccttccactttgtaaatacttccttcattgctttttatcacattgttgttactttttattgaatatatatatctcacttatttgtgaattgatggtgtttagaattcatgttttagtcatatttatgtatccaatttgtattatagtgtgtggtaatcaataaagacttattaaatgaagc

SEQ ID NO: 242080 - DNA, 754 bp, Homo sapiens
gcagagaggagaggagcgagcgactcctgcgcaagcgcagagtgaagggccgggaacagtggagggtgcgaggaagacaatgggggaggaccctgaggcggcctctgtgagccgacaggaacacgtggtcgatcagagagagactcgaggttcgtgaacggatggggaggaccctgaaaagcactgtggaatacaggtttctagtaacttcaaaatcacatcatttggactgggtaagaattgctgaaactttaatgaaaagactgactggcttataaaactgctaacccaaatagaataaaaattaattgaataccgaggaaatacttcaccaggtttgcatacttaatcagcctatactgaaattgtttagatatacaatttgaatgaactccatggtctaagtcaaattacctgtgataacccatcagttatccatgctatgtgcccaatttggagaaacaactggcacccaagaggacataagtccgatgttaagcatggactcatggagaaccaagatggctgccttgtccttcgtgagtccttaaagcttttgttattaaaagttatgcattccatgactcatcctggaaaagataaaatgatccaaattaaatatgttggtgtggtgacttacagattgttaaaatagtttataaacaatgtttagtttgtcaaacccatactcctgggaagtcaatcaaagcttcatgtacatttggctacctgatgaggcatttaaacatttata

SEQ ID NO: 242081 - DNA, 886 bp, Homo sapiens
gcagagaggagaggagcgagcgactcctgcgcaagcgcagagtgaagggccgggaacagtggagggtgcgaggaagacaatgggggaggaccctgaggcggcctctgtgagccgacaggaacacgtggtcgatcagagagagactcgaggttcgtgaacggatggggaggaccctgaaaagcactgtggaatacaggtttctagtaacttcaaaatcacatcatttggactgggtaaagagctttttatggttcactgaggacaatcaaccccttcacaatctagaacccaaagatgggatcttctgagaacatcagagaaaagctgcccttggcatcatcactgcaacaaaacatcaggatcttgaaccttggggtcataatctcacaactgagcagggtcactcttggaactctacatccattgaaacccttaaggtaaagctaatcagggaagtttctccccagaagaagatggcatccttgatgtgagcagctctttctgaagatcatggatcaagacttcttactatcatgagactcttatctttgaatgtttttccgttgcttccgcctctgtgaacaacagaagtgagaagggggtctgttttgtgcacttatggggtatacttttatttgtgaagggctttgcagccagctttatacatggataatcttataacttgatagataaagatgaaggcccagtgtatcataggtgagaaacttcaatgggtacatatggtgcctcataatcattcagaagcagaacattggttcactcctcttaacccacagcatgggttaaagagaccattgccaagaggccttccctcttctagaagggcatcatttgttaggtcctttttccatggtttggaattaaa

SEQ ID NO: 242082 - DNA, 780 bp, Homo sapiens
gcagagaggagaggagcgagcgactcctgcgcaagcgcagagtgaagggccgggaacagtggagggtgcgaggaagacaatgggggaggaccctgaggcggcctctgtgagccgacaggaacacgtggtcgatcagagagagactcgaggttcgtgaacggatggggaggaccctgaaaagcactgtggaatacaggtttctagtaacttcaaaatcacatcatttggactggaacccaaagatgggatcttctgagaacatcagagaaaagctgcccttggcatcatcactgcaacatcttggaactctacatccattgaaacccttaaggtaaagctaatcagggaagtttctccccagaagaagatggcatccttgatgtgagcagctctttctgaagatcatggatcaagacttcttactatcatgagactcttatctttgaatgtttttccgttgcttccgcctctgtgaacaacagaagtgagaagggggtctgttttgtgcacttatggggtatacttttatttgtgaagggctttgcagccagctttatacatggataatcttataacttgatagataaagatgaaggcccagtgtatcataggtgagaaacttcaatgggtacatatggtgcctcataatcattcagaagcagaacattggttcactcctcttaacccacagcatgggttaaagagaccattgccaagaggccttccctcttctagaagggcatcatttgttaggtcctttttccatggtttggaattaaa

SEQ ID NO: 242083 - DNA, 1052 bp, Homo sapiens
cagaggtaccaagaggcacttctgcaggggctaagagttagtagaaggaaagcaattaatataaggaagatttcagaagtgcttcagggagctgaagaaaggctaagtcagttttatgaaaaactctgtgaagcattctggtttacaccccatttaaccctgagactgctgaaaatcagcatatggtaaatacttcatttgtaaggcaagcccagggtgacatcaagcagaagctgcaggcatgaataccacccagtctataaaagtagctaccaaggtctgtcttaactgtgaccagggaacaaaacaagaaaaagcaaaagcaacaagtgcagcagctaggaacgccaagggttaaatccctctccccagcccggctgtatctgaataaaagggggctggagaccggtattaggagaagaacaaaggaaaaagaaaggaaaaaaataaaagtgtgagaaagaaaaaaaaaaggtaaacaaatcagaaagaaatgagagacagacagcagtgcaaaggggcaaggcccgtgctgttgccctgccctgccattgcccggccctgccggctggccgaaggagcaggagaactcaggaatgaaaaaggaaagtaaattaaaggcttaagaaaaaggccaatctgttggcaacggctcttatagaaagagagattagcaatgtcagaggatgtagacgcagatgtagatgtggaagaaatcaagttaggcagggattcaagagccagacaaggctagaaagaaattaatgtgtgagatgaaaaaaggacactggaaggataaatgttcagaagacaatgagggaaatggccaagtgctgccccaccttggaggaaccaaatactgatctgatcaggctggcaggagctaaaggatgtaaggactaggacagactggacaccttctcattaggctcccaggagcccatggtcacattagaagtcaaaggcagcaaaattctgccgtatctggattccaatttctcactgatagctaagccactagataaaattacaaagaaacaaagaaaaaaaaa

SEQ ID NO: 242084 - DNA, 752 bp, Homo sapiens
atccaacctcaaaacacagtttaatcagtctttccttcacccactcactaaacaatctatttcctaagggcctctttcatgggtggcttgttcaccgtttgtgttgacatattgttattgccaaagttcatctgtatcaagaagtctttcaaaaataagcatattccttgtcaggtcttctcattggttaacactaatacagaggaacccttggatctcaaacaaatgctttttaatgagtttgaaattcttctgaaaacagttatcttttccccttgaatgcaatgaatgaatcatccttgttatccatccagtcctgactatatttggagaaatacatgaaaattgtacaatttcctcagaaaactgggcattcataataaaaaggaatagtataacaggttgagtcattttatgagaatatgttattttgtgactcttaaatctttatttaaagaagtgcattgaatacaatatcaaatatagtcagttcataattacagtagaactacattttataatacatctttcacatggttctcaggaacacattcctctaccaaaactcaattgcactcacttttggacaagcctgtgctcaggaaaggagaaatggttgtttaccatcaactttatagaaactgtcaaactaactgaagaaaagttttgctccattaagaaaatgcacctccctcaggagatcgagaccatcctggctaccatggggaaccccatctctactaaaaatacca

SEQ ID NO: 242085 - DNA, 379 bp, Homo sapiens
caagataaggtattgagaggtgattagatcattagggtggagccctcattaaaggttttagggatcttataaaaagaggtttaagggagctagtttgccccttccaccactgaggacacagcaagaaggtgacatctatgaaccacaaagtgggtcctcaccagacaccgaatctgctggtgtcttgatcctggccttccagcctccagaactgtgagcgctacatttctgtagtctaagccacccaggttatggtattttgttacggcagtccaaattgactaagacagattttttttttcaatacactgttctgggtcaattggatatccatatgaaaaaaaggacccctacctcacaccacacacacaccacacac

SEQ ID NO: 242086 - DNA, 501 bp, Homo sapiens
ggaactaatgttcactgagaatgccacatgccaaacactctgcaggcacattacatgggttaactgaatatttatgaccacaggagagtagtgatataacttttcctaccaagaatggggaattccttaacccatgggtgttatgaatttgacagatccttgtccaagctggagctttctttagggatgactagaaggagctgagcagttaagtttaaagactttcctgtcttgaataattattggctcatctcattaatgtattttctcaattgttactttctgcacactttggccttgcatagctctggctcattaagtatttaaagactttttttttttttttttttttgagatggagtctcgctctgtcgcccaggctggagtgcagtggcgcaatcttggctcactgcaagctccgcctccccagttcacgccattctcctgcccaccttggcttcccaaagtgctgggattacagattttatccgagcggccgct

SEQ ID NO: 242087 - DNA, 371 bp, Homo sapiens
tatagccattacctccatctccttccagaacattctaatcaccctaaatggagaccttgtacctattaagccctcactcctccttttcccaacccatgcaaacccctaatctactttctatctctagggattcattccttctagacatttcacataaatggaataacccaaggtgtggcttatttatatctggcttcatttactgaacataatgttctcaaagtacactcacatagcagcgtgtgtcaggatttcattgtgtttgatggctgtttcatattccaccatatggatagacgccattttgtttctccattcacctatgggtgaacatttgggttgtatttacccgttggtgattgggaagaatg

SEQ ID NO: 242088 - DNA, 625 bp, Homo sapiens
gttggggaccttgagggtaatgatttgcaagcttctaagaaagtggactatcagaaccaaagcaattaaacaaaatctcagctggtgttttcattttctttaatttctatatccttctcattgacttttgtactattgttggctcctccttcccctttttccccttaactcatggttgccgttttttttcttctctttaggacttgtccgtatcattattttcctgtgaatgtcttaactcttcccagtttctatcggcttagtggcttacattaaccattacttctcttattctctgtgccaggattcaaatggggagttcctctctacttgccatttgctagagtctttaacactattacattaaaattcagcaggccactggattaggatgtatagggctggaaagtccaagaatacttcactccctgtctgcatcttaatgcttctccacatggcttctctttctaggagagaccaatcttcttcataggatagtggctggctttcctgagcaaaagcaaaagcttccagatctctataaagctagttttggaagtggcacagcatcacttctcctgcattctattgatcaaaacaagtcaaaaggctagccagaattcca

SEQ ID NO: 242089 - DNA, 174 bp, Homo sapiens
tccacacaaaatgaaaaggtatttccattttgtaggtaagagggttttgagattttaacttgtcccaaggtgtcacaggtatgaagcagctaaagtgggcttttttggcatttctcccctcccttattcctgtgcgtatctcaagcattaaaaaaaacaaaacaaaactatata

SEQ ID NO: 242090 - DNA, 483 bp, Homo sapiens
taaatgaaacaaaaacctggttctttgaaaacacaaatacaattgatagaccattagggagattaaccatgaaaagaagagagaagaaccaagtaagctcaagtagaaatgaaacaggagatattacaactgataccacagaaatacaaaagattattcaaggctactatgagcacctttatgcacataaactagaaagtctagaggagattgataaattccaggaaatatacaaccctcttaaattaaacaagggagatataaaatttctgaacagatcaaaaacaagcagcaagattgaaatagtaataaaaaaattgtcagcaaaaaagtccaggaccaggcaaattcatagatgaattctatcagaaattcaaaccattggtaccaatcctattgatactattccaaaagataaggagggaatcctccataaatcattctatgaaacaggtatcaccctaatatcaaaaccagggaatg

SEQ ID NO: 242091 - DNA, 526 bp, Homo sapiens
tttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacactactaacaacttcttttcttaaaccttcaatcttggtagaaacatgaaatggcctccaagttgccaaagatagtcatccaaaaccttggaacaactctgaaggtccctcatatggattccttgcttcccagctccctttacaactggatgtgaaaggtgctgtcttctgtactttctcttgagaggcagaaagaaataaacaatggctaattctgacctatacc

SEQ ID NO: 242092 - DNA, 443 bp, Homo sapiens
cggggctgatgggccgcctgaagccggctgtcaggagctcgtctggccacagccgccagcaggagagaccagctggcggtgcagggtccatcggcccgggcctggaatctgagctgccctcagaggcccagcttctctctgggcccccacaaactggcctttgttcctgggccggccaagacccagcagcttgggctttctgtctgcccgcggcacccgcgctgagctggcggggtaaatgggccagcctcccctctgtccatgcccaggacgtcgctttaggactaaatggagatgtaattttctatacaaatccatgacaatttagatggagtgattgtaattggcttttcaatgggggttttgtccagagctggtggctagaactgggtggcctgtttgaggcaggctccatttaaatgacaataaagcaataatattga

SEQ ID NO: 242093 - DNA, 449 bp, Homo sapiens
agtgtagagatcgcccttcctaacaagctagagcctacaaggaacttctctgaattagaattaattatgctggtacatctgtagagaggttttgatttgactcaaactgagactaccactcatttcttcttgattatttggtagtaataaggcccctgaactgaaccggatcccccatagtcctctattactttccaacaactgtgacttttattcttagcagtgacttccatcttcaagtggaagatgaacaatgtttctctttgggaggaaaatgcccaatttccactgatacagttaagaactgaggccgggggcggtggctcacgcctgtaatcccagcactttgggaggctgaggtgggcggatcacatggtgaggagatcgagaccatactggccaacatggtgaaaccccgtctctactaaaaatacaaaaattagctgggc

SEQ ID NO: 242094 - DNA, 314 bp, Homo sapiens
gcaccctgaaatttctgttatgcggattaaatatccactatccgtgtttttccgagtcttacagcagaaagggtaaatgcagccctcacagcagcctgttgttcgtcctgcaattgtgtttccatcacattacacaaagcctctttgtcttcgtggttctaccctactaataagttttttaaaaaattatgtaatgtgtgtatatacaaatacctatatgtttgtgtgtacacatacagctaatatctgctgagattatgtatgcatgaactatagaattaacttgtaattttaagaaaataaattattttgta

SEQ ID NO: 242095 - DNA, 381 bp, Homo sapiens
cagttcattagcgtaatttgctaggcattacacaagacattgggagatacaaactgtttagaggtgatatatgctgtggtaaacgtatggtgtgcatgcagagtggggagtactgaacttgtttccgtgttgaggagggcttacagaggctgtaacatgtcgtctgagttcctgtgaagagaaagtaggagtttaggatgaaggttgtctttgataaagagattagcatgtattgaaagacttatattttaggctggatgcagtggctcacgtctgtaaacccagcacttcgggaggtcgaggcaggaggatcccttgaggccaggagttcaagaccagcctgggcaacatagtgatgcctcccatctctacaaaaaaaaa

SEQ ID NO: 242096 - DNA, 254 bp, Homo sapiens
agccctaacagttcacaggaggaacatgagagtaagtagactgacaatctgactctactttgaattttaccaggaccttaagaaagagagaagcagggaagtgggcagttgagacaaaattcaaaaatatatttaaaaagttagacattcaggaaacatccaaaaggaaatataccaacatttgataatgtgtgaaaaaacaagcaaggatgtaatcaaacagagagggccaagataaagaaggaaaagtgaaa

SEQ ID NO: 242097 - DNA, 574 bp, Homo sapiens
ttttcgagtctttgaggaatcgcccactgccttccacatggaaaggacacaaatggttgaactgatttacactcccaccaactgtgtataagtgtgcctttttctccacaaccagctttgttaacagcgtgaagactagaagaaaaagaatggaagaaagaagtgaaagagaaacaaatagggaaggggatccctcggatgactgggaaggaaaggaaaaccagaaaaagcagtcaggatgaatgcctgacaaaaaactctgctgcagtgacactttgacatgaagcagattcaaactttctatgactgaacaggacattttccatttattgctcctttgatacccaagctcctcaatgggggtattcttcaatgagacacttttaccagtgaccatattcttgcttgttggtttcttttttttttaaagtatgttgctgctgtacttttaagaaagttgtgttttatcttagtactttgatattcataaatggtataaagcataattttaccacatagctttaatggaatactttttacaaacaaaataaaacttgaccttcttccaccctat

SEQ ID NO: 242098 - DNA, 539 bp, Homo sapiens
cccacagcacgtgggagaaacctcagtgaaactcaaagcgcagtggcttagaagtctggctcatcttcaacaatacatttgtggagaaatgacaggacaatggaaagcaattttaggtgtccgaaggcaagaaaccgtgggaagataaatatatgggaagaaactagtggaatacgtgtgtttgtacattcttctgctgacatccctgagctggtaagaatggtctccggtaaaagagaatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattgcttcagtacacagcattctgtggcatggcttcatgctttagcactgtggctctgaattaaagcctgaaacaatttataaaaatactggtaaaa

SEQ ID NO: 242099 - DNA, 536 bp, Homo sapiens
cagtggtaaatatctctgaccacattcttgcctcttggttttataaatgcaagagaaaagagatggtttctggtacatctgaatttactttttcatgaaaattctgaagttagaaaaaagactatatgatttccaataagttttggagggactgaccctagcaccccaattttcttttaatctcttcttaaatcaaatctttgtaaataatgctttcacattctattaaaaatgtatagagaaatattcacccaattatgtgaggatcgtaaaccagtcattacaatatgtgctagcatacccttgttttagtctgtgaagtgtaagttttgctaccctaaacctctgactaccctgctgtcgtcctgcctcacttccatgaggaatattttgtctgggtctatagattttcccagtccccggtgtgttaatgtgagaattgagtctccagtaagagctgttactcttccacatctgctcctttccttgtaggccgccaagtcttctgaactaaggaaagaaaaaaactctataaa

SEQ ID NO: 242100 - DNA, 513 bp, Homo sapiens
cttagaaggacataggagttccactatgatgtcaatgctgcctggtttgccacctcacctgccacctctctaccaccagacgtggggcactctacatcagctcctacttttatggttccaagtccagccatggtcttcctgactcgggacattcacacatactaattcttctgcttagaatgcccatctgtccccattccctctttattgctcagcaaagcccagtttccatcacacattctgcgacaccttccttgactctgcagaataagtgtccctcctgtgtgccttaaagcacagtatttgtttctgctacaacacacattaataatattctaattgtctatgttttcttctacccctctccacttccccagttagatgtaaattccttaaaggcagggacactctagtttattttatatctcttgcatccagtgtagtggctggtacaaaactagaataaataaaataaatgttattgaattattgttgaataaagttataacatga

SEQ ID NO: 242101 - DNA, 633 bp, Homo sapiens
tgctttctctgttcagggtagtcatggttattggcttgctgctgtttcttgtagacgtatgcctacagtttggtcttcctagagtatattttcttagatattattatttgtagttccctgtcaagactacttaatccgtgagtgctgcctgttttagatttgactcagctctcacaaacatttggagcattgcccatcccatataggggtcccaaagtcaatcctctggctgtgcaggaaggttggataggcatttgtgcaaagaactatgaactctgcctactacattatagtgctgctgaacagccactctgacttggcatctatgttgtctgacgtaaagaaaattttcaggctggagttgtgaatctcaactggcccaattgtctttcactgccatcatgggattttctttctacaagcacacacaatacttcccatgttttaagctattaacagcttttcaacaagagaagccaagatggtgaagaagctgtgtgccaaaatctcacatttatcccatgttgaactggtgaatgtcgataaaattttccacacatgatggcaggcacataggagtctcataaatacagaagaagccttttatcatctgctccaagtttttcacttctc

SEQ ID NO: 242102 - DNA, 579 bp, Homo sapiens
tgctttctctgttcagggtagtcatggttattggcttgctgctgtttcttgtagacgtatgcctacagtttggtcttcctagagtatattttcttagatattattatttgtagttccctgtcaagactacttaatccgtgagtgctgcctgttttagatttgactcagctctcacaaacatttggagcattgcccatcccatataggggtcccaaagtcaatcctctggctgtgcaggaaggttggataggcatttgtgcaaagaactatgaactctgcctactacattatagtgctcaggctggagttgtgaatctcaactggcccaattgtctttcactgccatcatgggattttctttctacaagcacacacaatacttcccatgttttaagctattaacagcttttcaacaagagaagccaagatggtgaagaagctgtgtgccaaaatctcacatttatcccatgttgaactggtgaatgtcgataaaattttccacacatgatggcaggcacataggagtctcataaatacagaagaagccttttatcatctgctccaagtttttcacttctc

SEQ ID NO: 242103 - DNA, 495 bp, Homo sapiens
ccagaggttatgtttctaactcttgggcatggcttctatttaaattgaggaatatattttatgtacaaggtatcatacaaaatactaaaaataatttttttaatatgtgtttttcaatcctgatcttagcatattattatataagatttgtcaataaatttagccagttagtttgtagtcgatagactcctttttgaagaccaattcttcaaatcccaaagtagtaattatttacattaaaggagaatatagtcatgaattaaacccatcaaaatactagatttttttgttctgagtaacagaataaaataaaagttgtaaaaagagaaagtgtttttcatttgtgtaaaacaatgtctttatacatgtgaagtagctgaaatttatatttacttaaaatttgttatatatactttaattttaaaatatctaaggaagccagagaaggaaagatgattgattcctttaagaaatagtaacagaataaaaaattta

SEQ ID NO: 242104 - DNA, 458 bp, Homo sapiens
actatcgtttaatacctatcagtgttcatatttcccccacttgtcaaaaatatcttgttattcagcagcaaagcagaagagaaaaagaaaaaataaggtcagatgtggtggctgatgcctgtagtcccagcactttgggaggccaaggtgggaggatcactggagctcaggagtttgagaccagcctgggtacaatagcgagactcagtctctacaaaaaaaaaatttgtttaaaaattagcaaggtgtgttgatgttcacctatagtcccagctattcagaaggctgaagtgagaaaattgcttgagccccagaagttgcggctgcagcgagctgtgaccataccactgcattccagtctgctgcaccgagtgagaccatgtctcaaaaaaaaaaaaagaatgctaatgagtctcctaccatggtgggtggatgggatgagtaacctagcgcctata

SEQ ID NO: 242105 - DNA, 841 bp, Homo sapiens
  misc_feature (630)..(630): n is a, c, g, or t
gagtcagagcgccccactcatctccctcctgctgagctgcgaaccagcaccctccgagacaagcgtgtttgcagtgccagctctgcccttgctggactccaagtctcctctctgggcagccaggacccacccatgggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgtgggaaaggggttttgtggttcaataactttcggaagtgctgcacacttgtccccaagttggacattcacaaaggccgttattgccgtaaaggctctgacaagccctatagaaaagcttcttgctaaaccttctttaacccatgtttttaaacttatttgaccacagaacccttttcttggggaacagtattaacccccaaggaattattggttctcaagtgcgttttgggagctgctgnccagagagctaaagggcctggggtgtgagctgactctccgctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaa

SEQ ID NO: 242106 - DNA, 385 bp, Homo sapiens
ttaagggtaaaaaagatctactggttaataaaatccaaacccgggacactatactttgcactacaataccctctcttgttagattagcaaaggaaaggatccataaacattacaaaagcaaagaaaggcaggaagccctcaactggttgtcagttgaagtgggctgggtttgatagctatttcttttaacatctggaactttagctttaaaaagtgttaataaagttgtaaagtataaaaactcattatatttctgtacactacaaacagtcaagaaattttaaaattatgccatttacatcagcatcaaaaaatcaaatatccgagaagaaatctaatgaaagatgtacaagactttttttttttttttgagatggagtcttgc

SEQ ID NO: 242107 - DNA, 318 bp, Homo sapiens
ttctgtgtttgtgtgcctctctgagtatgtactccttacttttgggtatggagaaggattctaaaatagggatcttatgaactatggtcaaacgaagtaggtcaggtaatttttttatgactggtgttacacaaaaaaaaggaagaaggaaaagttagaataatattcttaggctttatgactgactttttaaaacgggttctgcattgtggaagacagtgtggcaattcctcaaagacctagaggcagaaatatcattcaaccagaaatcccattactgggtatataccctaaggaatataaatggttctattacaa

SEQ ID NO: 242108 - DNA, 455 bp, Homo sapiens
tggccacattccaggccatcatctttagtgttctcctgtaggactcatagataacgtatacaaaactcagtaatagctgtggtccaaatttcagaaggtttgtaaagtaatgttctttaacgtttaatttagtctggagtttggtgtcgtattaaatacccagtaacttcttgatttgattctctaatattaatcattttgccattgcacaaaatgatgcccgttttttttctcatgaaagtcttaggttgtaagatttctcttgtatgagctgatgtggggcaaccagtgttttgaggattgacttttattattctatcaatgtgtgaaaatgtctgattaatttcatgtcatctcaagtataacgtgtcaagagcacaattattttacaaacaagagacttattagaccaaggaatttttttctatgttgtttaagcttttatgattacaaaa

SEQ ID NO: 242109 - DNA, 468 bp, Homo sapiens
atattgctgcattctcccttctaccagatcctcccacaagactgaacagttctcaaactagcgaaacttggttttatcagtgtctattctctgctgctacataaagatctccagggatacagggcacttagacatgaggctttcttgatattcttccttccctccctatagaagaggaataggccccaaataaggggctacatgatcattaggcattttccaacccaaaataagcatactcatcctattgctaaggtaagataataatactggtatcaacaaccttgggccaaatgtgaagatgttaaattcattttgcacacctattcttcaggattaaaaaatattatcctgataaatacagtaaacccattgtaaacaaaacttttcatgatgcagtaaccttacccattactcccttacctcctatcttaaataatgtttgagtgtattcttccctttgccatt

SEQ ID NO: 242110 - DNA, 375 bp, Homo sapiens
atagagaacatttaccaaaacagatgttaccagaattattcttgattacagaaagtttagaagtaaattctttaatgcggaaacaaaacaaggatatcttctatcactgctactctttattatattggagattttagccaaagtaattagataagaaaaagaagggagaaagagacataaagattggaaaggaagaaaaatattaattataaatgaaatgattatctacaagagaatctacatactattagaactgtccgggcgcagtggctcacacctgtaatcccagcactttgggaggccaaggcaggtggatcatgtgaggctgggagtttgagaccagcctgaccaacatggagaaactccgtctctact

SEQ ID NO: 242111 - DNA, 706 bp, Homo sapiens
  misc_feature (611)..(611): n is a, c, g, or t
cagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttactatggctcgaatgcctgcttcacacattcangtgttaccaatgtggttgattgagaggttgagcccttaaaccatgattatggcatgaaggcttcctctgggtgaatgagaataaggccttattaa

SEQ ID NO: 242112 - DNA, 687 bp, Homo sapiens
  misc_feature (490)..(490): n is a, c, g, or t
  misc_feature (494)..(494): n is a, c, g, or t
cagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggtcatgntgangaggagtatcctagattaatttaagggtttcactatggcctcaaatgccctcctccacacattcagggtgtaccagatgtggtttattgaagagttgccccttttaaccatgattacgccatgaagggctcctctgtgagaatgagattaagcgccttatttaaagaggttaccctcagtgttaaacgaactt

SEQ ID NO: 242113 - DNA, 388 bp, Homo sapiens
ctcccctccctcctcccgtgagcgtccggccttgtgcatcctgaggccccgcgctgggcgggcctggagggtcgggcccgccaggaactctatttccaaactcctgttgggaggccgcgcgcggggcctcacgcctgtaatctcactgctcagggaggccttggcgggaggatcgcttgaggccaggagttcgagaccagcctggacaacacaccgagacccccatctctacaaaaaattttaaaaaattagccaggagtggtggttgtacctgtaggcccagctactcgagaggatcgcttgagctcggaatgtcgaggctgcagtgagccatgatcccaccactgcactccagcctgggcaacatagcgagaccccatcactgcaa

SEQ ID NO: 242114 - DNA, 373 bp, Homo sapiens
aggggcttgcagtaggttgaatggtggccgccccagaagatatgtccttggaacctgctaatgaaaccttacttgaaaaaggcatctttgggccgggcacagtggctcacacctgtaatcccagcactttgcgaggccaaggccagtggatcacctgaagtcaggagttcaagaccagcctggccaacatggcgaaatcccatctctactaaaaatacaaaaagtatctgggtgtggtggtgggtgcctgtaaccccatctactcgggagcctgaggaaggagaataacttgaacctgggaggcagaggttgcagtgagccgaggtcgcgccactgcaccccagcctgggcgacagagcgagactccgtctca

SEQ ID NO: 242115 - DNA, 182 bp, Homo sapiens
ctccatttgttctacttcctcccagttctactgaaccatgaatttaaatttgcaaagcaattaatagcagtgaaacatggagatgcttaaaattcacatacacaggcaataaagaatactaatacagagccttataattatcaagtgctgataacactcaagcatccctgaaggaaaaaaaa

SEQ ID NO: 242116 - DNA, 401 bp, Homo sapiens
tcttatggggtatccagagaagtaaaggcacatggcacaggctgctcagtgccgggacaaacatcagggaaggatcctctggacaggttggagctgagtgggagagtcagagaggcctccttgggaggggacactggagctgagtctggaggatgaccaagaattggcccagagaaggtagtggggagattttaagagcaggtaacagcacagccaaagaaccccaagccagggaaagcaaacacaatgggggtgggggcagcgggggcaagttgtgtggcttgtggtggtctcacctccccgccccccagttagctctagttcaggctcaggacaaagtctcaccgtgctctgttcagtgttcaatcagaaataaaaatagtaaaagcacatctgccatt

SEQ ID NO: 242117 - DNA, 657 bp, Homo sapiens
gattgtgttggccgttagagcaatttgggcagaatttacatcttagcaatattaagtcttctggtccatgaacactgtatatctctccatttatttagatcatctttgattttttctgttgttttcaacattcagattcttcatctatttattagacttatgcctaaatattttatgattttggtgctattataaatggtatatttttattggattgttagttcattgttaataagtagaaatgtaattgatttttgtatattatccttgtatcttatagccttgataaattcatacgttagtttgaagagttttttttctagaaaccttaagattttctacatgacaatcacattgcgtatgaatagaaaaggttttactttttcctttccagtctgtgctttttttttcccttactgtattatactgactaaaacttttggtatgatactgaatagtagtggttagaatggacagacttgtctgttttcagtgttaaggcgccatttatcagtttaaggaggttctatttctagtttgctccgagttttggtcatgaataagatattatattaacttttatcaagtgctttttcttcatcttttcttatttagtctgtgattatggagaattacattgactgatttttgaatact

SEQ ID NO: 242118 - DNA, 663 bp, Homo sapiens
acctctgatgcagtttggaccaagttttcttcagccagctaatttagagacaagaacctggatatttattgggcgtttgggggacttccttacagccctaggtctctgtgaaaagggccctggattatctctgcaaaagcccacctgctattggttagccaggactgtctccactttcagacaccagcttcatccaaacactctttgctgtatttataaccacggtgcatttcctcgggacgcacatcttacggcttcttggccccttcgcccagggtgcactgcctggaccatcgccctccggcagagacagtgtctttctttgtatgttctccttcctctggtcgagatgtggcttggtcacctggagtggggccgtcggcaagtcgcctgggcttcgtggaggctcgctgcccccatggcggaaagctcggccacacaccctgatgtctcgacacctttgagttgcccatgaatgggttttcagagcttcccgtgtttacttcgctgcacgcctctgtttgtgctctggggaaattcttggcagaggaaaagccaattggaaaacagccctgcttggtgtcagggcttgaggttgagggagaaagactgaaacggagatttgcatgagctggtttgagcatgtcacaagactttgtcttt

SEQ ID NO: 242119 - DNA, 340 bp, Homo sapiens
tggcatagatgcttttgtttttattagcaacagaaaatataaatatctaaatataaacttcacaagaatcatgtaaacttacatgaggaaaagtttaaaacactcctgaaacacaccaagagcggacatggagtcttcattctaacaatctgtgtattggtttgaataattcaatacccaatgtctttaattatctaaccatggttaaggcactcccttgccaaagattttagggatggatgtgtgacccgttgctggccattgagatgtgaggcaatatctgctggcatagggcaaaagtctctcacccttaaatggaaccccaaggaagatgcagact

SEQ ID NO: 242120 - DNA, 586 bp, Homo sapiens
atgtgtcaggtgtgtctattcctggaaccttactttgcctgctggagtttcccagtctgttccagatgcactctctcgaccctgaagggacctgaggggggatgttggtcgccagtgtgtgctcccctggactcgattggaattggtcccacaaagtgttatttatttatttatttatttatttatttatttatttatttatttggagggagtctccctctgtcacccaggctggagtgcagtgggacaatctcagctcactgcaacctctgattcccaggttcaagtgattctcctgtttcagcctccctagtagctgggactacaggtgtccgccaccacaccttgctaaattttttatttttagtagaggcagggtttcacaatgttgatcaggctggtgtcgaactcctgaccaggtgatcgacccaccttggcctctcaaagtgctgggattacaggcgggagccatcacaccccgccaatcccacaaatttaggcattatggtacattgctacttttgaatcacttatttttttagttgtgttttcccccctccttttattgattgattgacacagagtc

SEQ ID NO: 242121 - DNA, 99 bp, Homo sapiens
cttcccaaccccctacctgccaaattatctttaaaaattcctatccccaaatgcttggggagactgattcaagtaataaaaaaactccagtctcccaca

SEQ ID NO: 242122 - DNA, 647 bp, Homo sapiens
tccagaaataataattttaaattatgtgccattctgagtagcatgatgaaatcttgcaccatctctgtccctcttgcctaagacattaatcattcctttgtccagcatgtccatactgtctgtgcttcctgcccgttggtcacttcagagccatctcggttatcagatcgctggttgaggtactgcggtgcttgtgttcaggtagcccttattttaataatggcctcaggctggtcacgggggctcacgcctggaatcccagcactctgggaggccgaggcgggcggatcacgaggtcaggagatcgagaccatcctggctaacacggtgaaaccccgtctctactaaaaatacaaaaaattagctgggtgtggtggcaggtgcctgtagtcccagctactcaggaggctgaggcaggagaatggcgtgaaccctggaggcggagcttgcagtgagccgagattgtgccactgcactccagtgtgggggacagagcaagactccatcttaaaaaaaaaaaaaagaaaaaagaaaaaaatggcctcaaagcacaggaggagtgatactcataatgtggatatgccaaagagaagccgccgcaaagtgctttctttaagtgaaaaggcggaaagttctctacttcagga

SEQ ID NO: 242123 - DNA, 328 bp, Homo sapiens
atacaaattcatgatttaagctaattggtactaaaactaaattgttaaaatctgatgttcattgttgtggggaaaaacatgtgtgaaaatcaattatccaagcatttgaattaaagaattaaaagagaacaatgtgacacaaaaatgtaaaatggaataaagataggagtggtaattaatgacatagaaaacaaggcacaatagggaggatcattaaagacaatggttattgtttaaatagattattaaaatctacaagctctggagagagtatttatgattatatgagaataaaaagataaaaatgataaggaaaataaggcgataa

SEQ ID NO: 242124 - DNA, 482 bp, Homo sapiens
gcagtttaatagatattcaggtctgccttcccaacatatatctgtaacagatgccttcagcttctcctttttctttttttaggcatattgtatttggaaaacatttgcaagtttgcctctactgtggggaaaaagagagggaagagtatcattatatgcaatgtttaaataataaaaataaattttgaattgggtttcctaccccaaaatctggcagatacttttccttaagaaatcactccctgacttaaattttagatagtgccttgactatcttttaaaggaaggaatagtattacatatatcaaaattgtttcatttatttttaaataattgtaaaactcttagaaataccacaggaggctgggtacggtggctcatgcctgtgatcccagcactttgggaggccacggtgggcggatcacttgaggccaggagttggagaccagcttgaccaatatggtgaaaccccatctctacca

SEQ ID NO: 242125 - DNA, 489 bp, Homo sapiens
tgcctcagcttcctgagtagctgggattacaggcatgcaccaccaggcctggctaattttgtattgttagtagagaccctgaccatgatggtcgggatggtctggaactcccgacctcagatgatccacccacctcggcctcccaaagtgctgggattacaggcttgagccactgtgcccggccacatgtagcatttctaagtagaattttattgtgtatgatgtggaagagtcgtagaaatctgattattttcctatagagcaggggttctcaactgggggtgattttgcctctcaggggacatttgcctcactcagcctgcccaccaaattgcctggagacatttttggatatcacaagtgggaagtgctagtgacatctagtgggtagacgccagggatactgctaaacatcctacagtgcagaggacagcccctacatcaaagaattgtctggcccagaatgtcaatagaaatagtttctcaagg

SEQ ID NO: 242126 - DNA, 731 bp, Homo sapiens
atgcaacacattatcaacaggtaactaattgtcctataactctaggggtcagtcctcctgtgatgctaggtataaaaggaatgtgattctgatcagttcactaatcctactgtttctcactgctacctggaattgttggggtgaagcctggtccctgaacaacctaatggatggatgatgcttgctcacaactgtgatgatgctttaactggtccagatccttgcagaggcagcagtgattctttaagggaggatgaacccaatcccttaatgccacattctttcaaggatgctctaaattaggtctcctaggttctagatcttaacaatcagctccttcagtttatatatgcagccacatctcattgtgtaagccggtcccaagagtactttttgaggacattttgtagaatcttttcactaacaaacctcaaactttcttccctccccagggcttaagcgcctttctttagtcactcaaaatataaagagtcttgttaaacccttatctcaggacagtagggcctgttcatgctatacttatgtaactaaaggaaacccaacttaaatgatttttcacagtcaggaggatctgcttcagggttattttcctacctctacccaaatggcaaagcaattgcacacttctcttgctaaagaagaaaggaactacaaatttaatctttataaacatctctcttatagggcattttactatacttaatgtgttt

SEQ ID NO: 242127 - DNA, 2244 bp, Homo sapiens
  misc_feature (61)..(61): n is a, c, g, or t
  misc_feature (108)..(108): n is a, c, g, or t
  misc_feature (124)..(124): n is a, c, g, or t
  misc_feature (182)..(182): n is a, c, g, or t
  misc_feature (309)..(309): n is a, c, g, or t
  misc_feature (877)..(877): n is a, c, g, or t
  misc_feature (880)..(880): n is a, c, g, or t
  misc_feature (963)..(963): n is a, c, g, or t
  misc_feature (968)..(968): n is a, c, g, or t
  misc_feature (1063)..(1063): n is a, c, g, or t
  misc_feature (1212)..(1212): n is a, c, g, or t
  misc_feature (1227)..(1227): n is a, c, g, or t
  misc_feature (1233)..(1233): n is a, c, g, or t
  misc_feature (1918)..(1918): n is a, c, g, or t
  misc_feature (2073)..(2073): n is a, c, g, or t
  misc_feature (2182)..(2182): n is a, c, g, or t
aagcgggtaacagattctcggtcattctggggtcaagacgagctatcccggtccgaatcgnagtctggtctcatcagcttcctggtttgtagaggatgaaccctggcncagagaaggacagccncttaccccgggccgcacagccaagtagaaatgtcaggcggccaagagtcaagacgcanaggacagggagctggtggcgggggtggtgctctggaggctggccctgcccccagctgatgcctcaggctcagcatctcgagaaagtcctgccccctggcttggtgcttcctcgtggccctgagtccnggggaaagtccagggcagggagtatgggtacttgttcttcctctttagggctggccaggggccaggggagctgtgtttgctcagggtggaacctgacaccctttggaatggattgaggttagcggaagcctaggctggggggaggggtcgcccagggagcgaacgggcatttattgtgcacttactgtatgcgcgagtgtggggtcaccaggccttggagattcagcagtgagcaaggcaggccaagcttcctgctctcgtggggcgcatattttggtggggaaagacagacatgaaacaagagcgcagtaatggagccaatggctgcacagagggtaacatgcgtgagaggcgctttgtaactttattttactttttatatttttttgaaacggagtctcgctctgtcgcccaggctggagtgcggtggcgcgatctcggctcactgcaagctccgcctcccgggttcacgccatactcctgcctcagcctcccgagtagctgggactacaggcgcccgccaccacgcccagctaatttttgtatttttagtagagacagggtttcnccntattggtcaggctggtctcgaactcctgatctcaggtgattcgcacgcctgtaatcccagcactttgggaggccgagacgggnggatnacgaggtcaggagttcaagaccagcctggctaacatggtgaaaccctgtcctactaaaagtacaaaaaaaaaaaaaaaggtgctttatgtgtctncttaattcattaattaatatgggaaccggtaagactttatagcctatacagaggggaattaatttgtttcctttctttcttttttttaaaaattgaaaatagaaatggggttttgctgtgttggccggcctggtctcgagcttctgggntcaagtgatctgccngcctcngccactcaaagtgctgggatttcaagcgagagccaccgacccggcctcagcattcttgattgcctgtgtgtgtgtgttctttcagttctcctctggaccagacacggtggctcacgcctgtaatcccagcattttgggaggccaaggcaggtgggtcacttgagcccaggagtttgagaccagcctggcaaacgtggtgaaactctgtctctactaaaaatacaaaaattagccaggtgtgttggcgtgtgcctataattccagctacttgggaggctgaggcaggagaattgcttgaacctgggaggcagaggttgcagtgagccgggatcgcaccactgcactccagccccagagacagagcaagactccatctcaaaaatgtcattccgtgcccagaatgacagcaccttagcgtagatggtttccatggggcagggggccccctctagccctgggacactgtaattcacctttggctttcccactgggggcccgagtggagttagaagcatggagaggcagcccaggggatccttagtggcagatgcttaaacctttgagccttccctgaaatactgctcagggtcaaaaccgggatccccgttttacagatgaggaagctgaggcaggggctggaattcacatgggctctgcttttctctctctgctgtggaacttcctnctagagctcagccgtcctcccttttgggggaaatggcatctttggcatggcttggtggctcccgcctggaatcccaacattttgggaggccgaggtgggaggatcgcatgagcccagcagttcaagacaggtccgggcaacatagcgagataccntctctacaaaatatacaaaaatctgctgggcagggtggcgtgcacctgtggccccagctacacaggaggctggggtgggaggatcgcttgagcccaggaaagtggaggntgcagtgagctatgattgcaccactgcactccagcctaggtgacagagcaagactctgtctc

SEQ ID NO: 242128 - DNA, 479 bp, Homo sapiens
actacttcttaatgttccagtgagagagagcctgaaatctgcagtggtgttgagagcccatctgtcctgctgcaaaggcccaaggaggaagaagttcccaagagaggttccagatgtctcaaatgaatccaaaatccaatcagatgacctaggactgtcatccaactcaagcaataaagaaaccagtaatcacagatgactgcctgccaggtgcttcgtgcattttacacagtattttcaacatgggctttaaagtcagaaaattccagctatgatcatttttagttgtgactttggtaagagtttcaaacacagtatcttctactagtattattattgctactaccctccaactgttccttttactacggtgatgactgtctcattgaatgctacataattctccctaaaaccttatgaagtagatatatatatccactatatcaagaaaagaaaataaataaacaaaaagcaaaatt

SEQ ID NO: 242129 - DNA, 435 bp, Homo sapiens
agccaccctcatttttcccctggacaactgaaaaagcctctttagtggcctccctgcttcacaacagtccctcccaaatacattctccaccagaagtgagaatgaacacttcaaaaatgtaatttggggccaggtgcagcggctcatgcctgtcatcccggcactttgggaggccgaggcgggcagatcacttgaggtcgggaggattgcttgagcccaggagtttgagagcagcctgaataacatggcaaaagcccatatttaaggaataaaaaaatacaaaaaaaattagctgggcatggtggcatgcgcccatagtctcagctactctggaggctgagatgggacctaggggaggtcaaggctgcaatgagccaagatcatgccactgcactccagcctggctgacagagtgagaccctgtctcagacaaaa

SEQ ID NO: 242130 - DNA, 847 bp, Homo sapiens
ggggtggatggaattctagcacacaggtggtgggggtcccatactttttgtgagaaacttgaactgaagtattcaagaacaaaacctgtgtgttacagtagccacccaagatgatgtttatgattcaaaaaacaaaatccaggaacacatgaagcaagagaaagcgttctgcttttgatttatgtgcttctttttccaggagaacatgagcagcttcccaggacatggaaactggcaggcactctggctggagacatgctgacagcgcagtaagggctccgggccgctcccctcaaggcagtgcctggacagggggccctcgtgggcagccatgagccttccttgggaccagcagttccagagatggaattaattctccagagggcagtggaggaggaagccaatgaagtaattctatttgttcaaacccaacttgaaagagggaaaaatgagtcaactctttctttggagtggctgccagtttccagataaagtttgttcaatcaaggagctccccatctgaggtgggcatgccaggcacgggtgtggtggtgacgggtcaggtggcacatgcaggatggtgaagggcaggtgagggcaggccgggtcaacacggaggcagcgcccctgcagccactgggtgtgtcccactctgctgccatgtggcatgcatgctccatcatcctctgccaccacggtgaagaggccagtgctgattccgtggacatggaaaactgagtgggagtcagaaaactttctgtgcctcagttcctcatatgataaacaagaaggatgtacgacatgcatgacaggttttctcccataatcataaaaatatacaattaca

SEQ ID NO: 242131 - DNA, 365 bp, Homo sapiens
cttgcccagctcatagtgtgatgtcgtcctaacctcactggtccactccagcaccgaatcctgccaggctgtggtcaggagagagcagctccacttatctcttcaacagacttccgctaatttcagtctaaagatgctctaaaatatgtggaatggccacactgtgtgccaagggggtgcacaatttcaccagaggaagtcagtggtcctgctgaacctgttcccctgtttcctcatgggtgacgtattggggccagtacctaaccattcctccctcagtgttctcctgcagaaaccaggctgtgtagtgttatgagttaggcattgctgttagctatgcatccttctttgtactgtgtgtggga

SEQ ID NO: 242132 - DNA, 456 bp, Homo sapiens
aggcccagtgtgtggtgccccaaaacaattacagttgacccttggacatcacaggtttgaattgtgtgggtccacttatatgcaattttttttcagccaaacatggatggaaaatatagtattcacaggatgcaaaacctgcatatgtgtagggctgacattttgcatatatgggttctgcagggctgatttcagaacttgaatatgttcagattttggtatatgcaggggtcctgtaactaatcccccttgtattctgagggacaactgtacaatagttacatcaaaggtcattgatcacaaatcaccgtaacaggtataatagtaataaagtttaaattttgtgaaaattaccaaaacatgacacataggaagtaagcatatgctattggaaaaattgcactgatagacttgtacttgctccacttaagtttgtcagaaaccttccatttgtaa

SEQ ID NO: 242133 - DNA, 444 bp, Homo sapiens
gtttcctgaggcctccccagccatgcagagctttccttcccacgctcacactctctcctactgccttgtgaagaaggtgactgcttccccttctgccatgattgtaactttgctgaggcctccccagctatgcagaactgtgcctgaactctggcaatgacctgaagggccctcacacagattcttctccagtgcctccagaaaacaacgcagctctgcgacccctgatctcagcctcatggaatactgggcagagaatccagtcacagcttgcctacacttctgccctacaaactggaagctgataaatttgtttcattttaaactgttatgtttgtggttatctattacacagcaatatgggcttattccaaacaggctgtatgaattcaggtccctgaccaaatctggttgactgtaaaaatgaaaaaggacaacctgagt

SEQ ID NO: 242134 - DNA, 392 bp, Homo sapiens
ctcatgcctggaatcccagcactttgcgaggctgaggtgggtgaattgtttgagcccaggagctcgagaccagcctgggcaacatggagaaacccgatctctacaaaaaatacaaaaattacccaggtgtggtggcatgtggctgtagtcccagctactcagaggttgaagtgggaggattacttgagcccaggaggttgaggctacagtgagccatgattgcaccactgtgctccagcctggacaacagagtgagaccctatctaaacaaacaaacaaaaaaattatttccatatgtaaatgaatgggaacactgtgctagaagacattgtaaagaagcctgatgaggattccaactgataacagccacgttcggatttagaaaaatgtaa

SEQ ID NO: 242135 - DNA, 369 bp, Homo sapiens
ctctaccaaaaaaaaaaattagacgggtgtggttgtacatgcctgtagatccagctactcaggacgctgaggtgagaggataactggagcccagatgggaggtcaaggctgtagtgagctgtgttcgtgacactgcactccagcctggctgacagagtaagagcctgtctcaaaaaaaaaaaataataataataataatttcaacaaggtggtaatcttaacagataattactaaagcgttatcaaggaagacaatatgcatcactgatctatttcttaagaaaaaataataaataaaattaaaacctcatgattttataacctaatagaattttgtaagcacaggttttcaacaggtagctgtaattt

SEQ ID NO: 242136 - DNA, 1190 bp, Homo sapiens
agaagggagggaaagaaatggggcagaaaatatatctgaagatataatagcaaatctctttaaaactgataaaaataacctagagctccaagaatatcagcaaatcctaagcaagataaagacaaaaaaaaacaaacaacaacaaaaacaataaaactgcaacaaggcatatcatagtcaaactgctggaaaacaaagacaaggagaaaaatcctaaaggcagccagaggggaaaaatagtataaataactgactttttaatcagactacagaggccagaagataatggtactttttaaagtactcaaacagagggagaaaactgtcagtccaaggttaaataacgctattgaccaacttgagctgattgagatttatagaatactctacctaaaaaatttagcaaagcaataaagtataaggtcaatatgcaaaaatcaattatacttctacatcctagtagcaaccatttggaaaataaaatttaaaaaccatttataatagtatcagataatataaaatgcttatgagtaaacttcaggcataaaaactacaaaagcaggttttagagaaattgaaggtctaaataaaaggggagctagataggaagctatatcatgcccacaaattgtccgaatcaatatggttaaggaggtaattgtccctaaattgatctatagattttacttaatgtaaactgaaatcccaagaggattaaaaaaaaaaaaaaaaaagaaattgacatgatttaaaattttctgtggaggaaggttttccaataaaaaccagaaaacctgctagacaaattctaaaagagctgttaacacttgatttaaaatttatatagaattgcaagagatctagaatagccaaaacaatctcaaaaaagaagaaaaccttggaggacttatgctattacctggctgcaagacttagtataatattataacaataaagttagtgtggtatttattaacatagagatgtataacaggccaatgcaacaggaaaaaaggtcaagaaatagactcatgcttattagtcaattgattttcaacaaagattttaaggcaattccatagagtcagaaaagtgttttcaataaatgatgtcaaaaacctgaacagaaaaaaaaaagaaagaatcttgacccatacacctcacaccaaattaaaaaattaattcaagat

SEQ ID NO: 242137 - DNA, 597 bp, Homo sapiens
aatcaggaaggagtgggaggagcaaggggagaggcggggtgatcatggcaaacgcatgtcactcaccactttgtcaggcactaaatgcttgcactgaataatatgtgagtggactcatttgacctggcaagaaccctgagagggcatcagtacatctccattttatagacgaggaaacaggcacagagaagttgccttgtgcaaaatctcagtaaaaatggtgagactagattcaaacccaggcagcccagctcctgtcccctctaccactgtgatgagatgaaaaagactacctgtggttttgtggcacacccaacatctctggaaagggctcctgtctccaggtaggtggaccagagaacttgagcgaagctcaagccttctcaactcaaggggtgggcaggagatgtagagcctgagcgtgggcactgtggactggaaagaatgtgaaggaagaatggagccaggctcagccgggcatctgtctccatctgtctaaagggaggctttgtcaggcttcagctgtttggggactggccccttctatgaccatttcagggctcagcaccagaaaggatgatttctgagttcattgga

SEQ ID NO: 242138 - DNA, 397 bp, Homo sapiens
tccaaatggagacagtaataaaagtgctttagaaactgctattaaaaaacattttaatgaggacatccagtgctctgatgtctcccctggggcccctgattcaatcacccaggaattcaggtcaggcttgaatctgagtgcaccacctgcaccaccgcacagaccagtgtcctcctggttccgcattgcacggggcaggtgagaagtgagatggcaatgatcactcaactggttggccgacggcccccaagtggttgagcaagagcaactgctggatcttcgaggcaggttagagttgtttccagactggcagcctggatctcacttcctcttgggtgtttctgatggggcagggtcctgtgtgcagtgctgctgtgataactctttcctgtctcca

SEQ ID NO: 242139 - DNA, 143 bp, Homo sapiens
gctagacatagagtaattggtcagtgaaaccttgctgatttaaataattcaaagacccaaagtgaactttatagaggcaggttggataacaccccgaaatatttcttactctattattgactgttcttagtgatttattaatt

SEQ ID NO: 242140 - DNA, 372 bp, Homo sapiens
cgataaatagatctttggtcatcttacttaattatctggaatgtgttcatttttatcaatgcctgagattatatttttaagtcatgaaggaaggaagaaggaaagaaggagagagagagaaaggaagaaagaaaaccatgaagtgatattgggaagtggctcctaggtaaaacaatctgcttgttgttatagatattcctcttataggtgtaaatgtagctgctccctcacaccttcactttacagtcttggaactccatagcagaaggtgataataccgggattagaggaacctctaactgtgtaaaatgtcctgaacttatttattttaattttggtgaatacaaataaaagaagatttattttattctg

SEQ ID NO: 242141 - DNA, 1499 bp, Homo sapiens
taagaagcagagcacttcaaagagctgcaaatagtttgaaatggttagaacatgggttcttacaaggctgaagagtgaaataatgggtaaatcataaaagaaagataaaccaatgctgcttgaattgactgagtggtcatcacaatctaacactttgtaaattgttttactttgctacctattttctagaaggagagctttcaacagaaggaaatgaaatgaatgaaaacttctaatcaatgtccattatttatgtcctgtgttttcttgttagttttaaatagagtttgataaaggttcacattacattggcttgggtttttattttaactttttacaaaatatgatttagttttacaaaatacaatttagttttagtctactcactaaaaagaagcaatgtgatcatcacgtacacagttcagtttccatctgaaatgtctatattataggaaaagtgcctctttaatgagaaaatatgcaggaagcttgttgcatcagatgtctgtatcattttgtctttggaaatggatcaatttttgaaggtagtgatactgacgataattttctaaataactttatcttcctcatcgcactatttcccttttttcattgctactacaaacatacccacatgtacactcacaaaaccacaatccctgaaatatgaattgcaagtattagacctatagcacaggtaagaaaactaaggtagagagaggcaatgactagttactcttttccacagtgtgtcagaagcagagtctcttgagcggtgacttactactctttagagtaaatcctgctgcctactgcataaattcaagaattctgctcctttatttttaaaatttactgagcgtaaatacaataacttttaagaaaaagagtgtaacagaatggttttaaagcatggatttttgggatttcaaaagaactactttgaacttgtcttccccatttattgcatagcttaagaaagtttagttttttctcatctgtgaaaaaggtttaataatagctcttagctgttataagcagtaagttagataaggcatgtgaaccctataaaaagttcttagactatagtaataactcaatcaaattaactcatcattgagaaaatgaagaccaccaagtagcagtaaggcttcagagttgccttcaataagaatcacattagaaattgggctcaattaaaatatggctataattaattagaaacacatttaggtataatatttcctgtcccaccataataaccatcacaatgacatatatgcatattcacatgttagctccatggaacctggagttctagttgttttgttcacctttatatcatcagcacaaagaacaatgctaagtacacagtaggtactcaagagatgctttaaatgaatgcattaagcgaatctcacatttcttttttattcactcagcttcttttcagattatttgtttatcttaatgctggttaaattattttgagagaaaga

SEQ ID NO: 242142 - DNA, 517 bp, Homo sapiens
ttgtaagagcatattacatgtttcagttgattacctttcagcttagaaggcactttccagaaaccatccacacttctcgatcgttgtatgaatcaaaccaagtgcaaaccaagtgtttgcagtcatgcctgtttccataaaacatcccaaatagtctgcatcctgcatttgccagtggcccatgtatttttttttttttctatttcactttcatgttattagaaagatgaatagtgcactgctcaggacacttttctaaagcgagtaatcaaaaagttttttggtgatagttataatgtcataatataaccagacatcaaaaatggaccacagtagctacagaggttaagtcacagcactctaatggttatatgtattaatttgtcattgtcaggtttcatttttaaggtgttaaaattttcctacactgagatggtaatatacaagggagttgagaaaattcagtttgtttcatttggaagaattatttgtgacagttttcaaaacattttgtaaa

SEQ ID NO: 242143 - DNA, 507 bp, Homo sapiens
ggctcttccagcacagaactaactctcagacccaggagtctgtcccctctgtgcctagtatctcacttgtgaagtggggatgtggatagtacttgtattagtatttcattgtattacttattcttagctgtataatagattaccaccaaataatggctgcatactgcaaacatttattatctaacgcagtttctgtgagtcaaggacacaagagtggcttggctggatggttgggctgagggtctcacaaggcaatagtcaggaggtcggcaggattgcagccatccaggggtttgactggtggtggggaatccgttcccaaggtggcgagtctgtggctgttggccacaagacctctccacagggctggttgactgtctaacatggcaactggcattcctcagattgagggacccaatagagagagcaaagaggaagccccaggcctctcttgtttttgaggaagggtctcactccagcctgggcaacaagagtgaaattctgtct

SEQ ID NO: 242144 - DNA, 347 bp, Homo sapiens
tttctccttaaaatccaattttgaaaagcaagttgaggagttcagccactgaaagatcttcattgatttatttttcccttccttatttattaatgggaccactttctccttgatatttcttttttctctctgatgtatttgtaaaagctctgctcccgcctcttaacctgatgcattagattagcccagcctttgggtttccttctctcatcttttcctttccatccattctgactctagttgagacacttttatgtcttcttccctaaatccctatgtccagaaaaattttcagctcatctgtaactgtcatgtggatcctggaagtaatcaaactgctgacttcc

SEQ ID NO: 242145 - DNA, 259 bp, Homo sapiens
cggccctgaggtaaaactttctaattcaatcataataactaggatccagagtcatactttatatttttagacaaagtgatttcttagttgcttcaaggggttcatgaacatgctaaagggtgatttgacctcacagaggggattcaaggataatgacttgggaggtcaaggccactccaatcttcccaactgtatttgatgggtttttttgcctagacccctgtaaaacagcattaaaacttttcttttatagcaatga

SEQ ID NO: 242146 - DNA, 325 bp, Homo sapiens
ggtggcttatagacaacagtagtgtatgtctcagaattctggaggcagggaagtccaaacgaaggtgtgaagatgtgggcagatggcaccttcttgcggcagtgtcctcacatggtgaaggggcctatgagctcctttggccctctttaataaggacacttagtccatttatgagagctctagcctcatgatctgatcatctccaaaggcttcacctcttgatgctgtcacgtcgggaattaggtttcaacatatgaattttgagggaacacagacattcagaagttagcaccttgattatgctttcatatggagctatcttgta

SEQ ID NO: 242147 - DNA, 462 bp, Homo sapiens
tgtgtaaggaccacatacagtcatatagttgctgtatgataaacgtacttgatagcaataacttaagcataccctgagaatgaccctgaatatgtacggcaaatacacctgaatatgtgttccaagccagggaatcctggagtggccaacccggagattcatttcttgtctgtgaagaacatttgagcccttctgcctgtccagtggaacacaggccatataggggattgaggccctgagttttgggttggatgaaggttgccagatggaggacattaaggggaggatgttaagtgaaaatgttgtatagactgcatgttgtttgcaagtgatgatggttttccttcccagcctgctgccactggaccgtacgtaaggtggttctcctatgcagcccactgccactggactctctgccctatgtgttagcccctgataaaactccatgtctcatttgttggc

SEQ ID NO: 242148 - DNA, 980 bp, Homo sapiens
cattatctgtaactgtttaatgttagcaacagaaatgtatgatttaatgaccttattaagggaaaggctgccatgggaaatcagccgtaagatacaacactacattattaatatctgtaaaacagtaacataccatctgagtcactgctgaaccaagcaaaccagatttagctccttctttacattcctccccaaaatttcataaccagaaagggatgatctgtggcagtgccttgtgaaaaagggcagtagctcaaggcagtagtatcacagaattatttaatcattcatggaaatcttgcctctactctccgtatgtccttgagaaactaaacttggcttggcttttaattaacacccaagaaaagaaaaaaagtaaatccttattcatagatttaaaaagctacgcagagaaatgttcaaccttgtatccaaatgataattcaaaaaaagaaacaaagaaaaaaactggggttaaaaaaagctcagaaaaagcaaaagttcttctagatatctggcacttagctagtaagtttttataacgtatccaggaaataacactgagacctaaatatgaaaaaaaaaaagaaagaaaagaaaagagaaatcagggggctagtgggggaacacttagtggatggttctactttatgtaggtatgctatccatctctatccatctcttagaaaacaaaaccggaaatctgggcggggtggctcacgcccgtaatcctagcactttgggaggcagaggtgggcgatcacctgaggtcgggagttcgagaccagcctgaccaacatggagaaaccccatctctactaaaaacacaaaaattagccgggcgtgtgcatgcctgtaatcccacctactcaggaggctgagggaggagaatcgcttgaaaccgggagccggaggttgcagtgagccgagatcgtgccattgcactccagcctgggcaacaagagcaaaaactccatctc

SEQ ID NO: 242149 - DNA, 379 bp, Homo sapiens
ttttctgagacggaggcttgctctgttgcccaggctggagtgagactccatctcaaaaaaaaaataagctaaaataaaagaaaatgcattatagccgggcatggtggtatgctggagtgtgtctgtaatcccagcttcttggaaggcagaggtgggcgatcacctgaggtcgggagttcgagaccagcctgaccaacatggagaaaccccatctctactaaaaacacaaaaattagccgggcgtgtgcatgcctgtaatcccacctactcaggaggctgagggaggagaatcgcttgaaaccgggagccggaggttgcagtgagccgagatcgtgccattgcactccagcctgggcaacaagagcaaaaactccatctc

SEQ ID NO: 242150 - DNA, 434 bp, Homo sapiens
ctctcccgctgctacaatccattaaccctggctgcctctgtatcccttaaacacctcaatttctgcccacttcagccctctctacttgttcttcacactttctggtttgctctctccccagatctttgtgggctggcacctccttctcatttaggtctcagcttaaatgttacctccctagaagagtccttcttgatcaccctacctaaagaaacctaccctagactcccttaccccattccctgtttttttcttcagacaccactatctgaaatgatatcatttctttgtcaattatcagacttcccattagcacgtaagctgcatgagagccaggaccactttattcacactgtatccccagcatatagagcagtgcttggcacatgattaatatgtattttgaataaatgaatgttttctgttcaggcata

SEQ ID NO: 242151 - DNA, 2550 bp, Homo sapiens
caggctggtactggccctgggatgtttagcatcttgtgggaactgtcagaccagctccaggcgctggggctttctcatgtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccaaaccctg

SEQ ID NO: 242152 - DNA, 2694 bp, Homo sapiens
caggctggtactggccctgggatgtttagcatcttgtgggaactgtcagaccagctccaggcgctggggctttctcatgtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagggtgacagattctattcattttctggctgagagtgcctcagaatttttctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccaaaccctg

SEQ ID NO: 242153 - DNA, 2274 bp, Homo sapiens
caggctggtactggccctgggatgtttagcatcttgtgggaactgtcagaccagctccaggcgctggggctttctcatgtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccaaaccctg

SEQ ID NO: 242154 - DNA, 1689 bp, Homo sapiens
caggctggtactggccctgggatgtttagcatcttgtgggaactgtcagaccagctccaggcgctggggctttctcatgtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaataagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccaaaccctg

SEQ ID NO: 242155 - DNA, 397 bp, Homo sapiens
gaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaa

SEQ ID NO: 242156 - DNA, 414 bp, Homo sapiens
tatccattttctatttccccaaagtaacttgtgagaaatgtcttaggctagaatttgcttatatattttccatcttgcacatggttaaaacgtgcagtttcctaaaccagtggttctcgaacatcagtgtgcattagaatcacctggagggctggttaaaacacagattgccaggccgttctcagggtttttgatttagtaagtttggcggttggacccgagaatctgcatttctaaccagtgattcccaagtgatgctgatgctgcaggtctggggaccaatgtcttgaactaacagctctgaataaaaatctaattggattctgaatgccacagatggagtttggagattgtttttcaaagcagaatatccatttgtggaataaaaaagtttatcattgttattacctgaag

SEQ ID NO: 242157 - DNA, 354 bp, Homo sapiens
cggtggcccgtgggtgtccgggccggagaactccagatccgagtgcgtcctcttggtccacgagcctcctccctctcccttacccaaggacagtgagctggagcgcgggcggctggacgcgtagcgcagccttcgcaacgggtcttttttcgtcccactttttatgggaccttgggcttccaaaccgacgttggatggtttgtcagcggatactttcaccgcccacagcaaacttgcagagccaagcgggctgttctccggaggctctcggaggacgccccctgccagctgccggcatctgggggagagggacagcatttggggtgggaaatgaagttctggttttgcacattt

SEQ ID NO: 242158 - DNA, 769 bp, Homo sapiens
  misc_feature (538)..(539): n is a, c, g, or t
  misc_feature (603)..(603): n is a, c, g, or t
  misc_feature (637)..(637): n is a, c, g, or t
  misc_feature (649)..(650): n is a, c, g, or t
  misc_feature (684)..(684): n is a, c, g, or t
  misc_feature (769)..(769): n is a, c, g, or t
tcccagcctccagaactgtgaagtccaagcaagggactggcagattcagtgtctggtgagcattcaccttctggttcacacatggagccctctagctttgtcctcacatagcgaaaggggcatgcgagttctctcgtgccgaattcggcacgaggaggctgcggtcatggagggagcaggagctggatccggcttccggaaggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgnnggccttggagtgtccagtggggacactggtgtgggaagggcagcacctggggagtccctgcctntcctcctgggacaatagtgtgcatgccacccggngtcctacaggcnnagtgctggtgcttcttgccacatttcctgcaccngacattaaagctggcgtgtgacctttcaggcatgcgatattccccttggagatgcttcccagctattaacttgtcttacaaagan

SEQ ID NO: 242159 - DNA, 450 bp, Homo sapiens
atgtttttagaaattaaatttctaggtgaaataaaataaacatattaaaataattaaaaccaggtaatagaattaagttatattatagttttcagtctgactgccaaaagtgtctagaagcaataatacccattgacaatgaacactataatctttaagaaccattaaatcccactctttattgagaataaccagagcttcttggagatttggcacactctagttctggatagggagtatatgaaaaaggcctggaatacctcactgtgagaaaagcaaaaagccagcaaacataaatgtgagggtgcgaaaaaacacaaaagccagcttgaacccctctttattggccaattgtagaattacttgagcatcaaagagaggactcctgtagttccttggaacacaataaatatatacaaattcaggagtttataataatattaaaaaaga

SEQ ID NO: 242160 - DNA, 368 bp, Homo sapiens
aatttattcactttaatcatcttggaatttctgggctgtggcctaatttcatatagtacacaattgttagaccctaaatctaaaaaatctgcttggtcataatatattcaaaaccttggtcatactatatttcaaaaaggtgaaattaggtggtacgattgagaaactgttattttaaactttgtcctgtaaatctgacccaattcttagtagcctgcagtgaccccctgagccagactgttaaaacaaggaggcaattaacgttcctacacaattggaaatgttattgtagacaatatattgcattagaaaggttctatgtagtacccaatatattaaaaaaagaaaacaaatagaaagctgaaatt

SEQ ID NO: 242161 - DNA, 313 bp, Homo sapiens
tcaaggattgtgagaacgaagcaaaaggcatcaagcactctgaattgttcaaataatgaagatgatgcccacaaagacagatagaacatgcctcaaagcttctcagttttcctacgactaagataaccagtcaccatgtggcatgactccgaggaccacgtacaggctttgcatcttctgtgaaggcttcagttgcccttggggatacatcgccgttctgtccaccaacactctctcatgttctcaggacataattacctatttctgttctatcctcaccccctaaaagattagtctagaacctgttcttatt

SEQ ID NO: 242162 - DNA, 505 bp, Homo sapiens
  misc_feature (336)..(336): n is a, c, g, or t
gcgttcctcctggggaccccccagagacatggacgcgcacacggacacacacacaccccttgggctcgtacagacacagatacagaggcacaggtacgctcggttaactggcagtcactcaggcactcggggctaaggaggcagatgagcacagacaggcacagaccctccagggcaatcggagaccgacataaaagcacagcaggccggccgagggacccactgaggggcacacccaggcgcgggcagaacgtcctcaaggacacactcctccctcgggcctcactctggagcacctggggacacgcccatgggcggctgcacgggcggcaggangccccagcgcacctggcgcccccgcgttcccctaggcgcccgagccgagtgtgcgtgcgtgcccgtgcgcgccgccacctgtgggaggagaggtgcgcgctgcgcccggggctgcccgcctagcgctgcgcggggggagctgttgccatggcgcgcagagcgcggccgc

SEQ ID NO: 242163 - DNA, 967 bp, Homo sapiens
ccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacctcagcctcccaaagtgctgggattacaggcgtgagccatggcgcccagcctgggccaaccttttctgagccatagtccagctgtactacagctgtatccaaaaggtaccatgtatctcccaggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttct

SEQ ID NO: 242164 - DNA, 438 bp, Homo sapiens
gagatatttgccaggcggcttccctttcttagcttggggacctcttgcatgctcactggttgttggcagaattgacccggttgtggttatgagacaaagactgccattctcttgctagccatcagccaggacttttcagctcctgggcaacagagcaagactctgcctcaaaaaaaaaaaaaaaaaaaaaaaaaggcaagagagttaaatgagaagagaaacagaagctgctaagagctttttattcccggcatctttagcttcagggagaattatggatggaactgtgtcccctaaaaagatatgtcaaagccctgatgcctggaacctgggaatctgaccttatttggaaatagagtctttttggatgtcatcaagttaagatgaggtcatactccattagaataggccttcgtttaatagactgggttcttataa

SEQ ID NO: 242165 - DNA, 619 bp, Homo sapiens
gacctgcctccatgattcagttacctcccacctggtccctcctgcaacatgtgggaattcaagaagagatttgggtgggtacacagccaaaccatatcaaaaaccatttataaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcactttcgggtcagttgagtctaacataggggtgtccaaacttttggcttccctgggccacattggaagaaaaagaattgtctttggctgcacataatatacaattgttgatgagcta

SEQ ID NO: 242166 - DNA, 398 bp, Homo sapiens
aaaaaaaaaaaaaaaaaaaaaagaaccatggccactgactcctgcagccccctcccccagcaaatgcactttccaaaaaacagagagaagtgcaatccttttgggtttctctcttctctctccattgccctgggcaatcatgttaaaactcacatggctggtgcttattcagataaacctaacaatgcacaccgctggttaccatgtgaatcttcacaaaccacacaagaatgtgctggttcaaatcccccccgaccccctccaaagcaaaatttattcaagacagcaaactgctcagcagctttatgaaagcaaatggtgctagagggaattctatcttgtatttacaaattaaaaattagatgcatcatcatgcaataaaggttagaaaagcagca

SEQ ID NO: 242167 - DNA, 507 bp, Homo sapiens
gtgtgaccactgcgaaaggatccctggccactaagaagtgacaagtgatatcttgttccactttctgtgcccattccaagtggctttgccgaaaggacagggggccaccaccttgggtggcagctccttttatttcctccccttggactctggcccagctaccacccaacagtgaccccaggggaaaacgccaagaggcctctttaagggaggggctgggaaaggccccacagaggaccagaggggtgctccaacggtggccgggagaagaaggggtgggtggctgagaggtggcgggtggggcgggggctgcctgaaccttgacctaactctaggcgccctgctggggggtgctacaggctaaaacaccctgcagaatgctgagctgagtgtcccactggagaacaggagggaaggaggtcaggagcctgccagacgaaaagaggggtgggtgagaagaaggggcgacctggagggacacggactctggcaggagagtgcggccgc

SEQ ID NO: 242168 - DNA, 435 bp, Homo sapiens
caaagcaacacaatcagtaaacaaacattagaaccagggctgaaactttaggtttttggttccttgaagtgctattttcacttaaccaggaaaaaaatgcctgaccctatcgacttgttcagccaataatggctgtgtttgtaaagtcactgaaatatatgacttgaagatacagttcggtgatttcttagagagctctacctgtcatttctataggggtagaggattattttccccaacccatctttaaccttgctaataaatgattcattcagcaaatattgaatgtgttacacctgtgtgtactgggcagataacagcgaacatgaggaataaacttctgtcctcaagggacttatcttctatttggggagataatagacaaacaatagtaatagctaataaaatattagatagaagtaagtactatgaaga

SEQ ID NO: 242169 - DNA, 404 bp, Homo sapiens
tagatttgtgctgttttcccactaatcccgaatttatcttaaatatctctcattctacttaatttatagtttaagagactatttcttgatatgtttgttcatttttcctccacattccaactacacggatgtctattgctgtcatcattagtctgaacattgtttaagaggtaggcaccttcaacagccattgagtatacatttaaataatattaatcgttcaaatcttatccatgccggactttacaatggagaaaggaagctaaagtgagattggtcaaccttgtaaaacattatttccaacaatttctcttgtcaaaaccaaagtatctttgtttatttaatttattgggttttattccaatgtatatggttctatttctcaatattatgtctactgtaac

SEQ ID NO: 242170 - DNA, 305 bp, Homo sapiens
cagtgagaactataactcagtacctaagaatgagctaaaataaaatatatcaagaaaatgacctggaatatgaataatataaaccgaaaccagaaagactcagaaatcaggtattaaaactcaggaaaaaaaatctaagataatttcagaaaagatgagtcatgtggaaagatcatttccagtgaataaaccacaataatgccttcagagaaagagaagagaaaaaggggacaaatgtttaaacatcagtaagaaatagaggaaaaaaccccagcaaaacacaaagatggaaaatgagtccctca

SEQ ID NO: 242171 - DNA, 1015 bp, Homo sapiens
gctctgttacccaggctggagtgcagtggcacgatctcagctcaccgcaacctccgtctctcgggttcaagccattctcctcccaagtagctgggatcataggcatgagcaaccacagccagctaatttttgtatttttagtagagacggggtttcaccacggtggccatgctggtctcgaactcctgacctcaagttatctgcctgcctcggcctcccaaagtgctgggattacaggcatgagccaccacgccgggccaaactcttattttttgcttacaagcaaatggtacatagcaagaatgatcaatgatgaaggattataaaacctcctcccatgaaactttaaaagggaatcaatccattaaatttctttaaattatttatgccataagcaatcaatctgaacatacgcttaagggctcctctttggtccattcaggatttgacttggggaaacacgggtggtcagcctttctcttaaaggtacagtttagaaaataagcaagccaaggaactatttcttctaaattattctcctgttggtcatttttattactgaagttctcaataatcaatagaggaaaaaaaattactatttctctttccttagaattctaatgaccaatcatagagtacatgatgctgttgaggaggtggtagatggtgcgatgaatgatttatgttttctaagtaaaatgtagggtcagcaatgcaaggctctgtcagttttggcaaaacaggtcctgaactgttttgttttgtttttagagacactgtcttgctgtcacccaagctgaagtgcagtgacgccatcatagttcactgcaggctccaactcctgggctcaaggggtcctcctggctcagtctcccaagtagctaggactacaggcacaaaccaccatgcttggttaatttaaaaaaatttttttgtagagacgaggtcttgctatgttgcccaggctggtcttaaaatcctggcctcaaggtgaaatcctcctgactcagtctcc

SEQ ID NO: 242172 - DNA, 418 bp, Homo sapiens
agtgtaatgtctaaaaatgttcattttaggtagttcttatttttctgttaaacaatgcaaagtctagatttaaaataatctttatttgaaccaaaaagctctttcttaaaaaaaaaaattaaactttgtttatttttaatttcatagcaggtgactattatagttttcaaagtattatgtaaacatattactgcaataatctttgaaacttttctctgaactaggcatccttgtttttggcaacagaatgtgaacattacatatccagtttgaatctaattttaaagaattaaccacccatggtggtatctgcctgtaatcccagttactcaggaggctgaggaaggaggatcgtttgagcctaggactttgagactagcctgggcagtatgatgagactatctcaaaatgcataaat

SEQ ID NO: 242173 - DNA, 764 bp, Homo sapiens
aaaacacgaactaagaaatggtagtttattttctttttgccatgcagcaaaggagggtcgaatgtaaagctgatacagttgctggctgagcttttcccgcggcagccagtgcgtgcttcctccacttcttcgagacttctccgtgctcctgccccacctcccaggctgaagattcatgcaggccctgcgcttagcccagactctggccaggcccggcccagcccgaaggtgggcggctcccggcgcagggcggcccagccccaaccactgagaggaggaccctccggcgtcctagagtggccgcaggccgcggcgtcgggttggaaaaccaggagagcatggagctttttcgctggtccggcgcggtctcttgcgttcctgtggcgggcacctgactccccatgcccgagtactgtcctcaggcggaacggcgtctgcagcgaggagcggggttccagcaggctcggctgacgcggtccctggcatttcccgtgctggccctgggtcgccctcgatgctgcttcccgctgggagcctccttctgacggcggaaaggagcttcacctggggcggccggcggggaacggagaagaatccaccggggaagtggacggggctggctcccgggcctggcgctgcggctctcgggccgtcagacctcccgcgggttgcgtcactttcctcggttttctagacagcagttgtggggttgaatccttgccgtggttttgtaagaattaaatgagataatgaacgcgaacacc

SEQ ID NO: 242174 - DNA, 85 bp, Homo sapiens
aaaagatatcccagaagaaactgaagaaacaaaaacttatggcacgggagtaaattcagcattaaaataaatgtaattaaaagga

SEQ ID NO: 242175 - DNA, 506 bp, Homo sapiens
cggcgttttgcggggtcttcctgttctgaacgcgcgtaacttttgcctcagtatctcacttcttggaatccggcggcgttcacgtgtgtgctccagagaagggcgccagagggtattccctgaaagtgaaaggtcggcgaaagaggagtaaagacggcgagacgcgtccacgcagggggagtctgtgcggtttggaggaacgcgccaatgtctgcactcatgaggagcccccaagggcggttttaagagggtgaagcaggaccgggcgcagtgacttacgcctgtaatctaagtgctttggaaggcctaggcaggaggatctcgagcccaggagttcgagattagcctgagacctcatcgctaccaaaataaataaagtaggcatccatttgtgtaaaacaaaccatatatacacacatatatacatatataaacatttgtatatataggtataggcatagttatctataccttgtaaaccaaaaataaaattgtaagcctcccca

SEQ ID NO: 242176 - DNA, 604 bp, Homo sapiens
tactttattaaaatattgagttttatttcacaggcatatttttgtcttcccacaatttccatgtctgaccaccgctactactatgtcctatcataacattccatacatatttaaaaccaagcaaagggtgagttccatctttaaaaactaaacaggcattttggacaacacattcttggcaatggaacctggacaacatttatcaaacacggtagggaaagttctcactctgcattataaaaaggacagccatatatcaactgttacagaaatgaaatatgatggaaaatttttaacaaattgttgaaactattttcttaaggagacttcctccactgccagagatcttgaatagcctcttggtcagtcatccagaagcaattcttcacaaaattgatgaactcggcttccactttgggaagagaaccccctttttctatacttgcttgcatttttgctttaatgtcttctacagaactagatccttttggtgttttaggagttttttcctgtgttttgaaggattcttgtccttttgatcttggtgctgatgatggttttgagtcttttccattctgatttgacttgtgtgcatttttggctg

SEQ ID NO: 242177 - DNA, 583 bp, Homo sapiens
caacagtgtttgagaggattctgaaactctctgtaggcgaaaaagaagccaccaaactgactctgtttcaaatttctactctaagttatttctcctgttcgtgtgaaccctgggacagaacgggtgtgtattcattttaaccttagctcagatggacagctccaggtgtgtaagtgggttggtggtggctgcccagagaggaggagatatttcagatttggtttctccaaggttgcaccattgattgcattccatgtacattatgatcccaaagtgtgtttaatcgagagctacacaacagtgcaaagtggcggatgttaatgttgactagaacttaacctatacgttttgagtgccttcctggggcctggattttaactgagcatcgttaatgtgatgaatttctcactgttaattaaatgttataatgagtcttcaatacttttaaaaccagaagagaagtattctgtgagaaaactttatatatgtttaaaaaacaaaagaattccatctttctgttgacactttccccacacctttgtgcggcattttctaaaagagaataaaataacagcaaaatgtc

SEQ ID NO: 242178 - DNA, 423 bp, Homo sapiens
aatttagaagcactagctttattcataaaatccaagaactggaagcaactcaaatgtccatccacaggaaaataagcacattgtgatatattcatacaatgaaattatgcctagcaattaaaaaacagaactgctgacaggcacggtggctcacgcctgtaatctcagcactttgggaggccaagaggggtggatcacctgaggtcaggagtttgagaccagcctggccaacacggtgaaaccccatttctactaaaaatacaaaaattagctgggtatggtggtgcatggtgcatgcctgtaatcccagctactcaggaggctgaggcaggagaattgcttgaacctgagaggtggaagctgcagtgagccgagatcgcaccactgcactccagcctggatgacagaacgagactgactctc

SEQ ID NO: 242179 - DNA, 502 bp, Homo sapiens
tagagacggggtcttactatgttgcccagcataatcttcaattcctggccccaagtgatcctcccacctcagcctcccaaagcactgggattacaggtgtgggtcaccacacctggccaaaaacatgttaagttttaaaatcaaaagaaaatcagcaagccattttgcatatttttctggagatatataaatacagatatatatagatagagataaagatatacagatagatctggactggaaaccttatgataatatagtatcagttgggtataacttaaaaggacaaagggaactgattaaaaaagactcaaggcatatatatatacatacacacacatatatacatatacatatatatacatgtacatatatacatatacatacacatacatatatacatatacacatatatacatatacatatatacatatacacatatatacatatacatatatacatatacacatatatacatatacatatatatacatatacata

SEQ ID NO: 242180 - DNA, 310 bp, Homo sapiens
gaattcggcacgaggagaactagtcttgaggggggcattaaaatgagttcatagtgatttatctttgctagattaaataggttaagagtggatgataggaaacccatgaatctttggtatgattacataaaatggtttaattgcaataaaggagtaaaaaaaatagatttatgtttatatgcttaatgtttatattaatggcaaaaggataggtgttggggaaataacagcagcacagtatcagtactgtatgttaactttaagggttgagtgactctggaagttaggtctcaccaccctttctctcaca

SEQ ID NO: 242181 - DNA, 447 bp, Homo sapiens
gctcccaaataacgtggggctgtgtctaggctgtttctttcctcttgggccagctgtagggtttgcctttccttgtctgtctgcacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatc

SEQ ID NO: 242182 - DNA, 258 bp, Homo sapiens
atacagaatacgtttcatacctaatgagccccccaaaatgatccatctcaaccgctcctcagcggcgagggtcactttttaattacactgcagttagattagggacttacaccagtaacatttggggacataagaaaattaaatctccgtgggtgttcaccctgtttgatttctcagatcattcttttcttgtttttagagacaacatctctctctgccacccagggtggagtgcagtggtgcgatcattgctcactg

SEQ ID NO: 242183 - DNA, 265 bp, Homo sapiens
gaggctcccacttatgcctcggtgggctctcccacctgcgtcacaccctggctagtgacccagtcagacgtgctggggaccctggctgaccacctgtaccaggggcaaggaaggaaggagaggggagcattgtgaagcagggcaggatgactcttgaaggtggagacaggccctggacagctctgggacccttaatggtggcagcagcccccagtcataggcctcattgtgtgggcagcctgggcgaaagagtgaaactccgtcc

SEQ ID NO: 242184 - DNA, 523 bp, Homo sapiens
gatgagaaaacacagacactgatgcatatactgatgtggagaaaattacaagcttctaggcaaaaataacaaattacttgtgagggaataataagcacactgacattaactcagcagatgaggacacaaaaccccatgaatgagaaccagcacagataacaggtaacagatcagcagtggttaccagaggcttggggtggggaggctggacagggaaaggggaaacgttggtcaacaggcacagtttcagtgagacaggaggaataagttctggtgatctattgcacagcataatgactatagctaataatgtatatttcaaaatagctaaaagaaaggattttaaatgttctcaccgcaaagaaatgataaatactagtggtagatatgctaattagcctgatttgatctttccacaatgcatatacatcttaaaatagcgtgttgttctccatcaatatataaatatatacaattattatttgtcaaataaaacaattaaaaataattgtcaattaaaaaa

SEQ ID NO: 242185 - DNA, 1244 bp, Homo sapiens
atttttaaaaaaaactattgtcctaattttggctttaacttttcctgaatgccatttgctgtaattgcttaacttgtttccctgtctttaaaatggttaattctattcagacatataaatgcagatctatgttgaccatcttggtcctggtctgaagtatttcatgtcatgaaggtcactattctgttttccagacaggtagtttcctaaggcaagatgagtggttggggctgtgtgagcaggctttgcctgggcagaacaagtgggcagaacatgccaactagtagatatctttaaagagaacagacaagtaagctagcgtgtgcataaccaaatcaatactagagtatcggatttacagcttgacttgttttgactgaaaacaaaagcacacagaacagttacatcatcctaaaaattccttgtgtggcccctttgtggttactttagtcaatttctctttcttcccttaaccctgggcaatcactgatttatctgcctttcctatttgccttttccaaagtatcacataaatgaaatcatacaatatgtagtttttgcatcagacctctgtcacttaacaaaatgcattttaagattcatctatattattgcctggattggtggttctttcttttttttttccctgagtagtaactcattgtatggatgtaacactgtacatgcatctgtcaaggacatcttagatgtttccaagttgcaacaattatgaataaatctgctataaacatttgtatacaggtttttggttggatgtaggttttcagtacacttgagtaaatacctcggaatgggattgctggatggtttggtaagggcggatggacctttataataaaccgtgaaactgtttttcaaagtggctatatgattttgcattcccactagaaatgtttgcagaatctaatttggtatcttaaaatttgattaatttgtagttaactcttcccaggtcttcccttaagagcaaatacttcccaggtctaagatgaaatactttctcagggtttactcttttgaaactgtacttgatcttgctcttcggtaatatgtttgctaggacatgtacaagtatcccataagagaaaaaaagatattttcaagtagatgaaaaggcaagcacagactgggagaaaacatttgcaaaaacatctgtctaacaaagaaattgtatctagtgtgtgtaaagaactcttacaactccatagtaaggaaacaacaac

SEQ ID NO: 242186 - DNA, 406 bp, Homo sapiens
agagactgctgatttgattgaggcttaaactgtgaaagaaaatggaaacaaacacaaaactgatttgtgaaggtcactttaaaaagaccaaagtttctgtctgtggatatggatatatttttaagtttcaaagctaatgggttttatacatattcttagctttctgattttttggttagtggattgtaccttgcatcttactgagctgccccatctagggctatgccttcatttttaacgtagactattactttagaggactcatacttgttcctactgctttaacttggcaaccatggttgtcccctggaaatgagcatggaaatgtgtagagtcgctatcattgcttcccggcactgaatgagatatcgagatagggaacttaaacaataaatcttttttatag

SEQ ID NO: 242187 - DNA, 605 bp, Homo sapiens
ttgcatcatcctgtaaactactaaatatttagccggcgaattgtttttctctgaagtttaccagtctgttgaccaagaccaagaatccaactgctacagttaacaaagaataaaaaatcagacttttggctgggcacagtggctcagacccagcatgttgtgaggctgaggcaggaggactgcttgtgcctggaaaatttctgcataattcaccccttaatttgcatgtagttaaaagtgggtataaataggattgcagagctgctgctgagctgctaactctgggcacactgcctatggggtagccctgtccacaagaagcagtgtacctctgctgctgctgtgcaatgctgcttcaatacagtttgctaacaccactggatcgcatcagggcaaagccaagaaccctctcaggctaagccccaattttggggattgcctgccctgcatcagaggcatcactccagtctctacctccaacttcacatggcatactcccctgtgtcttctgtttccaaatttccctcatctttttttttgagatggagtcttgctcttgtcacccaggctggagtgcagtggcatgatctcagctcactgcaacc

SEQ ID NO: 242188 - DNA, 296 bp, Homo sapiens
catgctatgacatggacgaaacttgaaaacattatactggtgaaagaagccagtcacaaaggaccatgtattattgcatgattctgtttatataaaatgttcagataatagccaaatccatagagacagaaagtgaatttgtggttgcccggagttggcaggaggaggagatgggatgtgaccattaatgtttatggggcttcttttcgggatgataaaaatattctaattgattgtggtaataattatgtaactttgtaaatatatacatgaaacatttaattatacaatttaaa

SEQ ID NO: 242189 - DNA, 609 bp, Homo sapiens
ggacacctcatatcctccaccctgtgaggttttagtctctcaactaagttgttcctatcacatatggaacaatgtcagcttaaaactaggggccccctggatccagtcctaaaattctgttttcactagatctagaatggggctggaaatctttaaagaactccctcggtggcttctgcgatgaagctgtgtttggaaataccaccttgtctaagaatatacagctggttaaggacagaataaatttcacacttagagtgatatgattccaaaacacaagcttttccatattctatgtattatttttacatcgccttaagaaaacacttatgcaaacgtaaacttgagttaaaaaaaaaaaaaaacaaaaaaaacccaaaagccattttgtttactagatcagtggtcctcaacccttttggaaccagggaccggtttcatggaagcagatccggggaggagggatgatggtttggaatcaaacttccacctcagatcatcaggcattagattctcataaggaaccttcatgcaacgtagatccctcacgtgcgcagttcacaatagggttcacattcctatgagaatctaatgccactgctgatctga

SEQ ID NO: 242190 - DNA, 308 bp, Homo sapiens
cgtccctggaccagccctgccatcagcttgcccagcctagttccctttctcttctgcgctctgaatgtgcactccgcgtgttcagatgctcatggtttctgatgagaagttggctgtgtctctcacggagcctctctcggaggtgatgagtgacttttctcttgctgccgtcaagattcctggctgtggattggatggatgggaagctctgtccctgaacagcccttgtgactatggggctgtccttccacagtgtgcactgagggtgcaggccaaaccttttaaagaataaacagaaagaaatcggc

SEQ ID NO: 242191 - DNA, 1364 bp, Homo sapiens
tccagatctcagaaagagatccctggggattggctgaaagcaaacagaatcaatggcagcgggaagaatgaaagtcagatttcaggtagaacctcctgtctcagtaacaggagaaaaattcctccagtaaccttgaatatcttctgaacacggaaactgagacccaaagaggtcaagcaactgtccagagtcacacagcatggaactggctgaaccatgaccaaaaatcaagtctcctgactcccaggccaaggttcttgccagggctccccagatgtctatcaggggagggagaaagagggaggtggagagaagaaagagagagagggagagcgtgggcagctctcctccctctcccacgtgcagcccagctggctgcctcccagtctcctgggccctggggaattttccagcctctctggatgagaacaatcaatctcctgcctccaccggacccccaacatcccccatccatgccaaagctgaggccatgacccaagttgagaaaagagaatctgccctccacgctcctgcatcctgagttccccccatctccagtgttagccttgggccttcctcactggattctattccacagtggccactgggagagcctgtcctgccaacctccttgaacacctgccccctttctcccagacttggagtgggggcctaggcagctgagttcctctccgaggccctgcacgggcatctgggtcttgtgccataggcatgtgggagtagggctgaacgagcggggatgtggctctgaatgctggcacagctgtgttcagagaatgggggctttgatagcttctgaaagaggccaggaagcacgggaccccagcccaggcaggagggggtggggggcagaaatggctgagtgtggctctgagggctcttgctgccgcagacagggagtgtggagtgggaggggatgtggagcagtagggagacagcaatggggactacaggctgaacagcatcatcagagagcccccctgctgcaccagcaggagccagcgtccccatgagctggtcagaccgcgctttgagggttgcaaacccatgtgttcagaggagaccatcagcttgttgcacaaagaacagcgggaggaactggagggctggagcccgagtacatctgaatttacctcttgaggtcccaccagaaggctgcctgtagtgcctctcccagcctcctatggggaaggaccactcatttgtctgtgatgttggggcaggtactaatctccctgtgcttcagtttcttcacctgtaaaatggtaataaccccttgttgtatggttttgatgttggagccatgtaaatattttatataattaaaatacgaaattaattag

SEQ ID NO: 242192 - DNA, 580 bp, Homo sapiens
tggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaagattggtaagaaaaagacaacccgctagaaaaaaaatgaacaaagattatgaaaaggaaattcatgcaagtaacgcaggtgactaataaacacagaaacacaaagcctctgtagttactgaggaaatgtgctaaggaagttacagtcgaaacactgttttgcagggattagatttgctgtaattaagacaa

SEQ ID NO: 242193 - DNA, 194 bp, Homo sapiens
actctgtattgccgataatgtataaggttgtagacatttgttaatcccaaaaaagttagaaaaatgtcattttattattaatcagctaatgagtattttgaatgttagcctggtgcctattaataaatttctataatcttgagtttctatttggtagaataataaacctttcatttgggaagatgtgtttgtat

SEQ ID NO: 242194 - DNA, 260 bp, Homo sapiens
tgttgtagtcaagacactcggagatcctagagacgcgaaaagcaggaggggaacgtgtgacggccactgcgaggctcagggagaatttaattcaaatttggatttttctcactcttacgctttggggcaatactgttaaatggtaaatatatagccattgtatgaacagcaatacacaaaggagttatttggaaatgaaagccttattgaaggcactggaaaaattaaacaaataaatgtttcctttagattgctcattc

SEQ ID NO: 242195 - DNA, 558 bp, Homo sapiens
atctgtctcagtctctcttccttcctctctttctctttacagtgaaaatctaaattccatataggatgtatatggaaaaagactaaaagagaagacaaaataaagacagtggatggtttattgacgtgaaatactgatatgtttttctttttctaatttgctttttattgccatgtgctaacattataaagtgaggaaggcttagcagaacaaagagaaatagccaagaatctctcttcctcctcctaattgaaaactctggacaacttccatgtaaacaaaaaagtgttacttccactagttttgttctcttttaaattaataaaagaagagaacaaatattgattatatcaccagtttttttctcaagtattatggcacatataaatctatgtttatacatcattttttgttttaaataatttttaaaacaaaaatttatgagcaactgttaagctggcagatggcgcttgggtgcttctctaaaagctgttttcattttttcttaggcttataaaataatacgaaaatgtaatttattttcaagacaaatttaaa

SEQ ID NO: 242196 - DNA, 469 bp, Homo sapiens
ttttaaaaagcatatattgtgcaaacacatttttcatgttctcttccagttaaattttacataaaacaagcccaaaacactatttaatgaagacctcttatataagtattaataatgagctaatcaataacttttgggtagatgaataactttgtccttaaattcgtaactctattttctgcttattttcacaccaacttgattatatagcggtgctctgaaattccacgaatgcttgaaccacctacacttgttgacagtttagcgaattggaaataatcagtaaattatttcataacttccaaagatataggaaggaaaattaacctattatttatctctgaaataagaataggtgctttacaccaaattcactggtatttggcagtattctcccaagtttcttagtttgaaaccagttaattgttctctttttaaatttaagataacataataggtagtagtcaat

SEQ ID NO: 242197 - DNA, 653 bp, Homo sapiens
gggccctgggacaaaaccccttttctggtaacagtcccagctactctggaggctgaggtggaagaattgcttgagcctagtctgcataacataatgagaccccacctcaaaattaaataaataaacaaaacaatttaagctaactgataagcatggagatctacttccatgtcttgaaataatacagttataatactctcacctctcaatggtttattttacttaaatcttcagttagaggaagaatatagtgaacacctgtatatccttatctagattcacacttgctttctctctcctgtttctgaactgagttagctgcagatagtatgtcacctaacaataatgacacgagaatttgaccttgatgaaacattactgtcatatgtagtctagtcatctattgatttctcagtttagaagatgtgctatgattattttgttgcccagctattccaaactcttctcccagatacatcaatttcttttctctcaatatgttcaaatacatatattgcctatcaatttcatcttcttgaagaatttgttcccagagcctctaacctgttcaagtctggatgggtagttgtctaagttagctgcaacctgttgtcttaatttgaaatggcttttcaatatcatttgaagaattc

SEQ ID NO: 242198 - DNA, 469 bp, Homo sapiens
gacgtcatgaagtctttgaatctcagtgcattgctaaagaaattttggcaggggatagggggagttaactttctcatatgtcatagtcatagcccaggttgtttaagttatgatctacagtacttcaatctttgcactccttcttttgaaataatgtcttattaagtaaaaggaaggaaatttttgccttgctcctaattgctgaaaaattttgcatagctaaacaatggattcaaaagaatccacctacaattaaagcctgattcagtaagatacaggagattatgtatgatgtaagacaaaaagattacaaaatgaaatgtctttatcccctgagaataatagtcatttagagtgttggttactcttttaagatcagaatacttaaggataatctgtagcctataaatacatggaaaggtagtataaataggatggtgatgctttaaaaaaaaactcactgatatct

SEQ ID NO: 242199 - DNA, 506 bp, Homo sapiens
atttccagtacttttaacttcctcttttagctatgtgagattaattaactattgctttctgtatttttatactcttaaaaatatccaacacggttgcatgatgcacccagtggtcaaaatgaaaccaagcaaaaaatgacaagtctaattagaaccggcctttggcaagcggatcctcaagcagtatctgtacccttcttgaagtacactgggagtattagcaacaaaacacaccagaaatatctgggtaatcatccagcaagagattggtaggtagagggaaagttgaaactgggaagaatctggcagtgttttctttaatgtaattgttgagaaaaaaactagagttcttttcttaggtaactaaacttgaattgtgaatcaaatgagaactacaaaacaagaaattaactctctttttcttacatatatgtagacgtttcaaatagaaacatttaagattccatttataccagtaagaaataaataataatttacttttgatt

SEQ ID NO: 242200 - DNA, 405 bp, Homo sapiens
tctccctttgtgattctttctaggtacaattagtgtttgtcacaatcttcaaacactactaagcgaccaattttgctgaagattttaagaggagatgacaattgtagacattatatgttgcactgcatttcaagcccagaatatctctagagaaaaaacaaatctccctcaatctcctctttatgttattctccaggaaggttccaaactttaccttctagcctcattcagcatctttcaagtcctcatctccttgctttccaaagctctaaatcacttctgttacataaatgcaattgggctttacttcagcttccccaatttatatctgtacagctattacaatcacactcaacaaactaaaaactgctttctgggcctacctttgttagaaggtggtggaac

SEQ ID NO: 242201 - DNA, 381 bp, Homo sapiens
agcctctggagtagctgagagtacaagcacatgccggtatgcctggctaatttttgtaaatttttttttttttggagagagggggttttgccatgttgctcaggctggtctcaaactcctgggctcaagcaattctcccacctcaccctcccaaagtgctggcattacaggcatgagccaccgcgcccaaccttcatgtattattcttgaatctaaaaggaaaaaagaatatgtatttttgtagtgattgctggagccctctttcctaggttggctgtggtcagtttgcagcacagtcctaatgttaatggagtctagccattctgatctggccttccaggtcattaggaggctctgccatcgtgtgaggaggtatgctat

SEQ ID NO: 242202 - DNA, 408 bp, Homo sapiens
taaacattaattttaaaagattgaggctgcttagttgcaatgaaaccataaataatattttgaatatagcagacttacttaaggaaaatagcaaggtgcctggcattattatctatgagcaggaactttttcttacatttaagaagatggcttgaacctgggaggcggaggttgcagtgagtcaagatcgccacactgcactctagcttgggcggcaaagcaagactccatctctacaaaaaacacaaaaattggctgggtgtggtggcacatgcctgttctcccagctattcatgtcgctgaggtggaaagattgcttgagccccagaggtcaaggctgcaatgagctgtgattgtgccactgtactacagcctgggcaacggagcaagaccctgtctaaaaaaaaa

SEQ ID NO: 242203 - DNA, 470 bp, Homo sapiens
tgttgtcacatgaaaccaccttcaatgagaattagaggcccacagtcttagctctgcaagagtaaagcaaatttcactcactcatgtcgcatacatctattcagaaccactttccggctccctcacacaccagctgtaggactctgggcaagttttgaacctcctaatgtctataaaatgggtgtaaggtcgagtgtggtggctcatgcccataatcccagcactttgggaggctgaggcaggtggatcacttgaggtcaggagttcaagaccagcctgggcaacatggtgaaatcccgtctctactaaaaagacaaaaattagctgggcatggtggtgcacgcctgtaatcccagctactcgggaggctgaggcaggagaattgtttgaactcgggaggcggaggttgcagtgagcccagatcctgccactgcactccaggctgggcgattaagccagactcagtctca

SEQ ID NO: 242204 - DNA, 308 bp, Homo sapiens
tctacttcttctacatacatggtacccaaattcatactaagctgttttctaggttgcttaagtgcaccctcccacccagcgcagcagccctgtgccctgtgtatgtgtggggagggaggtttaactctttcatgctacacctacgtagtctatgaactaaggtgataacttatacagatggtccccaacttctgatggtgcaacgtcatgacatattgactttatgatgatgtgaaacagttgcaattttgatgtaatgtacagtattcaattcaataaatgacagatattcagcactttattataaa

SEQ ID NO: 242205 - DNA, 723 bp, Homo sapiens
tcactgtgccaaattaacgagtgtgtacattgttcagtatgccaggttacatttctgctgagcttggcttctgtatgctgtcttttatccttgtaagcagaagtcattttatatctttaaaaaattagaacattggtagaattacagattttaaagttcaaacctgcacgctagtacttgtttaatgttttgtactgaagggcgcacattgtttatgtcattctgcgatacagcgacatgtatgtacacatacacactgcacagcgtgtataccgactggacacctgcaccaaatagtacacaccagactgcacatggacccgccccgcacactgcacatgcactttgcatgcatgcacacatcaaaccacagacactccacacacactgcactgcacactgccctgagcacactacactgtactgcacactgcactgcactttcagggctcacacgctgcaccacgcacactgcacggcgcacactgcactgcatacacacgttggttatggaggctgcttatggagcttccctgtgcagagaaatgctggcttgggttttaaatgggctacaattaacacttttagagcatttgggttttcaaagtgtcttcagagacttgatttttttaaagcctatattaggagtttttaaacatctgatgtaatagcttttttaaaaggaatcttgctgaattaaaagtgagtctaattactcggatt

SEQ ID NO: 242206 - DNA, 439 bp, Homo sapiens
aacctgggaggcggaggttgcaatgaaccgagatcacatcattgcactccaacctgggctacggagcgagactccatctcaaaaaaaacaaacaaacaaacaaaaacacaggatagtcttcttggccctacctgttggtgccaatggaaggataattcttagggccagggcacaagtgtcctgagttccccctgccagtgtggaaaaccacagatgcactggacggtgctcctcagagccagccttggatgctggctgctgctggctccccaattcctggttttagggacctctaagatggccccaatgtcctaacccgtccaccccactaaagagggacagtcccataatggtccaactctttgacaagaccatgagcaaggatgaagaacaaggggtagttgaccaacaaggccttcattcctgtccctctttatta

SEQ ID NO: 242207 - DNA, 322 bp, Homo sapiens
ggctgcttcaggggcgagggggtaacaaaaaagtcctggaactagagagtgctgatggttgcacgatgctgcgaatcatgtgaaatgccactccccatcgccccttgcctctgagagctgctcatctgccttctgcctagggatgcccctgttgtggatgctttgtataaatggaagcacacgacatgccccgtttgcatctggcatctttcacttagcgtgatgcttctgaggttcatccatattgtagatgtgtcagaacctccttcctctgtaaggccgagtaatactccattcttgaatataaccacgctggcattct

SEQ ID NO: 242208 - DNA, 579 bp, Homo sapiens
cagcccatgaagctccctgggatccctaacccaaagtcctctctcccttttgtgaaaactcttgacactttatctggtcttttaaaagtagcacttactactacttcctctatccttttttctgagcctgcccggccgcccgcctctctggaagataagttccctgaggaaagaccttgtcttctgtgtcctgccctcactggctgtagcagatcacttatggtttggggaccattcaagggtttcccacctacacatctgcccatgcttcttcctccccatggaatttcttctccccatcctaccactcgtctgcctgatgaatttccttgtttagcaagactgcccatccctcatgaccccagtgacagattttctgtcactgatacatgacattgtgttgcgccagtgtgtttatgtatgtgtatggacggcttagtttgtgagacactgcagtcaggatcttgtcttgttcatctgtgtatcgcaggcccagtttgtgcctggcccacagtatgtgcttagtaaatgtcttgtggatgagtggagtatactgggaagcccagcctccctcatatc

SEQ ID NO: 242209 - DNA, 477 bp, Homo sapiens
ataaatctattctttaaaaatggtagactgggactgattagaattgcatacaccttatacattagcatgtagggagaaaatctttataacagtatctttttatccaagaacatttcatccctcttcatctagcatctcttattatttcttggcaatattttggccccactttacttctaaagctcaatcttggaatcttatgttttttaatcaattatgaaaggaattttgaaactcctattggatctaattgaataatgctggcatatatatgactgtaagctattgattttggatatttactgtgtatccagccacttaaccaaagtttttaatattaaaatggatgtttttaggaaacagcttttcgaactttaggttttaaatgaactcttgaatataatgtattaatagaattcttgcattgttaggataaattttacctggtcatcaattattccttaaaagttatttgga

SEQ ID NO: 242210 - DNA, 493 bp, Homo sapiens
gagaaatttagtttaaggaattggttcacattgtgagggctggcaagttcaaattttacaggacaggccagcaggctggacattctataaagaattgatgttactatgctcttcagtcctaaggcggtctggaggcagaattccctcaattccctccttgtgcagaaacttcaggctttttttttttttttttgagatgtgttagggacccaacccagcaaaggccctccgccaaggcagatgttcccctcgctttgtttttctccatcccctccttttctcaccacctgcaggccctctgccaaggcagatgttccccagctgttgttttttcccctaacatctgcccatcaaccaggatgtggctctacccagaaacagcccccactccctaaaatatacttacaccccctagtctgtaagcctgggctgctgcctcctctgattgctgtggagcagcccagcaggttaataaacttgcttgcctgacttt

SEQ ID NO: 242211 - DNA, 910 bp, Homo sapiens
cttatgctttaaataccactctcatttcctgaaaaactttcttcctgcagttatcctctctcttctacagcatcaatttctccctaattaatcagtaccatcatacacatattctaaaatcttccatcttgaaataactcttgaccccatgtcattttcagactctccccttccaccagcatcacccccatttctctgttgttcttcattgcagaacttgtcaaaagagttgtctatactcactgactcaatttcttcacctctcattctcaacacatttggttaggcttctttcctctactctcccaaaactgctctagtttactgcttttctctctgccgccactcctatcatcatgcatggagatttcatatccacttggatgatccatttggcttctcagttctctgatctcctcacttggaaagatcttgtccttcaccccatcgtaggcacccactatcaaagccattgttaactgctctaccatttccagactatttcaagcactctaatctctaaccatgtcttagctttccagctcactcctccatgaacccccctatcaaattttcagcttaagggacttcaaatccattgatcctatgaacttttcattatatatcactatcttatgtcctgctgtctctcctcaccttatattccatggaccaacaatggaattactcccttgattctctctccctctgtcattcttgccttgttaaatcgaacccttgcctgcacttggaataacagataatggcaagagaaaggcaaacaactatgccaactatgataactgacctttaaatccatgcccctgaacttcaagtgggctctcagtgctgcttgccagtcatactgtatttccacagtcaatttattttccagctgtcccagaaatta

SEQ ID NO: 242212 - DNA, 548 bp, Homo sapiens
aattaaataaatactccaacaccattttttttttaactagggaaaatacctctatgaaggtaaacagtttagttgagatgaaaaggagtcagacatgtaaggattagggaaagatcaattcaatgtcgaagcagcaactaatgtccagtcctccaggtgggagtgaacttggcatgcttgaagcaaagaaataaggcctgcatggctggaatataatatgcagggaggagtcagaggctgcagtcatcagactgatgcatgtggcaagaggctattgtagagcatgctgtcatttggactgtggtgtcgatagtggacaggcaaggaacaggaagtctttaaaactgtccagcgatgcatgaatggataaagaaattgtgctgtatatatgcaatggaataatattcagcactaaaaaagaatgaaatcttgtcatttgtggcaacatagatggaactggaggacattgttaagtgaaataagccaggaagagaaagttaaacaccgcatgttctcactcatatgtggaagttaaaaaaaaaaaaaaa

SEQ ID NO: 242213 - DNA, 785 bp, Homo sapiens
agtgatgaaattagcagacaagcatgttgaaaaaaatgttataactatgcttatgtgaacatagcgaagagaatataagaagacatttaaagtgaaaatgtcatttgatggaattaatggcagaagaaaagatcagtgaacttgaatacatagcaataaaatgtatccaaaataaagcaaggagagaagaaacatatttaaaataaaaatgaacatatccacagtagcttatggggaaataccaagcactctagcctagtccttggaagaagctgagggaggaatagggtaaggtgaggcaatgcaacaggaagtatatttgatacaagctacacatcgaagaaactcaattaacccgaagaaggataagctcaaaacaccaaaacatgccaaactaacagtgataactttttaaaattttaacataagccagagtaaaatgaaacatcatgtagagaagaacaaagaaataaccttagaatattcatcaaaaactggccgggcgtgattgctcatgcctgtaatcctagcactttgagaggccgaggcaggcagattgcctgagctcaggagttcgagacaggcctgggcaacatggcgaaatcccatctctactcaaaatacaaaaaattagctggacgtggtagcacgcacctgtaatcccggctattcgggaggccgaggcacaagaattgtttcaacccaggaggcagaggttgcagtgagctgagattgcaccactgcattccagcctgggcaacagagcaagactctgtctagaagga

SEQ ID NO: 242214 - DNA, 526 bp, Homo sapiens
atggttatcccattatatgtaaacatggtaagaccattatataatgtaataggaaggttttaattaaaatgattagtattttaaaagtatgatgactgagattacaagtagcgaaaagcgtattttatatggtaaaaagtccaggtaagactctaccaaatgtaatcatttgtgttggagatttagtcaacaaacatttattgaacttgcgcatttagccagactctatgctaagcaacagaactgtgaagacaaataaaacacagtcctccaattgcctattcccatatgatagagaaactaaagaatgtgtttcatgctgtctcacagtgtttatattactttaaagataaatgagtggatcattttcattctcaacatccatcccccaaaatgagaaccacacttaattgctttcatatgtatgacttctattcctccccacctctcctgtcactggcttataaacgtagcttctgaagcgtgaagtacacgactatcaataacatcctttcttccttcaata

SEQ ID NO: 242215 - DNA, 392 bp, Homo sapiens
cagggctggggcctgacacctgcagcaggtgcctagaatgttaatgccaccaacttttcctgtcctctgctgggaatgccttgtccaccagcagctcctgccgagatcccttgatcggctccttctgtgagtctcgacaccacccaccaccgcactgttctcccgcagagatgacagacagcttaggtttaagtcttctgatgcccagcaagaatatacaaagaaaactggcctaaccaatgtattaatagtaaaatctggttcattcgtaagtagagttctgagggttttgagatgctgctgttatgtttaagctacaggcaatttacccaaggaatgtgatgttgaaatatgtttcagaataaacttccgcttgaaaattacaggcaata

SEQ ID NO: 242216 - DNA, 412 bp, Homo sapiens
tccaaacccaacccctccccaccaataaaacagatcaatggaaacaagattattctcacatacctgaggcagcccacctactgctcttactgcaggaagtttatctggggagtatttgggaaacagggttatcaatgccaagtgtgcacatgtgttacccataaacactgccatcatctaaccattacagcctgtatttgccaaaacaatattaaccaagaagattcaaagattgccaaacagaggttcagaatcaacatctcacacaacttcagcatccacaactacaaatcactaccgctttgcaatcactgtggcgccttgctttgggggataatgggtcttcatttctgaaggctctagtgtcaggtaaaactttgatgaaataaatttgttataattttcttttggt

SEQ ID NO: 242217 - DNA, 429 bp, Homo sapiens
tattcttttttaaaaattaaaacacaatttttcattttaaaagaatttcagacataaaaatgttttaaaaatagaatgaagaattcccatattccttgtcctctcccagcttctccaagtattaatatctcaaatagccacaacacaatgatcaaaagcaggaaattaacattgatatactattgtgagctaatttacagatcttacgaaaatttcaccggttggctcactgacgtcctttttctggttcaagatccaatccaggaccacacattgcatttaattgtcacgtctccaatctggggtagttcctcaagtctctgtcttctgtgaccttgataattctgaagagtattggttgggtattttgtagaatgtgcctcaattgtgtttaatgttttttgggattaaattcaagttatgagcatc

SEQ ID NO: 242218 - DNA, 378 bp, Homo sapiens
ttactatgcaccaggcgctgagaaggcagccttagaacagatggaaatccttgctttccgggagattccattctaatgggtcattgattcagtggcctcttcagtcatttgttcatatgcatttactcgtacctctcatgtgccaaggctcgattctcgaccctggggatttatccaagaacatggaagaaaatcccagccctcagggaacttcacttctagtaattcattgattcattgcttcatttgctcatttcttgatggatttatccattcaatatatatttcttaggcacttactaagcgccaggcactcttctaggtactggaaattcatcaaagaataaaacagacaagaaatcatgcctgtcagagctt

SEQ ID NO: 242219 - DNA, 778 bp, Homo sapiens
  misc_feature (1)..(1): n is a, c, g, or t
nacccttgcatgctgttggcaggactgtcacaagtgagttcatcagaatacagtatagtagtttctcaaaaaattaaaaagagatttccatatgatccagcaatcccatttctgggtttataatcacaagaattaaatgcagagactcaaagagatatttgtacacccagcattattcacaacagacaaaagacggaagcaacccaaatgttcttcaacaaatgaagatggccgggcgcggtggctcatgcctataatcccagcactttcggaggctgaggtgggcagatcacctgagatcaggaattcaagaccggcctggccaacatggtgaaaccccatggtgaaaccttggccaacatggtgaaacatctatactaaaaatacaaaaattagctgggcatggtggcacgtgcctgtacttccagctactcggtaggctgaggcaggacaatcacttgaacccaggagacagaggttgcagtgagccgagacagtgccactccagcttgaggaacagagcgagtctcaagaaaaaacaaacaaaaaacagacgaagagagaagcaaaacatatatacatacagtggaatgcagcctcgaaaaggaatgaagttctgacacgtgctacaacatggaggacatataggaagaaaaataaatcagtcacaaaaagacaaatactgaggtcaggcgcagtggctcatgcctgtaatatccgcaggtttggaggctgaggtgaaaggattgcctcagcccaggagttggagaccagcctg

SEQ ID NO: 242220 - DNA, 513 bp, Homo sapiens
actggctgttgtagctgtctgtgcaaggtgatgcctacatactggtagggtcaaactgaaaagctgttacaaagaatcagcaggataaaataatacaaaatgattgacgtgggttgttggaaagaatgagttctaagaggcatagggtacttactgctcttcctagaatctgccacagaggctttaaattaatgaagctaatattaagatatttggttaaatacacatagtacattctttttagatgctgatggggaaagatgacacacaagatagtagttttaggcgagtttattgtatgaggttgtgttctgcagtagagatttgactcacagcataaatccaagtatgtgatgagccatgtaataatagacgtctgctgttaattatggtggatactctcaatgaaatcagattttcttagggccatacccataaaaaaattcttgacctagatcttatataacagtcccaggtatatagtaaattttatgcatatggaatgttgacagg

SEQ ID NO: 242221 - DNA, 207 bp, Homo sapiens
gttaagaatcatcttgccactgagcttaagaagaagaagaaaaaagaatcagctacttaaagatagtcctaagtttgttgagcacccattgcataataggtatgaaatattcagttaacagggaggcccagatcaacaggcttattagaagaatgaactaaggtgtctaccatgattatttttctaagctggttggttaataaacag

SEQ ID NO: 242222 - DNA, 448 bp, Homo sapiens
tcaaaagcacataagaagtgattgaacatttccctggtacagaataggctcaataatgtcatctttgattattattaaatagatagatttgcattagagggctggaaggagaggggctgtgaggagatggacagagcattaggagcctgttagttttcactaacaagaaaaggatgaaactagggtaaaaaaagtagaagtaaatagacctccatgttttattctttcaatcattgaatgttgagagagtgccttctatctgccaggctctgttccagacgctgaggattcagatgagctgagagaggccataagagccaggtgacataggggattgacaggctgattttcagcctttgacttttactctgagatagaaatccatggaggtttttgagaagaggggtgacgtgaagtatgttcacatgaataaggaagactgtagcct

SEQ ID NO: 242223 - DNA, 694 bp, Homo sapiens
ccatttaggcctcattcctgcatcagtctttatgtacttcagttacaaaatcatcacatcttagtgtgattgtttctcactccctgactaaattgtgaggtctttagagatgaggactatatctgtctacctttttatatccagttcccagtatgctgcttgacatgtcataggtagttagtaaattctttctctgtgaacacacaaatggaaggatggcccattcttttaggagttcatatgagcttgctaactctgagtcagaatgacccgtgaactgaaacattcagacgacaccaccactaaaaaccatggggattcaattcttttggagttttactgctgaatgtacattttgcttaatttttctttctggggaacttgccaaaatttaggtaagggcgccaggtgtggtggctcatgcttgtagtcccagcaccttgggaagccaaggcaggcatatcgcttgagtccagaagttcgacaccagcctgggcagcatggcaaaaccccatctctacaaaaatacaaaaaatcagccggacttggtggcgtgtgcctgtagtgcctgcagctactcggtaggctggggtgggaggaccccttgagcttgggaggtggaggttgcagtgagccaagatcaccccactgcactccagcctgtgtgacagagtgagaccctgtctcaaaaaaa

SEQ ID NO: 242224 - DNA, 945 bp, Homo sapiens
catatgcgtcacacatattgccctatattggactaattccattctctcattactctgagcccttgcagattctgtgccctttacttggacagttcctgtttttctccccatcaaaccagtacacacccaagaatcaacgaccgcattcacagacaaattttcctaactctcttttccttccaggactggcctttgtatatgcatccctagcactctctaataatttggagatttcttaactgtcttttcctactaaactcaaatccttgagagtagtaaccattcatctttttttctccagccctaactcagaactgagtatctaatagatccacactaatatttactatgaaaaaaaagtaatattatgtaatggatgaaagagtgagtagacgaatggttaaagccaaaggacaagataatggaaagagttcctactgtgagatggacagcaacacagagggaaatgatcagaaaaccagtatagggacctcattctgcagtaagaagagtttgcagaaagaacatctagtctctgacagaactgggctaaaacacaggggttcagtcaaaaaaaaaatgacatggacaaaactcagtaactggagaaggggagtgaaaggaacctggtcacgaagttacaagtggtcaggttggcaccaccctagggaatggaacaaggtttcagtcacaagtgaatccaataataagcagccatagctggaagccagtaagtggagaacagggctagcaagtttggagtgagggcaagagcaaagactcacttgatgctgtgttggtaaattaccaaccttgagctccctaagtgaccctcacctttctaagattaagaccaggtctaccatctagaagctgaagtgggactgcacttagaaatatgtgccacagttgcccaacctcctgattgtattcactcgtgcagag

SEQ ID NO: 242225 - DNA, 697 bp, Homo sapiens
tcctgtttttcattttgtctcaatttcattcttatgaaaatattaaaaagtgtcatatgaatgtcatggagaagtgtcttgttttctgttttaaatgtgaaatcttcttgttggttaagtatcactcttagctataaatggtagagtttgcctggagaagccagctctccagaagaaaaaacccctaattaatagtgtttcctaattcccatggtgcaaatacttctacatggccaaattcaaccaacatcattgaatgaggagttgaaaaaatacgtgcaataacatattattatgtagtatttccaccatacaaatcaaataggtaaaatatgctgaagagtaaaaatagaagggaaatgttattaaataaatagaaaattatgagtttgaatatttacttatttcaaaaaacttttaagttcaggggtacatgtgcaggtttggtatataagtaaacttacaatcacaggagtgtgatgacaaattatttcatcaccaggatattaagcctagtatccattatttatttttcctgatcctctccctcctcccaccctgatcctctgataggccctagtgtgtgttgttcccctctatgtgtccatgtgttctcatcactcatctcccacttataagtgagaatatgcagtatttggttttctgtttctgtgttagtttgctaaggagaatggcc

SEQ ID NO: 242226 - DNA, 335 bp, Homo sapiens
catgaaaagcattagttgtgagaattctgtatcgatagcttgatctgtactataagtaaaaacataaaacaaaaagttatggtaaatatggaaatgtctcagcaatttttgcctaaggttaatttgtagcaaggaaaggcttattaaatcagtatgagtctatcctgtaaagaacatctatatgaagttaagataaaacattgtgtctacattctctacaggttctattttgtacatgtaataaaatcacaaagaatgcataagaaataaatatgagggggaataaggaggtagactaaggacttgggagtctgtagtttcatatcctctaattt

SEQ ID NO: 242227 - DNA, 229 bp, Homo sapiens
aaatctgaatatggtgtttttaaaataaactgtgttaaactaatttgtaatatcagaagtcaggaagggaagcatgagggggcatctaggggctggtaatgttgtgtttcctcctgtgggtattggttacctgagttaatttttttttgtgaaattacaacaagctgtgcacttatgaaagttgtacttttctatacatgtattcttattcaataaaaagaaaaaaatg

SEQ ID NO: 242228 - DNA, 379 bp, Homo sapiens
gctcagagcaaagtagtaacttgcccaaggtgacaagctggttagatggtggagcaagaatgtcagtctaggacattgattcaaaaaacgtgcttttttgggccaggcacagtggctcacatcttgtaatcccagtaccttgggaggccaaggcaagaggtttacttgaggccaaggttcaagaccagcctgaccaacatggtgaaaacctggctctattaaaaatacaaaaattagccaggcgtggtggcacatgcctgtagtcccagctacttgggactgaatcaggagaatcgcttgaacctgggaggtagaggttgcagtgagccgagatcgcaccactgcactccagcctgggtgacagagtgagactctgttt

SEQ ID NO: 242229 - DNA, 334 bp, Homo sapiens
agcaaggcaggataccagctgcgcgtcacttcactaatttggacttttaaaagtctctcttccaggacagggcgcggtggctcatgcctgtaatcccagcactttgggaggcggatcacctgaggtcaggagttcaagaccagcctgaccaacatggtgaaaacctggctctattaaaaatacaaaaattagccaggcgtggtggcacatgcctgtagtcccagctacttgggactgaatcaggagaatcgcttgaacctgggaggtagaggttgcagtgagccgagatcgcaccactgcactccagcctgggtgacagagtgagactctgttt

SEQ ID NO: 242230 - DNA, 254 bp, Homo sapiens
gaaggaaattttcttcataaataatttttctttctctcaataaatgaaagttctgaaactctggaggtttttgtttcagcaatggcagtgcagtgctcttgaaagaagtcttcagcagtactgcgaagaatgtgctaaaagccatgtttcagatacataaatggggaaggaattccgtaactgaggcagcttttaagacatagctgcagctctcatattgctgtatgtatagttaaggcttattagtactagct

SEQ ID NO: 242231 - DNA, 314 bp, Homo sapiens
catttgaaaatgtgcagattcttataaaagtccagatttcctgcttctcttgaaaaaatcagatctggaaacgctggcctcccattcccctgtggcagcagggagtggaggaggagatgcctgccttagacggggcaccagccctcctttctgcgcctccaccctgcctatttgctcacatgcctggcccctgtggacctttgagtttaagaacttgtttgaaacctttaggcttgtttgttccatgggagagtcctcctgggattttgatactttgtgcatctttaaagaaaaggtttaccgtgtttcaccaa

SEQ ID NO: 242232 - DNA, 663 bp, Homo sapiens
  misc_feature (218)..(218): n is a, c, g, or t
  misc_feature (335)..(335): n is a, c, g, or t
  misc_feature (652)..(652): n is a, c, g, or t
tgctagcagttaggagtctgcagtttctttttgttgttgttgttgttgttgagacagagtcttgctctatccccaggctgaagtacagtggcgcaatctcggctcactgcaacctccacctcccgggttcaagcgattctcctgcctcagcctcctgagtagctgggactacaagcacacaccgctactcccagcttatttattatttttagtagagnacagggtttcaccatgttggccaggatggtctccatctcgacctcatgatctgcccgcctcaccttcccaaagtgctgggattacaggcataaaccatcgctcctggcctcagtttncattgttacacagtcaaactccactggcattaaaaaacggttcgagaaggctaaacgtttaactttaacttttcctggcatttccacattttatcagaatatgaaggcttaattttcagcatctacaaagatgctatttcctagtataaatgtgataggaatgaagaagttggtactcactgactctaataactgacagtcccagggttgactgatgtagctggatccaagggtttgctcatccaaactcactctctgagatacccctagcaacacttggccttcactggcctggcttacgttcatcctaaaaccancaatgacctgg

SEQ ID NO: 242233 - DNA, 411 bp, Homo sapiens
tttcattccttcccatcttgtctccatgtatctcttcccaccattcattttccagatagcatctagactgttgtgttaaaaagcaaaactcctttcacaccacattccattaaatgccttcccactggcctttgaacaccaaaccaggcctttaaggctatgtcatctcctaccattgatctcagacctagctgcagttgcacaatacaacccctggctcaagtcttctgcacacattgttccctcacaggcaggaaccctatggtgactgatcaataattaaaacttgccttgggccaggcacagtggcttatacctataatcctagcactttgggaggccaaggtggatcagttgagcccaggagttacagaccagtctgggcatcatagagagaccttgcctctacta

SEQ ID NO: 242234 - DNA, 728 bp, Homo sapiens
cacccaggctggagtgcaggggtgcagtcatggctcactgtaacctcaaacttctgggttcaagtgatcctcccacctgagcctttgagtggctgagatcacacgtgtgcaccaccacatctggctaagttttgtgggttttttggtagagacagtgtcttactatgttgcccaggctgatcttgaactcctgggctcaagtgttcctcacatcttggcctcctaaaatgttgggattacaatcatgagccactgcacccagcccgaaattttttaaataaattttgccaggcaaggtgggataccgtgtagtcccagctactcgggaggcaaatgcaggaggatcacttgaagccaggaattccaggacgtgtagttcactgtgatcacgcctgtgaatgtccactgcactccagcctgagcaacccagtgagaccatatctcaaaaactaaataaaaataaagtattttaatatataactaaattgatatccaaaaaagtgctattttatatgactaatatatgaaagcttctgttgttccttaccttctccagttacttgccttgtgcagtctacaaatccagccttaaaaagttgtttaatttccatttcttctatgaaagatgttaaaaatttttttcctttgcttctcacttaagtttctttgtgaaatatctgttcatatttatcttttttaaaataacaaatgtttttctctttatatat

SEQ ID NO: 242235 - DNA, 481 bp, Homo sapiens
tttttaagcagactgttcagggagggctttaaatcttatctgtcagaacttgcagtgtggttttataaaaagacattttataaatgaacacattaaatcttatcaagacctgtgcagcctttaaaaaataaatcaggaattaccaatatgctgaaagaacatacttaaactggcaacatttagatgctctagattttaatttttcttaggtaagtggcattgaagaaatttgcattgcatataagataaagtcaatatttaagtaacatgagatccctagtaatgtagacaagaaaaaatgaatattgagaaagaagatttggatttttttcattaaaaataccaagatagggccgggtgcagtggcttacgcctgtaatcccagcactttgggaggccaagacaggctgattacctgaggccaggagttcgagactagcttggccaacatggtgaaacccctgtctctagtaaaaataca

SEQ ID NO: 242236 - DNA, 651 bp, Homo sapiens
ctgcttcacccctccctgccttggtacatgtgctccctactgcatagagtactcttttttggggagggtatcatagactgaattgtgtcccccttaaattcctatgtagaagccctaacccccagcaagttagaaggtgacttgcttctatttggagatggagcctttaaaaggtgactgaagttaaatgaggtcacgaggatggggccccgatcttcttggactggtggcaaggctgtgtgaggacacagcaagaaggtggacatctgcaagccaagcagagaggctcagaaggagccaaccctgctgatgttgatcttggacttgtggcctctagaactgtgagggaagaaacttctaatgtttaagccacacagtctgtggtattttttaggaaagccctagcaagttaatacacagggatctttactttttctatataagaagtatataaacaattgtttcttataatttaaggacagaggtgcaccaggaaatgtgaaagtcccatttcagatcttctctccttttattcccttccccagaggacgcccggtcaaaagccctgtagcctccttggagttcttctctatgtttgcatttgtactgttacatagattagattcccctatttgtatttttctataactt

SEQ ID NO: 242237 - DNA, 1036 bp, Homo sapiens
gagtgattactttgagtgggtgttcaggagggattgctggaggagatggttctttgatctgggccttgtaagatgggcagaagttgagtatgtggagatggtaatggccttcagaatttatgtcttatctgtttggcctggcatacaaggcctttgacaatttggcagagtctggcttttttggtaggtctccagccagctcttcactttgtttcagccacttggaaccaagccacatcgcctgaatatgcaggtatgggtgtttcagggctctgtgccttagccaagagtgtccgttctccttcacctccctcctcctacacctccctcctctttctcctgagctctttcttatacatccttgggcatggcctatatctgctttacatctcggggtcagaacctgacccatggcaagagctcagtaaatgataaatgaatagatggaggttgagccttggagaagacaagtaatgagaaaaaaaaatactttgttggcctcatgtccttcctgtcccttttggggcagaaaggctcattcacaagtccaggccaaagtcagcacaggcttcaatttcattggctcaggccggtacacagatggggtgcattagagcttgatgatttaaagggttgggtgaaatgcctgactgtggggagagctgagggagctgtggctggcattgcacaaagcttcctttatttcactccacagccacccccggcgttaaataatctatagattcttatgcaggtctgcctaatggaaagatcattgccccagcctcctccttggaaaataggcctttcttttcatttttccctccctcttccatttaagaaagttcaaggagagaatgtctctcctgttctcctctcttgacttaatctcctatgcagtttcagaatctgcccagtgggagttaggagctgggaagcagataactggagctggatcagcagtgtaattaaatgatactttgtactggtaatagggcctttcatctgaaagcttgacattcgtttggtgcaaaaa

SEQ ID NO: 242238 - DNA, 719 bp, Homo sapiens
tccactacctctcagcaagtcaaactcattgccttaactcaaaccctcacccttgcaaagggactacgtgtcaatatttatactgactctaaatatgccttccatatcctgcaccaccatactgttatatgggctgaaagaggtttcctcactacgcaagggtcctccatcattaatgcctctttaataaaaactcttctcaaggccactttacttccaaaggaagctggattcattcactgcaagggccatcaaaaggcgtcagatcccatcgctcagggcaacacttatgctgataaggtagctaaaaaagcagctagcattccaacttctgtccctcatggccagtttttctccttctcatcggtcactcccacctactcccccactgaaacttccacctatcaatctcttcccacacaaggcaaatggttcttagaccaaggaaaatatctccttccagcctcacaggcccattctattctgtcatcatttcatagcctcttccatgtaggttacaagccgctagcccacctcttagaacctctcatttcctttccatcatgaaaatctatcctcaaggaaatcacttctcagtgttccgtctgctattctactcctcctcagggattgttcaggccccctcccagtcctcccatttcattaccacttggctagccctgtgattattaaattctttctttgctgccaaaaaaaaa

SEQ ID NO: 242239 - DNA, 415 bp, Homo sapiens
cccctagaaagtgttagaactgattcgctgagttcaccaaggttctcttccaggacagcgttccccacagaagagaaactgctggggtgaagccaaattgaagaagagaaagatgaagagaaggtccaaatacaagtagaataggggatagtcaaccaaaatctctcagcagaatactggttttgaacacttagaaagaaacagggaagttcccgtgaatcatgcttccttctcaaagtttaggaaatggaatttacttaagaaactaaggaaagtttttagatgaatctcatacaaagttattttaatgaaaagaaagagcaaagataagatttctgggcaatgaagatctatcagaaaggtctacagagcagagcaaaactagttcgtttaaaatgtgctaaaagatattaga

SEQ ID NO: 242240 - DNA, 566 bp, Homo sapiens
tacacataagagaatattcaactttattaatcattggggaaatacaaattaaagccaaagggagacaacactccttacccctaggaatggctaaagttaaaaagatgggaatacccatgtcaggaaggatttgaaacaactgcaactctcatatgctgcaggtgggaagtaggaggcaggcctccactccagaggaggggctcacatgacacacaccaaattgaggactagctagaacagggatggctggaagcagctttccataagacacacccaccagtgtgccacgtcagtttaccattgccatggcgacacccagaagttaatgcccctttccatggcaatgacctgatgacccagaagctaccatccttttcctagaaatttctgaataatccacctcttaatttgcatgtaattaaaagtggcaataaatctgactacacactacctctgagctgctgctccgggcacactgcctatggggtagccctgccccacagggagcagcccttctgctgctgctgctgctgtttacggctgcttcaataaaaactgctaactcc

SEQ ID NO: 242241 - DNA, 303 bp, Homo sapiens
ccacgtgcagcctattaagacaattttctgtttgaacttcacaggactttcagcttcttgggttgggacacattgtctatttgttgcgtgtgtggagaacagtggacagcaaagatcaaaacccttaggggagaggggcaagagagaggatatgagtggggattctctgctcccctgaacagtattccaggattccttcaccaattgaagttcaagtttggtcctctgagcaaaaagtttagagaagttcctttatgcgtttatttaaatttagaataaacatctctgtagcaataaaaaaaa

SEQ ID NO: 242242 - DNA, 466 bp, Homo sapiens
aagatgctcccagtctcccctaagctgtgtttgggaaacagtgtcgctggtctcctcctccaaatattctcaggttccttccatatctagttggaaatgttcactatgcctccttctgatcttggggttcacctcgggagtggggagattaggacatgtaagtcacatctctctgctgtatttctgtctttctctcctgctcacagcccccttgggatacacagataggttccctttccgctctggtcttcagagtagggtgtgtgtacaacattcctttattttcttcccacctggcaagtgatttgcccgtccctatttcctgagacatgaaggcaaatagggtgcaaggaatgagaacttgttttcacagataagtgaacatgacctttgaagtggttagaaaaacacagcaatcacactagcatacatagacccttgaggctggctgggagccctgtacaaa

SEQ ID NO: 242243 - DNA, 457 bp, Homo sapiens
gacgttaaaaaaaaaaccaaccccaatgtggctttccttctttctcactagggtgatagtccgacgtgcatgtctgtttcctggaccctggatgtgaaaatggggttcttgaaggcactgggagtgtttctctgctggccccagaggcctgtgtgtgctgctggcgaggcagctgggccactgtcactgtgccctgacaacaacgttgggaactgttcctgaaagtgttaaacaaaatttcagtttattaagcgctcctctcattaagccattgttttatttttcttttttgattttttgggcttcttttgaagccataataaattggaatagaaagaatacataccaagaaacaaatattaggtctgattttttaattttttgttattatttttgagatggagtcttgctctgcactccagcctgggtgacagagtgagacgccatctcagagaga

SEQ ID NO: 242244 - DNA, 329 bp, Homo sapiens
tggctcacttagaagctcagtttgcttgctcttcaagtatcaagactaggaaacattgctaaggaaaactaaggtggctagaagccagtctgtctcatccatctctcgccactctccttctctttaaaaatgataatacaaagttgaagaatatcctgtttgtttgtttgtttgttttttgagacaaagtctcactctgttgcccaggctggagcacagtgcacgatcttggcttactgcaacctcagcttcccgggttcaggcatttctcatgcctcagactcccgagtagctgggactacaggcatgcaccaccatgcctggataat

SEQ ID NO: 242245 - DNA, 350 bp, Homo sapiens
ttggcaggtgacctgaatggtaaaacacaagacagtggctttcacactggcaaaggctctgctgtggaaccctacccctgtgatgaaactataggcttgcttatcaattacaagaactcgtgccgaattcggcacgagctagtctcgagttttttttttttttttttttccaaagtatttgccagttgtttatttctcaagagaaactatttcttaactcacatattcatgtttcatagttcaggaacataggtcagcgacaaacttttaggtcaacccaagaagattatctatattccaaaatcaccttgcactctgaaagataccagccttcctcatctcctcaaaat

SEQ ID NO: 242246 - DNA, 431 bp, Homo sapiens
atggttcaagacaactcacatgactcatctggggcgcttgtttaaaaggggctttccaagctacccataaccattaaatcaagatctcaaaaaactggcccagagatacagatttttagcaattactaagtgagcattatgtactctaatgtttgagaacactgtactacagcgacccccaaaattaacattaattgactaagtgaagtgcacaaaaataattgtactgggccatataattgattaagtaacctcatggggaatgcacaagtcactttattattagggacaaaggcaacttgtctatggcttacttgaaattcaggggcttaggccaaatctggcacatagcagatgctaaatacatattgttgagtttgtaagtggatataagaaaacctgagccacaatgtcagtccttaagcccagct

SEQ ID NO: 242247 - DNA, 432 bp, Homo sapiens
tcaaatccatggcttgctgaagtccaagcctaccctaagatgtctgtgagttccaggcatgctcaatgctgatgacctccctggtctggagtcaattgctttgttgcataaagtatttttcctctatgtgtttttccagatgagaaactcaatctctagttcagtttaaaagttatcttcaagcaaaatactctgaggtgttactaaagatctggaaagagattgtctagtggatcacataagaaccaacttgatccttcatatattaatccctttttttataagtctttgtaaaaaaagttgggttttgttttgtttagttttgttttgagacagagtcttgctcttgtcacccaggcagagcttgcagtgagctgagattgtgccactgcactccatcctgggcaacagagcgaacccatctcaaaaaaa

SEQ ID NO: 242248 - DNA, 643 bp, Homo sapiens
  misc_feature (622)..(622): n is a, c, g, or t
  misc_feature (635)..(635): n is a, c, g, or t
aatttgtatttccctaaagcctaataatgttgaacatctttttatgtgcttatttgcccgctgtacatctttggtgatgtgtctgtttaaatcttttgctcatttttattggcaattttgctcttcttattgagatgtaagttatttatttacattatgtgtaattcttttaacgtatatatgctttgcaaatattttctcccagtcttttcgtttctcctgtcttttcatttctttaatagtgtcttctgaaaagcaggcatatttaatttcaatgaagtgcacactttttattgtcctataagtaatttttttatttaaaaagaatgcaggctgggtgtggtggctcacgcctataatcctaacacttcaggaggccaaggtgggaggattgcttgagtccaggagtttgagattagcctaggcaatgtagggagactctgtctctataaaaaatttaaaaattagcctggcatagtggtgcgcacctgtagtcccagctacttgggaggctgagtccagataattgcttgagcccagtactttgagaccagcctgggcaacacagtaagaccctatctctacaaaaaaaaataatttaggaaaaccttacatacaaggnagaaagacgttgnggaacaca

SEQ ID NO: 242249 - DNA, 521 bp, Homo sapiens
ttttatttatttatttatttatttatttaaagacagggtcccactccatcacccaggcaggctgtagcccagtggtgcaatcaaggttcactgtagcctcaaactcctggcctcaagtgatccttctgtcttgatttttccaaagtgctgggattacaggaatgagccaccatgcctggcctgtattttttaattttacacatttccatctctaagggataatgagtggcagtgcacactaaaagcagataacttaaagtttgtaattaaattgcactggccaaatttgcccaagctttcccacaatacatgaccaaaaggttctgcataagaaacaaacttgaaacagaaataacaatgctaagtgaagagccttcatagatacacatagaaacatatctagtaccctttcttgaaatgcttcccttattttttttttttccaagaggaaaagcaaaaaggaaactgtatgagtttgctattgctggtataccaaattatcacaaacttcatggctaata

SEQ ID NO: 242250 - DNA, 505 bp, Homo sapiens
atcccactttagcctcccaaagtggtgggatgacaggggtgagccaccatgcctggcccatgcctttgctcttagtcttttccctcaggtctaagaggggaaacctccactcccatgcccccgccaaaaaggtccctttccatgctgtcacatgccccactgccgctgtcttcactgagctccatgctgagagcctgactgcttctgggctcactaagtgcctcaagggcaaggccgacaagcccacctggctcagtctggctaggccagtatgtgcactgggcctgggacataaattagaaaataaaattgaaaaagaaacaaacatattcttttaggaactactcagatctttaatggagtgagaaagggtaacaaacagttggacattctaaaacaattctaggccaggcacgctggttcacacctgtaatcccagcactttgggaggctgaggtgagtggatcacctgaggtcaggagttcaagatcagcctgaccaacat

SEQ ID NO: 242251 - DNA, 177 bp, Homo sapiens
ctggaagttataaagaaagaatcaaatggaaaatgtggaatttaaatgacatttatcaagattagaaaatcagtgcataggtataacagcagatttgacctagcaaaagatgaattggtagctgtaaaataagaaaaataaaatatatagaataggaaagagaaaaggagagaggta

SEQ ID NO: 242252 - DNA, 410 bp, Homo sapiens
tatatacccagtaatggaattgctgggtcaaatggtatttctggttctagctccttgaggaattgccatactgtcttccacaatggctgaactaatttacagaatttgaattttagaataattttaatgtgggctagacatggtgactcacacctgtaatcccagcactttaggaggctgaggcaggtggattgcttgagcccaagagttcaagaccagcctaggcaacatggtgagaccccatctctacaaaaatatcaaaaattagccagcgtagtgccccacacctatagtctcagttactcaggaggctgaagtgggaggatcactggagcccaggaggcggagattgcagtgagttgaaattacagcactttcactccagccaggacgacagagtgagactgtct

SEQ ID NO: 242253 - DNA, 533 bp, Homo sapiens
tcacttcccacctctagtgcctattactctgtacccttagtaaatatatgcttcatatctgcatgtatctatgttgtccattggagtacattcttaaagtcaagctctacacaaattaacttaagcaaacacacaatgcacttagtgttaagaatgtggaaaagagacctaaccagaaatattaaaaaagtactcaacaaacctagaggagcttacaagtctatggatgtaagcaaatgaaatggtccaggcacaggggctcacgcctgtaatcctaacactttgggaggccaaggtgggtggattgcctgaattcaggagtttgagaccagactcggcaatatggcaaaaacttgtctctaccaaaaaaagaaaaaaaaattagccaagcatagtggccaagtgcctgtagtcccagctactggggggctgagatgggaggattgcttgggcctgagaggtcgaggctgtagtgagttgtgttcatgctgctgcactccaatctgagtagcagagtgagaccctgtctctga

SEQ ID NO: 242254 - DNA, 322 bp, Homo sapiens
aaaaggtcacctcctggctggaggccaaccaacacaaaaccagcccactaaacaaaacacaaccaaggaccctcacagagtccactttaatcccttgctacctccactgtagcaggtgctggcatcagtggctgcaagacctgtagatagatcacaacataggactctttggagacactccccagtactagcccagagcacagtagctccactgggttcctagacccagaagagcaaaaacaatcactacagtctagctctcaggaagccctattcctaggggaagggggagaacaccacataaagggagcatcccatggtt

SEQ ID NO: 242255 - DNA, 370 bp, Homo sapiens
gagtagttatcactttaatagagttgtagtttgggtgatgaaaaacttctggaaatagaaagtggtggtggttacacaatattgtgagaattttaaccaacctttggattttctcatgggagaccattgtgtgaaatgacttaattaggttttcacagctctaaccattaacttaaagcaagacttagaggacttttgtaaatccctcttttaaaatttataaatctggatacattcaactcatacctcaatgagctaatgcacctaacaaagggcttctataaatcagtaagaggaaggatcaactatctaatagaaaagtaagcatatatgaaagagatcatagatttgagaggtgggggctcgtgca

SEQ ID NO: 242256 - DNA, 495 bp, Homo sapiens
tcagcacagagaactctttctttttgatagctgcatagcgtcccacgggatgtttgcaccatagctgattgagtttgaccctggttggtggacttttagattttttctagtttttcccccatcagacatggctgcagtgagaaccccttattcctgtgcaagaatgaagcagaacagatgagtggaatagtagaatggatgtgtttatgaaacagtgattgggctgggcgcggtggctcgcgcctgtaatcccagcactttgagaggccaaggcaggtggatcacaaggtctggagttcaagaccagcgtggccgatatggtgaaaccccacctctactaaaaatacagaaattagtcgggcgtggtggtgggcgcctgtagtcccagctactcgggaggctgaggcaggagaatcgcttgtacccgggaagcagaagttgcagtgagccgagatcacaccactgcactccagccttggtgacagagcgagatgc

SEQ ID NO: 242257 - DNA, 391 bp, Homo sapiens
acacaactagctattgggaggaacggaagtctgacagatgatggaacatgatcagagcatctctaaacttgaagggacattatgaatcatctagaataattattttccaaacttcaatcatttaaacaccaccctcataacttcacctatctctatacctgtcttttttcatttgtataaatttaggggttacaagtgcagttttgttacatggatataatgggtagtgcctatacccttcttcataagtttcctactgctgcctaacaaattgtcataaatttggtagcttatgcaacatggaattactgtcttgtaattctataagtcaaaagttggacatggatcttatgggctaaaatcacagtgttggcagggctttgttcctttc

SEQ ID NO: 242258 - DNA, 447 bp, Homo sapiens
tctgctggtgtgagtgctcgctagagccttctgctttaatgctctcccaactcctgtcagagggctggtgttttctactggctctctgagggttctcagaaaagcttgagaagctctcttcttatctgtgcagtgaagagtcttatgcagagagggctgctttagctagaaaagcccaaagttggagaaacatctctactgaaatgtatccatggacactattttttttccaactctctaaatcaggatacatggactcctatgtgtgtgagatggtcaggagatgcagtttggatgagaaagtgttgaagtatcaattggttatacaacaggactgaatatttgaaatcaggactgttctggaaagcttagcatgggaggaggggtcccatacgttgacgccggtgcccttccagatttctcccaaataaaatgtgctcttctaaa

SEQ ID NO: 242259 - DNA, 484 bp, Homo sapiens
  misc_feature (12)..(12): n is a, c, g, or t
gggtacggcttngagaagacgactgaatgtgaaaaagccttgggatttacctattgaatttattttcctccttaagcccatagggaagctcagaacacttttgggatgacagagctacataattatggtaccattattttcctgttagagatggcctgacgatcctagtcacctatcagttgaaagccattagaaggcttttgacccttaaaagtaggtcaggtgcagtggctcacacctgtaatctcagcactttgggaggcagaggcgggtggatcacctgaggtcgggaatttgagaccagcctgaccaacatggagaaacctcatctctacgaaaaatacaaaattagccagacatggtggcacatgcctgtaatcatagctacttgggaggctgaggcaggaggatcgctcaaacccaggaggcggatgttgtggtgagcccagatcgctccattgcactccagcctgggcaacaagag

SEQ ID NO: 242260 - DNA, 270 bp, Homo sapiens
tggacaggatggtgattgctcacaccaaagccttggacccctcccagcctgtgacctttgtgaccaactccacctacgcagcagacaagggggaacctgggatagaaccacatcagaatgaggaagagaaacccctatcacctccagtgtccctctagcatcctctactgataaagcttaacatcacgctagctggccgagtccaggagtaggagccaacaaagaaaggtaaattttgagctgaaggacaataaattaataactgacaga

SEQ ID NO: 242261 - DNA, 241 bp, Homo sapiens
ctccctttttctctaagtgtgaattaaagagaatctctggactaatatgtgcattgcttagcatttgtttgtgcctaatgactataggctttaagattctcatgcaaatactatcaaaacactctgaagtgacttagatgtttgcaaaacttttttcccccttggagtgaattaaaccatttcaattggtaatagtttttttttgttgttatttatttgttattctctgggtatagggttt

SEQ ID NO: 242262 - DNA, 487 bp, Homo sapiens
taatcttctgtgtctctacttaagttttagaacatatggaaccaaattatagcactgttttcaatgaacctgtcagttaattctaatatctatggcaattctgagtccatttcaatttcctggttagtctctttgagaaagctcatgttttcccatatgtctgtaagtctggaaatatttcaatggatggaagactgagagttttacttggttggatgctgggtacttttggcttcctataagtatttttgtgctttgttctaggatgcacttaagtcacttggaaacaatgtgacactttcaggtcttgcttttatgatttcttaggcaaatctggagcagtgctcagtttggggcacattactcctcaccacggagaaaagacctttctgaacactctacccaatactctgaattatgagtttttccacgcctgggctgggcaggatcagtccttctccaggccctatggtgagtactgtgtact

SEQ ID NO: 242263 - DNA, 217 bp, Homo sapiens
ggaagtctcactctgtcatccaggctgaagtgcagtggtgtgatctcagctccctgccacctcaggctcctgggttcatgcaattcttgtgcctcagtgatatggtttggctgtgtcctcacacaaatctcaccttgaattgtaataatccccacctgtcaagggcagggtgaggtggagataactgaatcacagggggagtttcccccatactgtt

SEQ ID NO: 242264 - DNA, 241 bp, Homo sapiens
tgaaggtagatgaatttagaatctaattcaggacaatagtgaaataagaaagtaaacctgagaaaaatataaaggaagaattcattcaacaaatgtttcagagactggacactgccttcatggagctcatacttagttaagcaccatattgtaagaataaggtatacttacctgttttggagacttaacatcaacttggttatagtttcagttcagttagaaaaaaattgtactaggtgaa

SEQ ID NO: 242265 - DNA, 449 bp, Homo sapiens
attgtctaaccagactggattctgtcaaagcagatgtgtctaagatgctagaaatgaatgcataccaaaggacacaattgaataatgctggacagagaattctgcaagacagtctgcctagccagagtagcaagggaaggcaccgagtcagctactgagaatgaattttgaaacagagacttgtcaaaggcatagaaaaattgcaaaagtggcaacaacatttatggtaattacataggatccacagagcactttcacatcagctatctcatttaaccctcaagatgcctcagagatgacaggaagcatggacatgcattgagtcacttgacttggccaagatgtattggcaagttgaagtatattgggagctgggaatgaccattttcctccattcatatggacatcttataatcatttcttaatatacctttactgtagagccttca

SEQ ID NO: 242266 - DNA, 263 bp, Homo sapiens
acacttccccatccttatgcaacgaatgactgaatatatattcaactgaaaaggaaaagtaagttagaaatgattataaaacataattgatattaggatcaggaagaagaggacactggatctagagtattagataaaatttctcaagccaggcatggtggtgtgtgcctgtaatcccaggtactcagaaaactgaggtgggaggattgcttgagatcaggagtttgagtccaggctgggcaatatagtgagacttcatctca

SEQ ID NO: 242267 - DNA, 224 bp, Homo sapiens
gatctttttctgagcattcagtctcctatttcctaagtgctcagcaaaacatttgccagcccaattcttaatttcattatcatcagcaaaatgaataatcagaattaattggtgaatggtttcttcctagcacccctttaagaaactttcccctgcaatctccatgggcactagcttcagcccttgagtataaataagtcagtaataaagaatgtaggagccta

SEQ ID NO: 242268 - DNA, 447 bp, Homo sapiens
gctttgatttatacagacttgtaggtttccctgtgaatctgggagcaggatgaagtgatgctcaaaggatcaagatcaaaaggcagtggaaagaaatgaaggatgcaggagaaagatggacattgtgaataaagggaagagagagaggggtgatggggaaggtaggaagatcaggacagagcaaggaacaacaggatgagattcaaaagaaagcaacatggggaacatgcaagtggtgagggctaagaaatcttaataatgaagaaaccatggggactaagaggaagttgaagaaagctgctggagcaacctagagagacagaagagagcagagaagtgagtgaaaggaataaacctgggatgagagagaggatctgcactgtaactctgatattgaccaagaggattgataacctcccttttattaaatgccacatacatgccaag

SEQ ID NO: 242269 - DNA, 361 bp, Homo sapiens
cctggttaattttttgtattatcagtagaggcagggttttgcagtgttgcccaggctggtctcgaactcctgggctctctgcctgcctcagcctcccaaagtgcagggcttacaagtgtgagccaccacacttggcccacactgactcttacttgaaatattttgagactaataaatttttgttttcttaaataaaatataatagactttttttgatcaaaagattaattgggccaggtgcagtggcttgcgtccgtaatcccagcacttgggaattccaggtgggaggttcatttgagcccaggatttggagaccagcttgggcaacatgatgagaccctgtctcaaaacaaaacaaaac

SEQ ID NO: 242270 - DNA, 565 bp, Homo sapiens
cccctgtagtcccagctactcaggaggctaaggtgggagaatcgcttgaacccgggaggcagaggttgcagtgagccaagattgcgccactacactccagcttgggtgacagagcgagaccctgtctcaaaaaaaacaaaaagatgatttttatttaaaaaaaaaaaaaattagctgggcgtggcggtgcatgcctctagttccagatagctgggagactgaggcgagaggatcccttgagcccaggaacttagagttggaggctgcagtgagctgtgattgcaccactacactcctaacctgggtgacaaagtgtgagaccctatttctaaaacaaaatggtgatttttaagtattaatatgctaattgatatggagtggtagaagtagtcataaaggattataaggcagtataattgaatttttctattttttaaaaaaatctaggccaggagcagtggctcatgcctataatcccagcactttgagaggctgaggagggaggataacttgaggccatgagtttgagaccagcctaggcaatattgcaagaccctgtctctac

SEQ ID NO: 242271 - DNA, 416 bp, Homo sapiens
taagcaagagtaaaagagtttaaccccatatttcctagacattatagtataaagacacttgacaatagtatcaggagatgccttactaagtctaaggttgtttctttgtgaactgaggtgtccagggtttgtcaaagcaggtcttattaacttatttataaagcagcccagacaccaatatccactctactttcggatggtcactgggattgactagacattgcacgaaagttaccttactcttgctttcttgtttcatctaaaagatggctgtgggaaacctcaagcctgttgcaaaggcacccttgggcttccagagtccagaggtctctctgtggaagctcagttacaccccactacctggccagtgccgacactatggaggccaagggcctgcagggacagagcaaatgttt

SEQ ID NO: 242272 - DNA, 651 bp, Homo sapiens
tttcagccagtcatctaaacagactgttggagacccttttaaccccttgagctgcaacaataaatatagaatctgcttagtgggcccatgtcagtaaattcagcttgatccaactttatattctttccactattatcccataccttcattatccattcccacatgtatttccttggtttttatctgtataaattggaaaaatcatgtagttcttctggagtgtagtgcaccttctcatgggtcacagtttgtatctcacctttcagggcctacctgagcttgagttcctttataggtctggtagcaaagaggagtagtaggagtagatcctgactgtctgatcaaagccaggttaatctcctcaaatgaggtggaaagactgctgctgctggcaaagaagactcagaattttggtgtttaacatccccagctccatcaggatcttcttacatatttccattccttcccaatcaacaccctcactttaatagcagacaaacttcaaggttggtgattcagtttgtgtttcagttcagtcacttgcaggatgagagtgttgttctgatttttaacaatcttagcactgaacctgcaggagataaggatttctttcaaggaagacctagaaactttcagataatttatacagtt

SEQ ID NO: 242273 - DNA, 425 bp, Homo sapiens
cagggctggaaaataggaagagtgaaccagggaagtaggtgagagagactttattcctggtttctactctttttatgctagtgttctgtatgagattttatttgagagatgattctgctgctggaaaagtaaaacaaaaaagctgggctgggcgggtggctcacaccggtaatcccagcactttgggaggctgaggcgtgtggatcacctgaggtcaggagttccagaccagcctggccaacgtggtgaaaccccgtctctattaaaaatacaaaaattatccgggtgtggtggtgggtgcctgtaatcccagctacttgggaggctgaggcaggagaatcacttgaacccaggaggcagaggttgcagtgagcgagatcacgccattgtactccagcctgggtgacgagcaaaacatcgtctca

SEQ ID NO: 242274 - DNA, 399 bp, Homo sapiens
tgcataaaattaactgtgttatatacagtactgctgtaataatttcatagccaccttctgttgctattgcagtgagctcgatgttacaagtatccgcttaaagcactatatgacactaatttccacctgagcaattaatctctccagtaagttgcatataacagttacaagtgatctctcacagttcttgagtatttttcattgtgtttagtacaataccatagaccttgaataacaccgtaggacccacataaagtgccgctaatgctctcaaaagcaaagttatgacatcatgggaaaaagttgaattgcttgatatgtaccacagattgaggtgtgtagctgcatttgcccaccacgtcaagataagtgaatccagcataacaactattgtttaaa

SEQ ID NO: 242275 - DNA, 813 bp, Homo sapiens
attaggctgcagaaaggaatctcctgagggagttattctgaagaagggaagttcctctggtctggtgtctactagaattgcttttccttgaaactctgccttcttctggaaggcagaaatctaacatgattcaatggctacagctgtggaagtgtgcagaggaaagcattagaccagggttctcatccctggcttgcacacccagagcctggcctgcacacctagagcctggacccaaaaacaacaaaaaagtgatggaactggatgctctcccagtcttacatttctatgtaaatgtgaaagagaaacatggctacaaggaccaggtttgaaatttttcactataaaaagtttttgaaaataaggagccccagagagaattcctagaagatggcagaggaggaaaaagaggaacctatcttcccacctagataataattttaccagtagaatctgtctaatgattttctcctctggatttgctctggcacctcgaagaagcttaggggaacagttcagctttgctcttcctgataattagtggctttcctgatggtgtggttcaacacacccaccagagacggaagatgtaaacaacatgtgtgctccagatggactctgaaatccaggctcccactttatgacacactcctctacaacaccagagactcccaaacacaaggcctttatattgactcatttcagctcacatcctggcgactctcaagagagaaacctcagagtgactaaaatctccagtttgagaagacctgtacattcagtatctatttggaaagaatcccaaaatgatac

SEQ ID NO: 242276 - DNA, 560 bp, Homo sapiens
attaggctgcagaaaggaatctcctgagggagttattctgaagaagggaagttcctctggtctggtgtctactagaattgcttttccttgaaactctgccttcttctggaaggcagaaatctaacatgattcaatggctacagctgtggaagtgtgcagaggaaaggtgaaatcattatagaatactgaggaatactttgacagaaattatccttactctttttccattgaagtggggtcccctgaggtaaccagaggtgtgatgggaaaagcaaatcaagttattttttacctgtgtgccaatgttgtgattgtcataagtccaatgagaagtggatgcctgtggttttgaaggaatgtgcttagttcacagaacgaaaaggcttctcagttaactcgaagactaaaagcacacagattaaaattcagagaatgaggaaaagaaaatccagggaagtctgagtttcattggagcaagtatagatggttaggatatgatttcctggcatggtctgaaaaccatattctttcattccaaataaataaaaaattcttacaaa

SEQ ID NO: 242277 - DNA, 443 bp, Homo sapiens
gacagagtcttactctgtcacccaggctggagtgcagtggcgcaatcttggctcactgcaaccttcacctcccaggttcaagctattcttgtgcctcacccacccaagtacctgggattataggccacctgactaatttttgtatttttagtagagacgggatttcaccatgttggccaggctagtctggaactcctggcttcaagtgatccacccacctcagcttcccaaagtgctggaattacaggcgtgagccaccacgcctggccaacacagaggtctactttaaactgggaggcagaggacatctctcggacgaagtgctatgttttaagctgtgcctcatgtgagaagaaggccaaccaggtaaggaactggagatggagctttcctgcaaaaggaatagcacatgagggcccttgagcccaaggaaactgaaagaa

SEQ ID NO: 242278 - DNA, 451 bp, Homo sapiens
gttcgagaccagcctggccaacatggtgaaactctgtctctactaaaaatacaaaaattagccagccgtggtggtgcacacctgtaattccagctactagggaggctgaggcaggagaattgcttgaacccagggggcagagattgcagtgagccaaaattgcaccattgcacgctagcctgggcgacagagtgagaccccatctcaaaaaaaaaaaaaaaaaaagaaagtaagaatattcaaacacttattacaatatagacatcgactcttaaattatcccaaattatgatataatcatattcagttgatggggaatagaaagtgttcacgtgtggcattaagtcagcaatggtggagcattatattaccatctgtaattgtgggaagtcaaaagtaacgcctaatactgaaaaatgaagaagtggcaatatgaacatgttatatgaga

SEQ ID NO: 242279 - DNA, 488 bp, Homo sapiens
cacagactacgacaacgtgcctaggcccatcagagtctgccctccacccaccttctcagcctcctctatgatcctcttttcccagcctgaagctcacgtctcctgactgctctggcccagtatctgccacactcttcatgctttggtgcctttgtgtcttgtccctcagcctggaatacccttctctctttctcccctgcagtgaattcctgctcatccttcaagatcagtggaaaacatagctcttctttgaagccttccctgaccagctctgagcacagttagttgttcctttcctggaggtccagtaggatctagagtcactgcctccttgtagaaagacccttcacatggtaccagagatggtagtaaacatgcttgagtcaggaaagacttttccaacttttattactgtactaatgcatttaactaacacagatatggagacactgtgttgatgccagagtatctgttatatccaaataagg

SEQ ID NO: 242280 - DNA, 535 bp, Homo sapiens
agtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaatt

SEQ ID NO: 242281 - DNA, 436 bp, Homo sapiens
gccggacctggctcctgtgggctgggtgggggcttcagctgtgtcccttctcactccagctgcctttcctgggccaggctcgctctctcctgctttcaaggattctttttctttccaagctccttgccgtctttcctctctgtggagggcagatactccaccagctagagggaggacccgagccgaggggccaggctttcagactgggaggcgcctgagtgcgatccagcctgcccgtccccagctctcctgctcccaacccgatgtctcccagggctgccacagccactccaaagccagcagaacccagtaccaaccccaccaggtcctgttgccttgtcgcccagctctgggaccccatgcccaccctacagctcttgctctgcctgctacagggtcttcaaggtaggcaggaagccaggctgtgggcggccgc

SEQ ID NO: 242282 - DNA, 695 bp, Homo sapiens
ctgttgtatcctgtggggggggtggtccccgctccggctgcggccaggctgcacccccgcacgtgcggctcgcgggagcctaagagctgggtacccgggaggggttgcagagagaacagacggcgcgtcccgggctagtgctttattttaaggggccagtagagagtcgcttcttgcctgtttcccgggacgctctccctgtcgcccgagctcccagtccagtcctgccccgccccgccccgccgtgcttctgttctccttaagcccgcgcgaaacaaacacccggttccccaagcctggggtcttccgggagctcatttcgaaaccatgacccttgaaaccaggaaagtgacaggagagactctggacagcatgggacggaggctgagtctctcctctttgtcccttgttccaactattaaaatgcggcccgggtgcaggtggaggcggtgtgctgagcgggttccaatgcaacgggggaacgactagcaacggcaaaaggctcagctccggagggttaaaatctgaaatctccaacctggcccgaggctggtgtaaggcggctgtaggattctttttgtcacttcctaacaccctgaaatgctgccgtcagcaacatgtctttaagtggaggctgcagtgagccaatattgcagcactccactccagcctgggcgacagagcaagactgtctc

SEQ ID NO: 242283 - DNA, 1162 bp, Homo sapiens
tcttctgtttttcttcgtttgtttttctggctcttttccccgctgtctttttcactcatctcgtggtttccgtttctctgctccctgatggggtttggtttcgtctccgctccttcgtggcccgttgtcctcctggccttggttcgttggccctgtccgcttcacccccttttccggcgcccctgaaaatttttggttataacgcaccaccaggaccctgagcgcgatacaactgcaccgtgcgcttgctggacgacagcgagtacaccctgcaccatccagagagatgccaaggccagtacctgttgaccttctttgccaccatcgtggacctacttgagaaagactattttggtatccgctttgtagacccagataagcagcggcattggctggaatttacaaagtctgtggtgaaacaattgagatccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttcaagtatcaaataaaaataatttatataaatatt

SEQ ID NO: 242284 - DNA, 151 bp, Homo sapiens
ggtgccgcagcccgcgcggaggacaaaggctcccccctccgccgctgcaggcgaaccccgccccggggagggaggagcacaggccccaggaaagcaaagcccgggggtccagattcagctctgcggcagtggggcagcgtcctgtgtcccg

SEQ ID NO: 242285 - DNA, 1153 bp, Homo sapiens
tgcagtggctcacgcctgtcaatatcagcactttgggaggccgaggcgggcagatcaccaggtcaagagatcgagaccatcctggccaacatggtgaaaccccgtctctactaaaaaatacaaaaatcagctgggcgtagtggcgcatgcctatagtcccagctactcaggaggctgaggcaggagaatcacttgaacctgggaggcggaggttgcagtgagcagagatcacattactgcactccagcctggtaacagagcaagactcatctcaaaaaaacaaaacaaaacaaaacaaaacaaaacacattcccccttacccaaattgatatctagattcaatgtaattccaatcaaaaccatgacagacttttgtgtagaaactgaaaagctgattctaaaatgtaaagaaatgcaaatgacttcaaagaatcataagaattttgaaaaagaacaaactgtcaaatttcaaaatttgctgagaagagtactgtaatcaaaaaacattatgtattagctgaatggacaaatcaataaagaacagaccacacacagatggctgattttggataaaaatgccaaaataatataatgaaaaagtactgtctttaataaatggtgtgtttaacatacagtttttaaaaaaatgaacctcaacctcacacaaaaaataactcacaaaatggattacaggtttatattttaaagctaaaactataaaaatgctgggttaaaaagtggagaaaatcttagtaaacttggggtaggcaaaaaattgttagataggacacaaaagtcattaaccataaaataaattgataaaccagacttaatcaaaatttaaacctttagctcttcaaaagacaccaagaaaatgagcatgcaagccagagtcaatacctgcaatacatgtatctgacaaaggacctagatatagaatatatataaagaactttacgtttcaataaaaaggcaaactcccagccaggcgtggtggctcacgcccataatcccagcactttgggagacgagatgggtgatcacttgagctcaggagttgagagaccagcctgagcaacatggcggaggttgcagtgggctgagatggcgccactgcactccagtatgggcaacacagtgagatgctgtctcc

SEQ ID NO: 242286 - DNA, 695 bp, Homo sapiens
tgcagtggctcacgcctgtcaatatcagcactttgggaggccgaggcgggcagatcaccaggtcaagagatcgagaccatcctggccaacatggtgaaaccccgtctctactaaaaaatacaaaaataatataatgaaaaagtactgtctttaataaatggtgtgtttaacatacagtttttaaaaaaatgaacctcaacctcacacaaaaaataactcacaaaatggattacaggtttatattttaaagctaaaactataaaaatgctgggttaaaaagtggagaaaatcttagtaaacttggggtaggcaaaaaattgttagataggacacaaaagtcattaaccataaaataaattgataaaccagacttaatcaaaatttaaacctttagctcttcaaaagacaccaagaaaatgagcatgcaagccagagtcaatacctgcaatacatgtatctgacaaaggacctagatatagaatatatataaagaactttacgtttcaataaaaaggcaaactcccagccaggcgtggtggctcacgcccataatcccagcactttgggagacgagatgggtgatcacttgagctcaggagttgagagaccagcctgagcaacatggcggaggttgcagtgggctgagatggcgccactgcactccagtatgggcaacacagtgagatgctgtctcc

SEQ ID NO: 242287 - DNA, 363 bp, Homo sapiens
ccttcatggacctttaaccattcagatctcattctaatcctgtcaagaggggaccagtatcctgactttacagttgaaaaaaattgaggctccggaatccttaaatgagttgcctaaggttttgcagtgagtaaatacatggtagcattcagacctaggtgttatatccatgtctggtgcttgatccaatctagctgaacaactatccctaaacgagcaaaaaagattctgatttgaggtctgaggaccagggatgaagtcctggcccttgcctcttggtagcacatgatgtaaggcatatcagttagcctctctgaatcatagttttcttatttgaccaccctttattgcctgctttgtgaa

SEQ ID NO: 242288 - DNA, 310 bp, Homo sapiens
cagaatgttaattcccgttgtaggaggtgacgacactcagagagacctcgtcctggcctgcgtgcttcaggctgtgtttgaaattttccactatatgtaattttttaaatttgcagtttctttcttccttccttccttccttccttccttccttccttccttccttccttccttccttccctccttctttctttccttctttctttctttcttgagggagtctcactctgtcgcctaggctggagtgcagtgagccgagattgcaccattgcactacagcctgggcaatacagcgagactccgtctcaaa

SEQ ID NO: 242289 - DNA, 573 bp, Homo sapiens
tcaccagtttcaaactttttataaagcaacagtagcactatggtactggtataagaacaagcatatagattaagggaacagaattgatagtccagaaataaacctctacatttatggtcaagtgatttttgataaaggtatcaagaaatttaattgggggaagggataatctttataacaaatggtgctggggcaatcagttgtactgtaaacccatatgtgaaaggacgaatttagagctttactcaatattatacacaaaaagttacttcaaaatgcatcacagttctaaatataagtgctgaaatggtaaaactcttagaagaaaagatcagagaaactccctaaggtgttgacttaatcaaagagttcttagataaaataccaaaagcatgatttgaaaggaacaaaattgttgaactgaacttcatcaaaattaaaaacttctggttttggaaagacactgcagtaaagagaaggaaaagacaaggcacagaatatgagaaaatatttgcaaacatatctaataaaggacttgtatccaaaccatttaaataactatgacaactcaat

SEQ ID NO: 242290 - DNA, 167 bp, Homo sapiens
tggtcttccactgtactaatatttaattaactgttttcaaaacactctaataaatgttatttatttcttttgtgtagtaatttgtagtaacaaggaggttgatgtccagagaagttacatgacttgactaagatcagtcatccctttatgccaaatagtaaaagcca

SEQ ID NO: 242291 - DNA, 521 bp, Homo sapiens
tcatgctacagagaaatctttcatgaaaggaaaagtcaagagatgtggcaaacgtcattgttgtcttattttaagaaatttccacaaccactctaaccttcagcaaccatcaccctgagcagtcagctgccatcaacatcaaggcacgaccttccaccagcaaaaagattacaacttgctgaaatattaaatgaccattagcattttcagcaataaaggatttcttaattaagctatgtacatttttagatgtaatgctattgacaactaacaggctatggtatggcataaagataatttttatatgcactgggaaaccaaaaaatttgtgtgacttgctttattgcaatagttgctttattgtgatggtctggaaatgaacctgcaatttttctgagatacaaaatattaactgtactttgttttggtttgtacatatgaatctaaggtttattgacatggaatgatttgaccaaggtgatatagtggttaagcagttaagtgattaaactaactagtac

SEQ ID NO: 242292 - DNA, 351 bp, Homo sapiens
gtggatggcttgagctcagcagttcaagaccattttgcatgatatggcttggctctgtgtctccacccaaatttcatctcaatttgtaatccccgtgtatcaagagaggaaggcgattggatcattggggtggtttctctcatgctgcttttgtgatagtgatgagttctcaaaagatctgatttttttttataagtgtctgacatttcccctgtttgcatacttcctcctgccaccatatgaaaaaggtccttgcttcccctttgccttctgccatgattgtaagtttactgaggtctccctagccatgtggaactatgagtcaattaaacctttttgcttaataaatta

SEQ ID NO: 242293 - DNA, 460 bp, Homo sapiens
ccctattttttattcttctaagtagttaaaattagaaatcacagcaagtcaacaggaagctctcctctgccagtctcctaaatcacaatatggccttgtcgtggctggagtatttcaaaggctcagtcccactccagaatcggccctgtcgcctccgcccgcactccagagccggctgagaaccgcagcggcgcgggatccacgtgcagcgtctctccaggtcaaagctacctagatgtcatcatacaaattacaggctatgacgtccacctcattctctttctggaaggctgaccttaactgtcctgcacattccttacacagcatatttgcccttttcctatactaataagccctaaatcttgggggtaacagcctggggaactacctgtcttgctaccactcaagaccatacttctgtccacaaattccccccaataaattatcttttactgacaaa

SEQ ID NO: 242294 - DNA, 571 bp, Homo sapiens
agccttccatctagactgcaccctaggtccctcttgggaactctggactgctccccactgaatgtgccaacgcccccactcaccactgcctggctttcactcccagtgccatggacttggttccaaagggctttgagaacctcacataaaaacccactccaaatctttgagggtctaaagggaagattctggccccttcccagagacccatctactgtagggacaggaaaagaagacctggggggtagggaggggtagatggtaaatttccttaccaagaaaaatgccagccaggtgcggtgtctcatgcctataatcctagcattggaaggccaaggtgggcggatcacctgaagtcgggagttcaagaccagcctagtgaacatagcgaaaccccatctctactaaaaaaatacaaaaattagccggtgtggtggtggacacctgtaatcccagctacttgggaggctgaggcagggaggattgcttgaacctgggaagtggaggttgcagtgagctgagatcgtgccactgcattatatcctgggtgatagagtgaggctccctctca

SEQ ID NO: 242295 - DNA, 470 bp, Homo sapiens
gcacccacaccttctctccccggcttggcgcggggtgcagagtggagtgagaatggggggcccgggggctgtaaagcatgggggaaggggatggttcaaagacaacctcaacccttccggacccttctaaactcgccgttctccccgtaacttgcaggtcctcccacctcccagggctgtccattcgcccccacctctccagagggcccccccagttctccatccccgaagcctcctggtggctgactcccagccgcccgcggcgtgatttctccccggtccccaggacatccccagacttgtctgatctcccctgccccttcccccaacgcgctctgcctttctcccctgtccccaaactgcacgcctctcgtgtttccctccggccgttcgcagccctccgccccctcggctctgctgcgggtctttttggcccggctccaggcggggaaagttccccggcccggccc

SEQ ID NO: 242296 - DNA, 801 bp, Homo sapiens
taaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctgcctttgaaactgggggactcctaatcaactcttcctaacgggtaataaatattggcacaaggtctcacctgccctgcttgtacttaaccattcatttaacgcatatttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaa

SEQ ID NO: 242297 - DNA, 1309 bp, Homo sapiens
  misc_feature (1137)..(1137): n is a, c, g, or t
aaatagccgaaatgcctgtgcagaggcgtgtgattgaatacattatgatacactcgcacaatggagccacatcacttttttttccatcttcagaaaagaatgagaaagacctctatgactcacatgcagtgattgccaggatatattgttaatagaaaaaaagcaaaatgcaagagtatccttaatacgcttactttttctggaaaaagggagatataaaatacccttatctgctcatttctactggggaaacaacacaggaaagagaaacctgaagcagagaaattggttatgggtgggtagatgggaaaggcatgtcacaggtgaggagcggggaatagaggaaagcaggtgtgtgttggggaggcctgactctgagcataccttcttatgtagttctgactgttagaacatgtgaatgtttcacatacttgaaaaagtaaataaactggacaagattttaaaaaagaagaatgcaaaacaagtaaattgaaatgtatttcaattgaataatgtgaccatgccttaggggataggagagggatagagaactaacactagtaacctttgaacttgacattttgaccctaaacccttaagctagggattataataactgtgaactaatattaaacttaagttggttggctggtttttcacagtggtttggattagtgattctgaaactatgtgtattctaggtttgagcaaatacggaaataaattgtggataatgggagccaagtttcatccctttggagagagaagttataaagatggaaagtagaatgccaaaagtcaaccctcagtgtgttggactgcgattggaagtatcagtatcaatggattgtttttaatgtatggatgtagaaatagatatagatgtgtctgtacacaggagtgcacgtttcccaattctgtctgctgagaaggtctagaagcagtgagaccccagcaacagtgagcacaactatcatccacatattagtttctaaatatcattctcactaataggaactccttggagaagtggctgattccagaacaggagcaggaaaagatgagcctagagcatcttgctgtgccggaaagtaaggaagtgcccaaagaatgatagggacacatcaaaggacacangctgggattacaggcgggagccaccgtgcctggcctagaacaaaggaaatttttaagaaatctatacactgtttagcaatctttgctaatttgttattcatggataaaggttggggaggttgtgcattccagaaaggaaagagaaaaaaaattaaagtaaggccaaaatgtg

SEQ ID NO: 242298 - DNA, 108 bp, Homo sapiens
caaaagtgcattattttcattccctggtatttgttgctaatgtaaattttgttcaacaacctgaatagaattaagcaaagctttgggaatttttgccaggcaggtaca

SEQ ID NO: 242299 - DNA, 449 bp, Homo sapiens
ggatggtgaaagtatgaatggaaacatggagattaggaagaaacagaggtagggaagaatatctctatggtagaataaaaccaggcctttttcttactgctcagagtaattctgaaggctaaaactgagaaggccagtaacaaaaatgaagtgacaatggcccagagagagaactcaagagggttactctactcagcaaagaaaggcagcccttagaatgcccctgagcgaatggatggagccacattacgtaactcactcacttctctgcctttcatctttgtcaatggccataaacccgcaatttcactaaacgcaattcccatttcagagagtctttaaagcaagcggcactgcctcacaaacccatgaaaataggtccttttcactctcttatcttgaatctcaaaaaaacatactcttgctatgaacagatatggacttctttg

SEQ ID NO: 242300 - DNA, 414 bp, Homo sapiens
agattgaggcaatcagttataaggacgcctgctcataattaccttctcagaaggtaattatattaatactgaatttatttagtggtatgctgtcatcaaaaaaattcattaaaaataaaatcaatgaaggccgggcgcagtggctcacgcttgtaatccctccactttgggaggccgaggtgggtggatcacctgaggtcaagagttctagaccagcctggccaacatgatgaaaccccatctctactgaaaatacaaaaaattagctgggcgtggtggcacacacctgtaatcccagctactcaggaggctgaggcaggagaatcgcttgagcccgggaggtggaggttgcagtgaaccaagatcgtgccactgccctccagcctgggcaacaagagcaaaactctgtctcca

SEQ ID NO: 242301 - DNA, 469 bp, Homo sapiens
aagtccactttgaagtttgaagtccactcaagtgttgaagaagcttctaaaggtccaagtggagaccctggtcatagaactggtaggtttggtaggttgctccacaattatcatggaaatcaacaaacaggtcctgggaggaaagtcaactttcccctgccttttccccgtttctgaccatggctgtatgcagcatcatctcacattatactagctcatctatttttccaatcacctttattttttatattttcttatttttttattttcattctttagagatggggtctcagtgttgcccaggctggtcctgaactcttgggctcaaacgatccccttccctcagcctgctgagtagttgggattacaggcccaagccaacacgcccagccatctttgtttttgttgttgttgttgttttgaaatggaatttcgctccagcctgggtgacagagcgagacgctgtctc

SEQ ID NO: 242302 - DNA, 183 bp, Homo sapiens
tttttttttttaaaacagggtctcactttgtcacccaggctgcagtgtaatgtcgtgaacattgctcactgtagccttgacctcctgtactcaagtaattatcctacctcggcctcccgagtagctggaatcacaggcacacaccacagcgcctggctaattttttaaaatttttgtaggctg

SEQ ID NO: 242303 - DNA, 837 bp, Homo sapiens
atgtttttctcgtataagtgaagtgagattcttctaaaagtactgtctttccctttgctgtgaactaaaactcatgttccttaactctcatagagatgttggtctttttctttgtaatttgtgggagttctttgtatattagggaaactaatcctttgtgattttaactgcatttctaccaccaccccctcccccacaagtttgtcactttttaacattttaagtcctttaagtctgaatctggacattcaactcttaggcacatttaaagggctgtattatatatgaaagtagggaactacctgtaaatgttgccaagtaaatacagtattagtcctgaacatatttgaagacagctatgtggatgaaggttagattagatttattccttctctttatggagaagcaaattgcagctcagcatatggaagaattttctcttattagatcagcttcaaaatggaatggaaatcctttggaatagatggattcttcgttactagatttgttattgggaaggagatgccagccttttccccagttcattgcacaaaataagcacttagtgttgaataaacgaatctttggggcatctggatggttggattagctggtttttaataactttcacactgtgtttattttttatttttttgaaacaaggtctcatgttgtcatccaggctatagtgcagtggcacaagcatggcttactctcctgagcctcgacttcctgggttcaggggatcctcccacctcagcctcttccaagtagctgggtctacatacacacgccaccattgcactccagcctaggcaacaagagcgaaactgtctg

SEQ ID NO: 242304 - DNA, 189 bp, Homo sapiens
tgaattaaactacattaaaataaaaaaatttctattcattaaaagaggtttcaaagaaaactaaaaaaaaagtaagagatatttgccactgacagagcattttcttttctctctcttttttttttttttttttgagatggagtctcactctgtcacccaggctagagtgcagtggcatgctctcagctc

SEQ ID NO: 242305 - DNA, 618 bp, Homo sapiens
aagggatccagtttcagctttctacatatggctagccagttttcccagcaccatttattaaatagggaatcctttccccattgcttgttttttcagtagagatggggtttcaccatgttagccaggatgatcttgatctcctgacctcgtgatccgcccacctcagcctcccaaagtgctgggattacaggcgtgagcaactgcgcccggccccaaaatatctttatatagaacaaaagttttctgagtctttatctctgttattcagattctgtctaaaagagattaatagttcagaagaatgaattgtgttgggattttacctattatctttgtatctcttttcttagataagattcactgattgtaaatttcaattaaatatagtttatgtgtctgaatgaaattgatgaccagaatcttgccagtgtaggaaaagttgatttcctacactgctttcttctgctgcttacctttctgctactcatcagtatctgatcaggggatagaaacatgacgtatatcagacttgtttggagctccaacaaaatctgaagggagaggaaattaaaaatgtggctgagtatttcatgttatgacacttttggttcctatatt

SEQ ID NO: 242306 - DNA, 451 bp, Homo sapiens
gtaagaacgtgcttgtggaagacaagtctgtggcttggtgagtatgcgtggtcagcagtctccaatatgtgcagggtattaatgtgtcatcagggctgagtgttctgggatttctctagaggctggcaagggctcctgaaccagttgtttctgtcctgccggtctgtcagagttggaaagtccaagccataggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaa

SEQ ID NO: 242307 - DNA, 577 bp, Homo sapiens
  misc_feature (480)..(480): n is a, c, g, or t
  misc_feature (518)..(518): n is a, c, g, or t
  misc_feature (523)..(523): n is a, c, g, or t
  misc_feature (535)..(535): n is a, c, g, or t
  misc_feature (571)..(571): n is a, c, g, or t
gtaagaacgtgcttgtggaagacaagtctgtggcttggtgagtatgcgtggtcagcagtctccaatatgtgcagggtattaatgtgtcatcagggctgagtgttctgggatttctctagaggctggcaagggctcctgaaccagttgtttctgtcctgccggtctgtcagagttggaaagtccaagccataggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaaaaaaaaaaaaaaaaaaaaaaaaaaanaaaaaaaaaaaaaaaaaaaaaaaaaaaaaaaaaaaaanaaaanaaaaaaaaaaanaaaaaaaaaaaaaaaaaaaaaaaaaaaaaaaaaaanaaaaac

SEQ ID NO: 242308 - DNA, 407 bp, Homo sapiens
ggttccagtaggaaaatgggatcaagcgggactggaggttctttaaactacagcgaatgcattttgcatagtgaacctaatggatggaagagaatgttggggaagcctgcaaacccccaagccctagggtgtcctaaaagacaaatcagattgcagtaaaaagtataggtgatgaggtcaggagtttgagaccagcgtggccaacatgacgaaaccccgtctctactaaaaatgcaaaaaaatttagctgggcatggaggcgggcacagtcatggacacctgtaatcccagctacttgagaggctgaggcaggagaatctcttgaacccaggaggtggaggttgcagtgagccgagattgcgccattgcactccagcctgggcaacaagggtgaaactccgtctcca

SEQ ID NO: 242309 - DNA, 467 bp, Homo sapiens
gcctggatcaatcttggctactcaggtttctgacggagggtttctgtcacttgatcatcacatcagctaagggttaaatagtgtatataaagtaagacaaaacaaaacaaagcaaaatttaaaaacccacatcacattcgttttggacctctgcaagatctgcacttttcatacacgtttagatctctgataggaaaatggtgccctcttggtctgccctgattaaatgtaattggctgcagacatctgtggcacacagatgtcctgcctgcactcgggaagggagagtgacactctgggagggtgggagagctctcaggggaacttttcccctttctttatctaaaatgaagttccctgactccctccttccaactgtggactccagaaacagaaatgaaatggcagttaaaggagccacacagacgcctccctgcatgtgcactgagggaaaaattaaaagatga

SEQ ID NO: 242310 - DNA, 333 bp, Homo sapiens
gggtccccttctcaaatcggactattgcaaaaagcaggcagaaaggaggcaggcgtccttgttgctcccgcctgcaattcactgcgatgagtttggcacctacattgctgtgctaaacctaaggcatttttgacctaaaaaattgaaatgtttgagcatcgtgaaagaactctttggaagcagtcctgctttctccctctttgccttaacttggcagtttttctcacctacagacaatcgttgccttgtaaagacccttgaagaaatctaacacatcctccctggggtacaccttttccaagcaaaaactgcattaaatcttttcatggtggg

SEQ ID NO: 242311 - DNA, 411 bp, Homo sapiens
gtcatagtcgatgaagaaaaattattttgaagaagacaaattaataggctgtggcttggaagaaagaggacttaagagtatttgaagatgaggaacacatagcaaacagacaacagaaaagggagtgagtttgaaaggaagggtagatgcctaaaggactcccttttcccaaggtattaagggactagacttctcttccagttcaatgaattacaagagtggttctaatttacactgtaaaaattattaaagaccccaaagagcttttgcttatgtggattatatctattggtatttaccatattcaaaattaaaactgagaaaatttactttattcatttaaaatggcaattaaaggccagaggcacagtggctcacaactgtaatcccagccccttgggaggccgaggc

SEQ ID NO: 242312 - DNA, 238 bp, Homo sapiens
agacatgggcaaagtgcaaataagaaattgagagagataatagaaggtacagctatgctctttgcacctggccagatatgggtagaagtggaccaggggctacctggctgtgcaaattctctccatgagccatgcagccgtgctccagactccattccccacccatgggaggtccctgtggcaatcactgaaaattttcctgaaacagccatttccccagaatgcaatctactgggca

SEQ ID NO: 242313 - DNA, 303 bp, Homo sapiens
ataactcaaggctttagtctggtgttccaacattagtcattttgttggatgttctctcagacattctatatagataggaatagcaatactgatggataataactttatagtttatggcacccagaattattcttataattgtaatactccccattttagaagtaatgttaatcattttatttattatataagcagtaacatgtatttattttaaacatttagataagtcttattttcttaaataataattctgtccttagtttattattgcttaaaatccaaaataaatgtaggtgaaaaacc

SEQ ID NO: 242314 - DNA, 455 bp, Homo sapiens
caccagcatcttcatggccctcacatggctcatgtgcatatcctaactctgatactaagggaggagaccacccctcatattgtcttatgcccaatttctgcctccaaagaaagaagaagtaaaaactaaaaggcagaaatgaaatccacaagcagacagcccggcgccacaccctgggcctggtagttaaagatcgacccctgacctaatcggttatttgcataagaaaagcactgtgaagatccctgtcctgttctgttccattctaattaccggtgtatgcagcccccagtcatgtacccctgcttgctcaatcgatcacgaccctctcacgtggacccccttagagttgtgggcccttaaaagggacaggaattgctcactcggggagcttggttgttggagatgtgagtcttgctaaagctcccagccgaataaagcccttccttcttaac

SEQ ID NO: 242315 - DNA, 429 bp, Homo sapiens
aaaaaaaaaaaagtacataatttgactatatctctctagtgggatagtacctaaggattaaaaaatattacaaagaaatctcactgggagtagtcatggtgttaataatacttttgatttgttattttggaaggtagatattaatattgttagaaactaatatgtataaaatcaaagaagttaaacaaaaccccttgatttctaaacttgaattagatcagagaatagaggaacatgttacttgacaccatggaaatgcagtcagcgaagtctggaatgtggggaaataaatggcaagagaaaaataaatggcaatagaaaaaaaaggttgaggagcagaacctgtaaataaacctttagagacatatcaaccaaaagcaagggtagaccttgtttaggtcctgatacaaacaaaacccactgcattta

SEQ ID NO: 242316 - DNA, 723 bp, Homo sapiens
taaaaaaaaaaaaaaaaaaaaaaaagttaataaaaaattttaaaaagagcagaggtgagattcaaatgtagatttcaccactttctagctgtgtgatcttgggcaatttacatgacttctctgaccctgtttatctgtaaaatgtttcaaggatcaaatgatatcacatgtttgaaaaacttgtcacaaagtactcaggacatgttaataaggatcacaggccgggtgtggtgactcacacttgtaatcccaacactttgggaggctgtggcaggattgcttgagacccggagattgagatcagcctgggcaatataggaagaccctgtctctacaaaaaaaaattaaaaattagctgggtgtggtggagtgtgcctttggtcccaggtactcaggatgttgaggctgaaagattgcttgagtctgggagattgaggctgcagtgagccatgattgtgccactgtactccagcctgggtgatagaacaagaccctgtctcaaaaaaataattaaggatcacaaatgagcatttccttgccaccactgagtataatgccctgtataatgctgagtataatgctgaactcctagaacaaagaagtaaatcagatgcagtcccttcccccatggggagacagacttgcaaacagctagcacctgagtcagattgtgaattgtgccaccatagaggtctcagccaagtgtggaaggtgcactctccc

SEQ ID NO: 242317 - DNA, 541 bp, Homo sapiens
accacttcgagctcgctaccccacaccacctgagtcaggccgggtgtggtgactcacacttgtaatcccaacactttgggaggctgtggcaggattgcttgagacccggagattgagatcagcctgggcaatataggaagaccctgtctctacaaaaaaaaattaaaaattagctgggtgtggtggagtgtgcctttggtcccaggtactcaggatgttgaggctgaaagattgcttgagtctgggagattgaggctgcagtgagccatgattgtgccactgtactccagcctgggtgatagaacaagaccctgtctcaaaaaaataattaaggatcacaaatgagcatttccttgccaccactgagtataatgccctgtataatgctgagtataatgctgaactcctagaacaaagaagtaaatcagatgcagtcccttcccccatggggagacagacttgcaaacagctagcacctgagtcagattgtgaattgtgccaccatagaggtctcagccaagtgtggaaggtgcactctccc

SEQ ID NO: 242318 - DNA, 496 bp, Homo sapiens
taaaaaaaaaaaaaaaaaaaaaaaagttaataaaaaattttaaaaagagcagaggtgagattcaaatgtagatttcaccactttctagctgtgtgatcttgggcaatttacatgacttctctgaccctgtttatctgtaaaatgtttcaaggatcaaatgatatcacatgtttgaaaaacttgtcacaaagtactcaggacatgttaataaggatcacaggccgggtgtggtgactcacacttgtaatcccaacactttgggaggctggtcttgaatcctgaccttctgacctcagatgatccacctgcctcgggtcctggtgatagcacactagttcagaacaagggcagggctgtatgctgtggctcacatctgtaatcccagagcctttgggggccgaggcacgaggatctcttgagcccaggggttggggctgcagtgagctatgattgcaccactgtactctagcctgtgtgacagtgagaccctgtctct

SEQ ID NO: 242319 - DNA, 528 bp, Homo sapiens
agataattaagtgttccttttccagaagaaaaaatgaaactttctcccacaattagaaccattttgtaagccacatctttgtgtttgcagaactccctaaaaatgtgaaaaagttcatgcatcccagcaggtgagaagtttatttcttttccctgacaggaatattaatcactattattatcagctcagtaagtccttgacctcatagggagatgtgtgcagctgctggctttggagagggaaatgtatgttggagcaaagtgttgatatccactgctttactgcctaataaggaaagccagcacctgtccagaaggtagaattccaggattccagatgaggcagccatggtacctaaaatgtccatcattagaattattccttggggtttaatacagtctttagaaatgccctactaaaatggagatgttgtcaaatgctacattagcacagatatctttaaaaactggtgcatgattatgacggataccaagggaataggatctgggatcacagacaaaaaaaaaa

SEQ ID NO: 242320 - DNA, 384 bp, Homo sapiens
catttcatggaatgtagcccactttgggcatagctggatacagagctttgagctacgtcaaagaacacagcctgttcctctctgtctgcctatgtctctcactctttctctgtgtctgcccaccccccacacaacccccacgcccctgcttcctctgttttcctcagtgttggcttcattccaaagcaggatgtcccctcgctcccagtaaagacagttgctggccagtccaggctgatattctacccactcagcaacaccaaacactggagagtgtctctttgcccataacagtaaaaaaattgcaggaagggctgctattggtctggcttgggtcatgtgcccaagcctgaaccaatatagcagccaggggtatcctgagct

SEQ ID NO: 242321 - DNA, 283 bp, Homo sapiens
gaatgcagagaatactttccattggtttgagccaccacgtttgtggtagctcattccagcagcactagggcactccctctgaaatttatctaggagatgaaagatccacaagtatctaaaacacgctaccaaatatacagctaagaagagtgccgtgctggaacaagaacagtcaaccagggcatggaccagaatagagacactggaggcagacgtctatattcacgagcattcagcactgactgtctagtatttggtgttgagaaagtgactcagaaaatga

SEQ ID NO: 242322 - DNA, 384 bp, Homo sapiens
aacagtgggccatgggagcccagtagaaaagccagaaacagacctatttgtctatgggattgttgcaaagttggtgttgccgacattggtgaaaagatgattgttatgggctgaatgtctgtgtcttctaaaccaaaaaatatctaagacaggtctcaaccgatttagaaattttgccaaggttaagaatgtgccagggagacaggtctgtgcctttttccaaagatggttttgagggcttcagtatttaaaggggaaaagcaggctggaggggataggagggtatggtctcactactgaatccacttgttccaagacaaaaggagcagggaggggaatggccaattcggtgcttgtccaggcttagtacatctgctctttatg

SEQ ID NO: 242323 - DNA, 579 bp, Homo sapiens
agatgcgaccaagtgaattctcaatgttttttcagctgtatcctctgctgattcttgattcttcaaatccccagtgatttgccactggtattcttgttctcatcccattattcatgtattcagcaaatatgactgagaatctattggtacaagcactgtgccatgttctagaaaagaaccaaaaatgatatggttcctgacccattaaagttgtcttttctttattttcccttttctgaattttccctgagaacacttggtatacattaggagatgtacaaaggaatataaataagaaggaggaaggactcaaattcacttgtaggagaaatattgtgaataagtgaatacagtccagcaatgagaggagggttggaggggaaacagagtcaacatggagttcacgttatgacaggattatgaattgctattttccttttcttttaaaagtttttaaaaaatgtatacttccttttttgtggtaaagtcttgctctttcacccaggcagaggttgcagtgagctgagattgtgccactgcactcccgcctgggcaacagagtgagacccctactcaaaa

SEQ ID NO: 242324 - DNA, 1667 bp, Homo sapiens
  misc_feature (1166)..(1166): n is a, c, g, or t
ctaataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttggttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatgtgtttctgaatcctctgcttcgagggaaaaatcatattagtagaggataagtttactcagtactggaaaaattgtgtagattttaggaacttgtnggagcagaaaggcgattaattgtgagaaatgaaagtcaattttagtggcagcaggtatatcaagtacatcaagtcttagttcaatgtttatagattttgaaaatttataggttcattattcctttcatttgtttcttcttttgtcccatttttgtcaagcatgtatttattttgtttgaatccttttttgtctcatggactgagaagaaaatataactaaggttggattatcccacaatttgctctgtgtctaattattctgaggtggattgtaatgaagccagcaagacttatacattggaattttaaatgtatgggattgtaaggagggtagaagctacaaaccaaagataagatatgcctgcagatctgcttcagatttcctgagggcagtagatgaaattatttctaagggcctttttcaccactgctctttaagtatatgagtaataaacaaaaagaacaaagtatgtggttcagaaggaataaaacaaaaaaaaa

SEQ ID NO: 242325 - DNA, 435 bp, Homo sapiens
gaaggtttgcatttgttgtggggactgaaaatcatgcattgtgcaaaatgagaagatgagtgtggcggcgggggcaccatggagactgtcacctactcggattggggccttagcatacaaaacccacccgacggacatcagggattagctgttctgcttcgagcttctcaatttctccacatgctttgcgcccagacccactgagcagccagactcaaccagattccccaggtctgggcccccacagggagggcaggtcccctaaggctgttacacgtgagtaccaagcagatggagcccagaagatgggaaggagtgggacgaagtcaaatgccagccccaccctcacaacctcagtccccttctctgtaagacaagtgactagagggaaagccacagggcccacctctacttgcggactaaactcctgatgtg

SEQ ID NO: 242326 - DNA, 317 bp, Homo sapiens
gcgcgagctcgccaaaggggttcctgcaccgccttcagcagccagctggcttcgcccctcccccggaagtgtccgcacctcctagagcccagcgagcgagcgtttgtgcttttgtcctttgaaccgggtgtggtttggatttcggagctggagctttggaatcaaacctagcttccaaacgattgtgtacccgtgaccttgggcttgttacgcgcgatgtctcggaccctcctttatcttttctgtaaaagggggagagtagttcctaccttccagagttgtcttgagaattatatgagaatacgtacataaagcac

SEQ ID NO: 242327 - DNA, 498 bp, Homo sapiens
cccttagaataatgtctagcacgtcgtaaacgatgaatagatattagctttaaaaatgatacttgttattctgtgtgctagatatctagggaagtgaaggaaggacggcaagggaggcagagatgaataaggcagtgactaggccccatgggagggagatcgcggtaccacagctgaatggattgtctcccctacattgccattcagctaagagacattcagcaatttattgaataagcacttcttgagcccctagtgcatgcatcagacactgcgttagggctgggtgcacagcagtgaataagacagacgtagttcttgctctcgagtgctcatggtccaatgagggagacagagggtgactgggaacaacagtccagtgtgataatgctagcatagcagcagaacaggggctgcacaaacacaaagaaggaacatctaactcccaaatgaaaagaggggcattgacaaagtcctcctagggaaaaagaaaactga

SEQ ID NO: 242328 - DNA, 521 bp, Homo sapiens
tcattcctaactttgtagttgggacagacctctgattaacaagagaaaaacaagcaagtttactaaggcatgcagcccacagcacgtgggagaaacctcagtgaaactcaaagcgcagtggcttagaagtctggctcatcttcaacaatacatttgtggagaaatgacaggacaatggaaagcaattttaggtgtccgaaggcgagaaaccgtgggaagataaatatatgggaagaaactagtggagtacatgtgtttgcacattcttctgctgacatccctgagctggtaagaatggtctccggtaaaagagaatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattg

SEQ ID NO: 242329 - DNA, 490 bp, Homo sapiens
taagacacagagtcttgctctgtctcccaggctggactgcagtggcgtggtcatggctaactgccgccgagggagtttgaggctgcagtaagccgagatcacaccactgcactccggcctgtctcaaaaaacaacaaaaaaagctcctcctttcctgcttgggggagggtggctggcaggccctaagcctgtggaggtgcagggtgcactggggggctgtgtgcacccaccctgagaaccacttggtctctttgcagaaggaagcgggtcctctgtaagatggggctgcatccctgccccgctcccagcagcatggggtcaggtgagtgaccagcgtggcagtgttgtcaagggcaatgtgaggaacaccccttgccttggagtgtcctgcgagtgcgcttttggtcagcagtggccatttagctgagaacttggagacaaggcctcaagatgcatctctcagaagtctatgtggtcacctttgtttttt

SEQ ID NO: 242330 - DNA, 628 bp, Homo sapiens
attttgcagagatgggggggtctccctgtgtcatccaggctggtctcgatctcctggactcaagccatcctcctgtctctgcctcccaaagtgctaggattacaggcaggagccaccacgcccagcccgtcatcttctaatttaacagaaagaggaagtgagtccctggtcactcctgaaccagtcagagaaaccctggtctgtgggtgtccctgagtctattactggaaccatcacttcagcagtatggtcttacagatggggaaactgagggctgaagggggaggcatccagcccaggctgcacaagtaggtggcaaacccacaaccagaagccacgggcaagcagcatgaggacagtacccatagccaggtgcgggtactgtgaaggcaggtgctgtttcatccccattttacagatgcaaaaactgaggctcaggggagtgaagtgacccatccaaggtcccacagcttgtccgtggcagagctgggtttcaaccccagggagaaaccaatgcagtgctgcacatccaatcactattgagtgcttctccttcgtccgtaacgttcagcacggagaacagtgcctggcacatagtaggtgcttaataaaacgtgctgaatgaatc

SEQ ID NO: 242331 - DNA, 209 bp, Homo sapiens
tctcttcagtctgcgcctcatccccctcatcccaaatgggattatataggacccccatgttgggtttcagggagaaaccaatgcagtgctgcacatccaatcactattgagtgcttctccttcgtccgtaacgttcagcacggagaacagtgcctggcacatagtaggtgcttaataaaacgtgctgaatgaatcgtcgccagtgtgca

SEQ ID NO: 242332 - DNA, 325 bp, Homo sapiens
ctcggaggcccagagcggggagcagcgggcctgcaaccagggaaccctgaaaggaagcgggtcctctgtaagatggggctgcatccctgccccgctcccagcagcatggggtcagatgcaaaaactgaggctcaggggagtgaagtgacccatccaaggtcccacagcttgtccgtggcagagctgggtttcaaccccagggagaaaccaatgcagtgctgcacatccaatcactattgagtgcttctccttcgtccgtaacgttcagcacggagaacagtgcctggcacatagtaggtgcttaataaaacgtgctgaatgaatc

SEQ ID NO: 242333 - DNA, 375 bp, Homo sapiens
tttttaaaatttgaaattatttattctctgtgtctgagaaatattttgagaggcaagagcatttgttcttgtgactcttacaagatacagtggctggccgggcacggtggctcacgcctgtaatcccagcactttaggaggccgaggcagatggatcacgaggtcaggagttcaagaccagcctggccaagatgatgaaaccccatctctactaaaaatacaaaaattagctgggcatggtggcagatgcctgtaatcccagctactcagaaggctgaggcagagaattgcttgaagctgggaggcggaggttgcagtgagccgagatcgcaccactgcactccagcctgagtgacagagcaagactccatctca

SEQ ID NO: 242334 - DNA, 142 bp, Homo sapiens
cagtcaacgaggaaagggttagctaagcaaatgaatagcaaaagtgagagaacagtgctgcagctacttaaaagtacaagctgtttcaagtactctgtgatttagaagagaaataaactctggttataaattatttttacca

SEQ ID NO: 242335 - DNA, 244 bp, Homo sapiens
gatatatcaaggccaaaaaatatataccaacagtagtgtttcacttttgagtctcatccaggaacttaactgtgcatcagtgaagtggcactcaaataaagaaaggtggaaccatcaatgccattatgaaacacgatcataaaaggtgcttcccagtagtatctatcttggtaactctgatgcaaaatctttcactatcttagtgccacgggacagggctgcaaatttagagtaattccttagc

SEQ ID NO: 242336 - DNA, 668 bp, Homo sapiens
tgtgttcgtgtgtgtttgtgtatgtgcatgaatgggtgtgtgtggtgtgtgtttgtgtctggtatgtgcttgaacaggtgtgattgtgtttgtgtgtcaccttctgggagagggagcataaattgacagtggagaaacctggtgaacactgcctcagccaggtgttcaagtcagcattaaccctggtaaatcatgttgacagtgcgtagccccgatgtgatatgatatgataagaatagcactttacccctgtggtctctttccaaaactcataataataatgagaaaagcatgagacaaattccagtagaggggcactctacaaaatgcctgaccagtactcctcaaaaccatcaaggtcatcagagacaaggaaagtgtgagaaaccgtcgcagccaaaagaagccgaaggagacgtaacaaccgaatgtaatcctggatgggatcctggagcagaaaaaggggttcagttaaaactaagggaatcagaatgaactgtgaactttagtgaattaaatcatatatgtcagtactggttcattaattgtaaccactgttcatgtaaaagatgttaaaaatagagaaaactgggtttcagagtacttgggaactctctactattcaatttttctgtaaatcttaaactgtttttaaaaaggaatttcta

SEQ ID NO: 242337 - DNA, 408 bp, Homo sapiens
gatataatttcataattttatcataatttattatttccattgggattttttttctgtgagctattggcttttaaaagttatttcttaattactacatagagggcttttctaactatctttgttattgatgtctagtttaactattactgtggccaaagaacatatttcacattattacaactcttcaaatatgttgagacttgctttatggtccaatttctagttaatttaggtaaatgttttaaatgcttttataaataatgtatatttttaagttattgaatttagtcgtctacatagctcacttaggtaaattttgttaatcagcttgttcatatcttttatacccttactgaagttttatttggtttgttcattttatacgttaataagagaagcgtttaaaat

SEQ ID NO: 242338 - DNA, 534 bp, Homo sapiens
ggagtagggtaggcagttgcatgtgtgtctctgtgtctcccctctatgccagctgcagacatcaccaatgaattgggctactcttcgccgtggaccctggatgcagccagtaccaaccagtccaagcttacatgcacaggaggacactagttcaccgtctttgtttttgagtaactcaaattcttgcacatacctcagcttctttttggaaaatccaaatatgactttcctgtatgacaagatgctatagggcatttctcctttagcgaaccaaagaagtcttccctggctttctaaaggcgatcacttaacgtttactgccctcattccttttctatcgacaaaccttgtatttcagcacaaactgtaattctcctctccacagtaagttattggtgtctcgggaactcgacagacccagtcaacattaaaattgctcctagattggcttttagctctgcttcctaacttgattccgatctggattacaccaggcctggaactctccatgatttattctcaaccagcaatcaa

SEQ ID NO: 242339 - DNA, 807 bp, Homo sapiens
ggagacaggggtggaattcgtcttctgggaggaagctggagagagcacagtgaaattgaaatacccattcccagatagtcaaaaacatgaactttcccccagcctgcaccagtattgttttcaaacattgcccatgagtaggccctttgaagagttagcttcctcctcatctttgactataaaattgtttaatcaatggaatttgtaccagccttttaaaaagttttagtttttcctaagtgattttgctctcttccaatctaaacctgttgcttgtttggttcagagaactacaaactgtcaaagaaagggtggggatgataagaaatgctaatataaaaatgctaagtgaaaaaaagacttggccaggagaaataatttaaaatgcacatttgctttggatgcactgttgttctgttaaggctgtatatatttgtttatttaaggtgactgaaagtgcaaagaggaaatggacagcatgcaattcatcctaatgtacaaaacgttatatgcactcaaatgttataatttctaatatttttaaagtttatattcgagttgtacaaagttaagcattaatcagatatttcattttttcataatgttaccattttcttaaatattattacaaaattttaagtctgtctaatggagagttttttttaaactgtctacctcatataatacaagtatttacaacgctaaagttaccagaggtcaatgaataatcaaaacattttttacagtacacctttcctggatgatatgcaatcgaatgctatattattaaacgcatttttctcctta

SEQ ID NO: 242340 - DNA, 909 bp, Homo sapiens
gctatgagtaagaaaaactttttaaaattactcattacagtagcaaacaagacacaaagtaaactcctgtactgaagttgagatcctccaaattaatgccaccaaaactataccacaggggttaagggaaaaaagagttaattcatgcacaaataatcacagattcacatccaatacaaggtaataatgaagacatggattaaggggaataatggtagtttgcgtagtagtttattctattcaattaataccttggtgatcacagaatgtatggcactgtgttaaaaataactgaaagagaaggagaagtattgaactatattcaaacaaatcagagcattttaaatctaaccgtaagtaggttctaaaagtataaacatataatgaatgattcaattaaatcttaaaaagcctagctaaccaatatggcagatctagtaacaaatattccaagataatgctatgtagagtaactacttaattgctgttattttctacttagaattctcaacacagaacctaagatacagtcatgactatttttctcagtctttttcattcataaaatctcagccttcctcagggagattctgatagcccattcatgttctccatcaccacctggagttatgccccagtaccttttgcttaaggctaatataaaagattttgtagtgaagatggtttgtccctgtttgaaattgatattatgaaaacaacatggttatttttccattttccaagtataaaactactttatattgaacatctctttttaaatcagacatgtctctctagagatcccgatggcctctacattcttactgatataaagcatatagtcaaggtgaaaataaataattgtttattgatgttaatcaataaagctatcaataccccataaaccta

SEQ ID NO: 242341 - DNA, 387 bp, Homo sapiens
agtgtgaggcaggagaatgcctgtcaggagctgtcattcatcctccccaaaaggaaccccttagggccactcttgggttcccagaaccttcactgcagactgactctttcccccagcttatttggtcctgtgtttcccaccagcactcggagtgctgtgcagaaggcatccaaggctgacactctggggacctgaagacagcagcctcaggattctcccatctggcctttttttgtgcctttccaacctctgtaaacacagctggaagccccatcccatctttaagaaatgatctgaaagatcttttaatcttacgacatcttactttccgtcttgaaaaccgtccactaggcaggaatagtgggggtgttgataaatggagctagc

SEQ ID NO: 242342 - DNA, 513 bp, Homo sapiens
atttgttgactgattggctaagagagttcaagaggaatagaggtctaggatgactttctctcatttgaatggatggatttgtcattactgtggcacctaaggctttgctgcttataccactgcattttttactaaaaatgaaaaaatcaggccaggcctggtggctcatatctgtaatcccaacactttgggaggctgaggcaggagaattgcttgagctcagtgtcaggcttctgagcccaagctaagccatcatatcccctgtgacctgcacctacacatccagatggcctgaagcaactgaagatccacaaaagaagtgaaaatagccttaactgatgacattccaccattttgatttgtttctgccccaccctaactgatcaatgtactttgtaatctcccccacccttaagaaggttctttgtaattctccccatccttgagaatgtactttgtgagttctaccccctgcctgcaaaacattgctcctaactccaccacctatcccaa

SEQ ID NO: 242343 - DNA, 445 bp, Homo sapiens
ctcaggagttttaattaaaaaggacagctttttaattcccttctcttccagttctctaaataatgtatttctgacattaagtgtattaggaccagactggtgtcttctggcagtagaatggtagacaaaaaaaaatgtgttttcaagctggagacctgaggctgggcatggtggctcacgcctgtaaaaccagtgctttgggagaccaaggagggaggattgcttgagcccaggagttcaagaccagcctggggaacatagtgagactgtgtctctacaaaaaaatttaaaaattagccaggtgtggtggtgcacacctttggtcccaactatttgggagactgaggtgggaggagcacttgagcccaggaggtcgaggctgcagtgagccatgaccatgccactgcactccagcctgggcaacaatgtgaaactgtgtctctga

SEQ ID NO: 242344 - DNA, 356 bp, Homo sapiens
tgcatatggcatttattttcatatcatgataagcattctcatgtttgcacttaattttccttatttctatttttcttagatttgttgatgttgtgtggcatattaaaagtaggaaggactgtataaactcatgtattatttttaaattgtttttctgaatgtactcaagtacttttttatgtgaatatgaacacggaataaaagtactaaaaccagttaattatgagagactaagaatgtggaaaggaacattccggagtatattagtagctaaagaaatgccttggatcttaaatttcaacttctaaaattattaaaatacaaatattaaaaagatatagaggccactgctaaag

SEQ ID NO: 242345 - DNA, 180 bp, Homo sapiens
gcatgaagcatgtgacaaatagcaaaaacttattgcatgttattatctattgttattttatattccttattataccaggaacgtgggcacgccaaaatgattttttgaagatgctaatgtagatctgaagtctaaatgacaggcatactcaagaggttttgagtgagcttaagattgaag

SEQ ID NO: 242346 - DNA, 449 bp, Homo sapiens
ctgttactactacatctcaggcaaattctcattttcataatgcatatcttcacaaatttcaaatttttcagtgtggaaattgcccagttttaccagatgttgctctgcttgatattggtgcaatttgctgggattcagattctggcattgctatttaataattgtgtgaccatggacaagttgattaaccttattgcatttcaattttttcatgtataaagtattaatatgttatataagtttattgtgaggattaaaggaattaataaatacaaagcacacatggcacatgatgctattttctgactgctattataagtacactactgtcagccgggcgcggtggctcacgcctgtaatcccagcactttgggaggctgagacaggcagatcacgaggtcaggagatcaagaccatcctggctaacacagtgaaagcccatctctact

SEQ ID NO: 242347 - DNA, 439 bp, Homo sapiens
tttgtgtttagatttgatagaaggatcacaggagcatctgtatcataagggacctgagccaatctattttggagaaacattctgagggaaagaccccacaggttatggaagaaaagcaacagacagaagatgggaaaaacaggtcacgtttataagaccagcttgaagaccatgccacactgaggagtttggtttttcgttaggcaaagaaactagctgttttttcttcaatgttcatcggaaaacttgcccagcagctgtgagtgactcttcagctttcgaatcattgtcttggaatcttctaaaccagtaagaccatacttattttattttaaacatggaatttaggagcaaaggactagacagtcctcaaagtaataaaataaaaaagaaagaaaaatcatattagaaataaagaatgccgcctccccaaccaatt

SEQ ID NO: 242348 - DNA, 590 bp, Homo sapiens
agactaacacaggtgaccaatgttgtcagggaagttgttcttgctacaatcttagccatctgtttgtctgaaaaacactacaattttagccatgtgcctgggatcaagttgatgatctggaatcactttggacctaacaaatcgcccctagtataacagaagcctctcctactgcatccctttaactagctgactatatattcaaatctcaaatgagtacattaaatgggcagcatccaaaacatctggaaccccaaatgcaagggggtcaaaaattgagttttaaaatattttatttttgataatcgccaaagtttatacttaggaatataaattttgtacatggtaaaaatattcagactatagaaaaagtggtctgaatcttcaaataatccttctctattctcactctgtttattgcgttgcttcctgttttagtgagaaaggtagcaggtgagaattccttaatctcccatcactaccactatacaacctgcatctgtgattaagtttcctttaacttctcctgagactgagtgacctgatcctgctcctacagaagtaaacccttccacctatcacaccccata

SEQ ID NO: 242349 - DNA, 234 bp, Homo sapiens
gggaaaagcttttacagaccgagtaagagaattaacatgcttaggacagcaatattataatgaaaacctaagaaaaactttgtggcgaggtaaaaatcgttccaaatcacctcatccaaatccattctcctgctttctcttctgtaaatcacacctggtatcagcctgaagctttttggatgtgaatccactgagctggtgagttccttaaataaacatcctcctgtattcccc

SEQ ID NO: 242350 - DNA, 110 bp, Homo sapiens
cgccattgtactccagcctgggcaacaagagtgaaactgtctcaaaaaaaagaaaaaaaaacagaattttgtgaaataaaggccacttgggagtatctgagccaccccac

SEQ ID NO: 242351 - DNA, 588 bp, Homo sapiens
ctttattttttacttttaaattaattaattttttcttagagattgggtcttgctatgttgcctaggctggtctcaaactactggactcaagcaaacctctcacctccacctctgaaagagctaggattacaggcatgagccactgcacttgaccctgaaaggccccatcatagatgttctttaatgaccattccagctatgacacatggtggatttttccccagccttctcctcctgcagagggttccctcagagctggtgagctcctgcgtgcctgccactgctctgttccctccgcatccccagaatgcatctcctggcagcctgtttcacaggtgtgcacacttaccttcatgaaagccctgaggttaaatgacttgctcaaagtcacacaactggctgccagagcaaggactttagcctgcacaacctggctgcaagtccagagttttccacaccaccatctgcctcctcagacagtgctcaagcagcacccaggcctcccagggagaatgccctccaccccactggcctgcaggccattaggctccctgcaggagcagagctcttcctcttgtcttctgcatc

SEQ ID NO: 242352 - DNA, 4055 bp, Homo sapiens
  misc_feature (4047)..(4054): n is a, c, g, or t
aaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacacgttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcgctacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242353 - DNA, 1754 bp, Homo sapiens
  misc_feature (1746)..(1753): n is a, c, g, or t
gaccccagattcccagccgacttgtagattaagctcctgagccgattctttatagcgccccggatctccccttatttttgcccgtttttcccctcccaggctcccccaaacttttttttttttttttttttaaagaaagaaatgcagcctcagggaagggggaatggaattttcctttatgtcgctgggagcacagggggcagcccacaaagggggctgggaaacaagtgggatctgtacagacagcaaggtgtgggtgaacgttctggcaaggaatgcttaaccaacaggacatgggtttcagcctgcacagctttgcctatgcttacaaactgccctctttttcagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggcaggatctttgaaactgctcccaagcgagaggaagggggaggatctagaactgaggagggggtcacagggactggcggcagtacaggggaacttgctggtgaggtacactctgccccagccttgggcttgggtatcagaaacactggggtatggcccgcaggctggtcagcaggtcctcagacgtggcagctgcaggcttcgggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242354 - DNA, 3135 bp, Homo sapiens
  misc_feature (3127)..(3134): n is a, c, g, or t
ccccacagtggatgagcagacccagggttgcagtcctgggagcttccagaatggacgaatgttgtaaatgagtctgggtggaggccaagcagaaggtttcggtcagggctcccaggggaggacagagtatcgccagaggggtgtaaaccctgctgcaaagatgagcctgatcacccaaggaaagagcaggtgcatctcccagaagggcccacgtcacaggccagggaggaggaacagacaaggagaggtgcagtgctcttccagggaccagaagggagggttcaaggtggcggcctggcctggggctggggtgaaaggtggtctgtacttgtgttcctctcccctggtcactgggaggcccactaaccctttcctccaccaaccgccaggtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcgctacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242355 - DNA, 870 bp, Homo sapiens
  misc_feature (862)..(869): n is a, c, g, or t
tatatgcacagatgtataattatatgggggatgttcacatagggcagacattacacattaagaatcagggaactttactctgtaatttttagctggagttatgacttcctgccactgacattaaggctgacagatgaggctctgaaaatgccacagatttaaacggatggaacccgagggctttagctgagctgttccttgagcccagcgggacggggtagttacaacatgcaagcccataactacaaaggccttttgtttcagctgtggcagctggcctgaagccttttggggtagagcccatctctgcagagggcggggagtgtgaggaccccacccttcctgccagcccctccctcacttactggcagcacacctgaccctcagccatactgtccctgcaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242356 - DNA, 490 bp, Homo sapiens
cacctgctcatggcactgcccatctgctgtgtcattcacaccccttttgtttgtgtcgaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggtgcgccctgcagctggggctgggtgcctccctcaaggtggggctgcatctgggctccacagccaggcctgttgcccacacagccatcgggcagtgccagggccaccctcagagggcagacctggtccagcctgcagatggagctggaagagggggagccaggggcccccatcagtcctacacccattctccccaggagagggtatgagctgctccctcctccctgctcttcccctggtgcctccaggcactcacaacccaatcaaaacaaactggatggcctggcatg

SEQ ID NO: 242357 - DNA, 1550 bp, Homo sapiens
  misc_feature (1542)..(1549): n is a, c, g, or t
gaccccagattcccagccgacttgtagattaagctcctgagccgattctttatagcgccccggatctccccttatttttgcccgtttttcccctcccaggctcccccaaacttttttttttttttttttttaaagaaagaaatgcagcctcagggaagggggaatggaattttcctttatgtcgctgggagcacagggggcagcccacaaagggggctgggaaacaagtgggatctgtacagacagcaaggtgtgggtgaacgttctggcaaggaatgcttaaccaacaggacatgggtttcagcctgcacagctttgcctatgcttacaaactgccctctttttcagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242358 - DNA, 3318 bp, Homo sapiens
  misc_feature (3310)..(3317): n is a, c, g, or t
ccccacagtggatgagcagacccagggttgcagtcctgggagcttccagaatggacgaatgttgtaaatgagtctgggtggaggccaagcagaaggtttcggtcagggctcccaggggaggacagagtatcgccagaggggtgtaaaccctgctgcaaagatgagcctgatcacccaaggaaagagcaggtgcatctcccagaagggcccacgtcacaggccagggaggaggaacagacaaggagaggtgcagtgctcttccagggaccagaagggagggttcaaggtggcggcctggcctggggctggggtgaaaggtggtctgtacttgtgttcctctcccctggtcactgggaggcccactaaccctttcctccaccaaccgccaggtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcgctacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactcannnnnnnna

SEQ ID NO: 242359 - DNA, 480 bp, Homo sapiens
accaactcttggccgctgtggtggccaaagagcgcccagatctggaacagctgaaggtaatggcctgaagtttggtcacacgggaggaggtgccgtcccacacagagggggccaggtcactgtgagggtccccgaccagggctgccagtccagtgtgtgtcgttgcttctctctgaaggtgcctcagtgtgtcccacggcatcacagcttctcatacgacaggatggctcatttccttccccagctgtcccctcttcctgctcccaaatttaattctaagtcacatgacctctttgcttaaagaacatgagtcacagcggtcctcgggggctctaagctccaaagcgctgccctgcaagaatggcctggctgccagcccttgcacctgccacatttctggctgttatagccacttgcatgggctcaggaggcccaggcccgcctgtccccgttctgccccctacagtctccgtgacagga

SEQ ID NO: 242360 - DNA, 528 bp, Homo sapiens
tgtgaggtctcctgttcgcccatgtatctgtttcctgttggggctatgactggtacagaagggtgcacgcccactttcaagtgttgacgcctccaagaaggaagggaggaagatgaggcaagggtgtgacaggtgtccctcggcacagggcacagcaggtgctctaaagacatttcatcatacaaagatgcatgctggtaaagacggatgattgtcttagaggtccaagcttttactgtaggcctttgtagaattctcttgagaagggacagtgttttgtggtagtaaagacgaatatgctgttaaaggaagaaaaaatgactcctctggcagatggtaatggcaggaatcgtcaacatctttaacccacagagggctgctgtcatcctgtcacacaggtactcggggagaagcagagagctagccacagccagggctctgcccattaaggaaaaatggcttcagcaaaaagggaaggagatgtggggtgcagttctctcctcccccagtccacagggatgacttgca

SEQ ID NO: 242361 - DNA, 402 bp, Homo sapiens
gcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaa

SEQ ID NO: 242362 - DNA, 456 bp, Homo sapiens
tgagggccaacgtatataatcagagagcctgacgtcaggttgatactgaaaatatgagaactaaatggcattactaccagtctttagtttagaagatatagcatgtttgatgccttgtaaagaaggtatccaaggccacatgatactttgtaacatctgatgggactgtggtcacatgggagaagggaagggggctcttgagcacgtgcctgtggcccactgaagacagcatagccagctggagattgggcccacccacccttttagggctgtccggggctgacagttggctacttgggggtcagcatagcactgatgccagaactcacttgcctgaggttggattatctggttatagacttgtctgggcagagattgacttttgggcattatgaaaagtcagacatcagggctttttggacaaattctgcctcttaggtatatgtttgagttaaa

SEQ ID NO: 242363 - DNA, 604 bp, Homo sapiens
gtagaccagatggacctaatagacatttatagaacatacattaatctcatctgcacgtggaacattctccaaaattgaccatatgcttggccattaaagcaagtctcaatacattccaaaatactgaaatcagatcaagtatctttttggagcacagtggaataaaattagaaatcaaataccaagagggactcttaaaactattcaagtagatggaaactaaacaacatgctcctgaatgaactttgggtaaacatgcaattaaggcggaaattgaaaacaattttgaaataaatgaaaatggagacacagcatactaaaacctctgggatacagcaaagacagtgctaagaggaaagtttatagcgttaaatgcccacattaaaaagataggaagatctcaagctaccaccatacatcaaggaactagaaaaataacaaaccacacaaaaagctagcagaagaaaagagcaaagatcagagcagacctaaatgagataaaaaaatgatacaaaggataagtgaaacaaaaagttggttctttgaaaggatacacaaaattgacagcctgctagctaagttaaccaagaaaaaaaaaagtttt

SEQ ID NO: 242364 - DNA, 363 bp, Homo sapiens
gatttctcttatttccttcatgggcacaactgttaatttccacaaagacctgcagcattttattagcagagacaaaagataacaacttgtgtaatctctcagatcaatttgtcctttgttgggtgtgtattaaaacgtaggcttgataaagtaggaaattggtgtctgctccaaatataaaaatatcacaggggatgatgggcacaaccacaatatccacatcccaactttacaccttaactcttcttgacatttaaaaaactttttagaggagaaaaagtttaagggaattcaccacagagtaacagataaagggactccacagaataacagtaaaagtctcatgaaatcttgtagtaaaaa

SEQ ID NO: 242365 - DNA, 562 bp, Homo sapiens
ccttgctcccaccagcccggcgtctgcccagtaagagaagcagaggggtcctgcccaccatccttttccttccccttcatctatattattaccatcctttggggacttggatctggtgttaggccatgcagttgggcagtgggaaactcctccatcctcagtcttgcttaaagctggcttgtcccctgactcctccttatattcatggccttgtttctgtaccttgagtattgggggtaggacatgggcataggagtaggctaacctccccgatacactcataccttcagccctatcctccctggcttaactattggatatagagtaaaataagtggctggctgacaaggattttcatttcctacctgagagaagaatctagctttttactagaggccatcagtttcttgaaaagcccatgtgctatgttgggagtaagagcgcaaaacttaggcttatacagattgtgtattgcacagcttccagggacaccattcacctcatagtcattgtgtggatagttactatgatagttttctaataaatgtcagtcatcttgagg

SEQ ID NO: 242366 - DNA, 429 bp, Homo sapiens
tgaatgtttaaacaatgttagacttcatccgtcccccatctccaaatggcagttaatagcaggggttataacccccactccctgaacaagtatcaataagccagatggattgcctatttgttcactgttttaagtaccgcagaatatgcacattcgaacacaaatgttgtgagacagtggaaagaacctttaagttgatgacaggaaacagcaaacaagtcattttacctctctgagtctattctgccactgtgaaactagcccatgggtattgatgttgtaagttgaaaagaattatttgggtcaggtgcagtgtgcagtggctcatgactgtaatccctgcactttgggaggctgaggtgggaggttcacttgaggccaggagttcaagaccagcctgggaacacaataagactccattgccaccaa

SEQ ID NO: 242367 - DNA, 455 bp, Homo sapiens
gtcaagaataaatgaatacaaatgtgagacaatattctgatagatacagtactttcacagagtcttgtgtctgagagtatggaaaggccaatgaggagacagtgagctatcaaacatctgtcataaatatatatctaagtaacttttaagttgcctgatacttgaatacatcaagggaaagatagcattttagggtcaattaaacaaaagtatgtgtactgtaatagtttgacacaaagaagaatggatagagaaagaaaaacagtcaaagtggtaagctttatcaaaatagagtttttgaccttgtacggataaagaaagagagtttagaaatatgaattggcttacccatgcaagttaaaaaaataaataaattaggcagagagagtggaagaggaaaaatgaatacagacatctgtaacttttgtacatgaaaagcagcatgtacaatgaaa

SEQ ID NO: 242368 - DNA, 686 bp, Homo sapiens
ggctagccagcccttaatgtgtgtgcagatgagatcttactcaaactcattcacacagaagtacaggcatgtgtcacctaacaaccaggatacgacagggatacttccaagagatgtgttgtcaggcaatttcatcattgtgcagacatcatagagagcacggacgtaaatctaagtggcagaacctacagcacacctaggctatgtgggagagcctgggctcctgggctacaaacctgtgcagcatgtagcaactgcgacaccgtggaattatgtgtgtagctaatcatagaaagggtacagtaaaaatacggtataaaagatgttttaaaatgacacaggtgtatagagcacttcccgtgaatggagcttgcgggactggagtcgctgtgggagagtcagtgtgtggtgagtgtgagggcccagggcattactgtccactcgtatgtgactggcagtgtaataggtgtgttcacaccagcgtcaccacaaacgagtgataacgtgttgcactgtgacattacacgccgcaacctcactaggcaacgggaattttcagctgctttgtagtcttatgggaccaccgctggatatacagcctgtcattgacaaacttcgttatacaatgcatgactgtattctaaaataaatcactcaggccatagcaccactctcctccaatctgc

SEQ ID NO: 242369 - DNA, 268 bp, Homo sapiens
cagtactttcaatttcctgtggaaagctactttgtacctactttactgccatgctgtcatatttggggggattagtattcagcagatttacctggctacaataattagtagagggatggacacatcagccattgaaccactggggcatttgctaggatttctaggggaaaagactccatcttaaacttggttgaagtagacagtagctcttacaaccaacttgcccttcattgagcctgagataaagacaacattctaagagcaagtg

SEQ ID NO: 242370 - DNA, 441 bp, Homo sapiens
ctccggtgtcactattcactggaacagtgaacagtgcatgtgcatatgcctaaagccaggactggccagctgcatatgagttttactataaaagaaactgatttattgctgggtacagtggctcatgcctataatcccagcactttgggaggccgaggggcagcggggggaggtgggggggtggatcatgaggtcaggagttcgaaaccagcctgacccaacatggtgaaacccccctctactaaaaatacaaaaattagccgccagccatggtggcgagcacctgtaatcccagctacttgggaggctgaggcaggagaattgcttgaacctgggaggcggaggctgtggtgagccgagattgcactgctgcactccagcctgggtggcacagcgagacacagtctcaaaacaacaacaacaagaagaacaaaacacatt

SEQ ID NO: 242371 - DNA, 554 bp, Homo sapiens
aataattcaaccagaaaattgatatgagcaaacatgtcactgaagaggatgtacagatggcaaaaatgcatgtaaaaagatttcaacttcataaaccgttagggaaatgtgaattaagcaaccaatcagaatggttaaaatgtttaaaaaatagtaacaccaccaaatattggcaaggatataaaggaatcgaatcactcatgcattgctagtaaaaaatgtaaagaggtacagccacactgggaaaccttttcatggttttctaaaaactaagcatggagttaccatacatcccagcagttctactcatcagcatttatcccagagaaataaaaatttatgtttacactaaaacctatatatgaatgttcataatagcatttttcatagtagccaaaaattggaaccgtctcaggtgtcctaccatgggtgaatggttaaacaaactatggtgcatctatatctaccatgaagtagaactcagcaataaaaaggaatgaactattcatacaccttataacttggatgcatctccaggtaattgtgctgagtga

SEQ ID NO: 242372 - DNA, 786 bp, Homo sapiens
ctcaccttcaagttatttccctcctctagaatgctgtacttccaccactgccaaatcgtgaactttctctccttcaatatcccactgagaactcacccccaggatgggactctgctcaccccgtcctctactcaagcagaagcctctcagcgatcatagggcaaggcctgaacacaagcttctgttggtgtaaagtggaggcacaggctgcaggactgtctcagaagggaaataatatttaccttccaaactgagatctaaaacccgaacaaagcctcaggaaacatactccaccaccatcttacaagtttgtgctacgggtggagggaaaatgaatctaatgtaggaggcctcccgctgtgcgtctagcaggaaagaccatacggtgcaagtctccaggatcactagaggggtggattgttcatttcagtccaggtagcaacaggaagcccgtgcaaatgttcctctctcactgcggggctaaggagtgtgggtcctttcccgcgactacctgcttgcctctctcagaacctgcaagtgaagtgcggaagatctgtctatcttctcggcggcgcagagcccaaggtagaaaccgatggaggcggtgcactagataacatcaaagccccgggcaggggccagaaaggggggcacaggcagcccggggaatgaagcgcctccctctagcatttcctctcacgcccacttccaacctaggaggcttttggtttctgcttttttgtttttaaaattaaaagttaaacccaggaagctttggatcagact

SEQ ID NO: 242373 - DNA, 368 bp, Homo sapiens
cggcacgaggcttagtgtttcctgacttattacacatcagagaaggtgtggggtgggtgggtcttatctgaggatgtcaggggcgcagtggtgaggaaacagccaaatcctgcaagctgtcaggggctgtttcctggcatctgtaaggtatccagatgtgggggcaccctgcgttccccggcagctcatggcccctcatgcagcctcccccacccctcactgtcaccagttccgagagcttccattccacggctagaattgcatggcttgagttggttgaaacagtacacatacctgcaggcagaaggatttcacttttttgtttgtttgcttgttttttgagacagagtgagactccatctcacagg

SEQ ID NO: 242374 - DNA, 465 bp, Homo sapiens
ggggcaaaggaagctgcccatgccatgaataaatgctatcaaacacaatggcaatttacctcactgctttagcagttatcctcactggcttcctaccacttagaaagtccaaactgcttaacttgccatgtgaaaccctgtacagtcttatgctatcatttttccacttttccactcacacactcaatacttaagctacacaatttcacatgtacttatgtgcatctcaccatttctcacccatttatcttggcttcttatgttccctctgcctagaatgtcctttttaaaattcatttaatacgtttattgagtggctacagggtgccagccatcattctggacaatgaggatacagcaggaaggaggggaaacaaacaagggattccctgacttcactgagtgtaactgcctttatacccctttattaacagcagacattaaatacatgatttcagtaaaaca

SEQ ID NO: 242375 - DNA, 1005 bp, Homo sapiens
aagactctaggggttcacctgtaagagtcaagggttcccgtattccaaactaaggcaatggccaggtcagatcccaaacccttggcctcacccacacaccttctggtcttaccaacacttactgaggagagagtttccccttcctgaccggggatacacttcctttcaggtgttcttagtgcttcatttccagctttctcagcaaaaggcccttcacgccttccctctgcttttatctgaacctcctgaatctcccaactcaccttttctccttaatcaagaagcagcatatactaacctacctgtcccactttgcagaattactttataatgtacacgaagaaagtttggcaaggcagctagaaaatttaaaagcacaatgttgtaaagtaaagctacattctccaggtctcttagcataaaagcagaactattgtgcttcatatttggtaactccaggtcagcactctaaatacgtcatgccgccagaacattatttcataggttattgttttatacccccaaatggataccagattcattccagttctaccaagaaaacatgactgagatgccttggatctgtattgcttttcccttccttttgcaatatccacttgttcatttgttcattcaacaaacaccagagtagagatagtggtgaacaaccaccattgctgcatcacggagtttaagttctcatcttacactcaattgccagggccgtggtccctttacaaagtagacaactccagaactggggcttgggaagacatctttgaggtcagccagtcaaaccttttgtgttacagatttaaactgatgctgagaaagatgactggcttcttcccccaactagtaagttactgtggggagagtgcagagcacaggccccttccacctcttgtgtgctcttcaggagcccatctgtctcagccagaagacagaaacagagggaggccctgagaagtgacaaggacattggttggggtgggcaaaacactg

SEQ ID NO: 242376 - DNA, 415 bp, Homo sapiens
ctcccggcgcgcagggtgtggtccccgagaataagatgagcagaattaaagcagatcctgcacccactctgctgaaatccggcttctgaggcagcctcgcccagggctgggtgggctcaggcggctgctactcggttcaggggaggttacgcacggtggctgccgcgcgcaggggaggcttcgcttccgtactccttgggccgggagatccgatctttgttccctcaagactcacactctccaaccggtcattatcctcccacaaagatttatttctagaaaaaattggcaagtgccacagttcccgccccttcagctgaacgactgtgacagctccgtgtttcaagttgaatgcaggcgttatgtgccagagtcaatcattcaacaaataaagttcttaaaataacagctacca

SEQ ID NO: 242377 - DNA, 475 bp, Homo sapiens
tttttttttttcctgttttccatttgcttggtagatttttcaccatcccttcattttgagcctatgggtgtcattgcatgtgagatgggtttcttgaagacagcatactattgggtcttgctctttatcaagctggccactctgtgccttttaattgggtcatttagtccatttacatttaaggttagtattgatatgtgtggatttgatcctgtcattgtgttattagctgtctttgaaaaggtggacatttgctcatttatagttttccgggatttcttttgtcctcctttgtttgaaatctctgtcaatcataagtcctttccaattgagaacaatgttgcttcagagagaagatgggaacataataggagataagtagctttgctttctttttgccatgtattaataccaaatttttcttgcctaaaccaagagtccatctcttcacatcttgaatatagctaaaaatggc

SEQ ID NO: 242378 - DNA, 430 bp, Homo sapiens
atttattggctctcttatccttttctctgtctcttgacttttttttctattttatacatctttatttctctgttgggcaatttcttctcattaggtcaagtttttaaattctatcttcaatcatatctctcctattatttaacctgtgttgagtttttaattataacaattatattttaacttttagaattttgattttattctgtataaaacatctatccctttgtcatgctgtcctattcttatagtttctattttttcctttatccatctgaacattttaaatatacacgcttatctcaaactctctcttaaatgatcttattactttagggtgaaaagtcttccattccacaacttaaataatagaaattatgtatacatccacatatatgaaggggaaaaataatttttaaaaatcatggtgaat

SEQ ID NO: 242379 - DNA, 744 bp, Homo sapiens
tgtttcggtgtggtgagtgaaatggagaaggctaaactttttcttcccacatgctcacttccttgcttgttcgctagctgctgcatctggcccctcaagggtaaagtcaaggggaaaaggagattgagaggaaggacagtctgtgaattgtgcgagggatatttctgctgacaattcaacattcaaagggatgagtgtatgacgtctctaagagatgtcatggagtgcatgtagaagggactttttatggagaactacttctcaaatcactattcacatcctggtagaagtcaagcaatgaagatggcacagaaacacatcccaaatactatgataccataaagtatactgtagcaatgcattggcacaccctcatttgaacatttgtctcagaagattttgacagaagataaaattgtctggtttttatttcattggtttcatgaaaatttatttcactggtttcatgtcacaggcccatgactgtataaagagtcataatctttacaaacacaacaatgactcacagcgacatgttgcaaagctgtaatcgaaaacactgatgttgatttcagaggccattaatggtgttaagaaggcgcttttgttaaccaaataattgaatactcgtaattacttttcagttctagttcagttcttgacaccaaaacaagccattttctttacatagtgaatgcagaacttgccagtaagaactttcatactaaacttctatgtaaaaca

SEQ ID NO: 242380 - DNA, 835 bp, Homo sapiens
tgtttcggtgtggtgagtgaaatggagaaggctaaactttttcttcccacatgctcacttccttgcttgttcgctagctgctgcatctggcccctcaagggtaaagtcaaggggaaaaggagattgagaggaaggacagtctgtgaattgggtctcaccgtgtttcccaggctgaagtacagtgttgtgatatcagttcattgcaacttctgtcttctgagctcaagcaatcctcttgcctcagcctctcaagtagctgggactgactacaggcatgaaccaccacacctggctaattttttttgtatttttgtcgaaaagacagtttcgccatgttgtacagaactacttctcaaatcactattcacatcctggtagaagtcaagcaatgaagatggcacagaaacacatcccaaatactatgataccataaagtatactgtagcaatgcattggcacaccctcatttgaacatttgtctcagaagattttgacagaagataaaattgtctggtttttatttcattggtttcatgaaaatttatttcactggtttcatgtcacaggcccatgactgtataaagagtcataatctttacaaacacaacaatgactcacagcgacatgttgcaaagctgtaatcgaaaacactgatgttgatttcagaggccattaatggtgttaagaaggcgcttttgttaaccaaataattgaatactcgtaattacttttcagttctagttcagttcttgacaccaaaacaagccattttctttacatagtgaatgcagaacttgccagtaagaactttcatactaaacttctatgtaaaaca

SEQ ID NO: 242381 - DNA, 1333 bp, Homo sapiens
tctctgcagctgctactactctgtcatcctaagagaagaatctctgaaattttgacagcatgtggaaatattcccactgattattggattatgaagatggagaagagtattttaaaggagttttgtaggagctgcaggagaggattcaggtatatttatattcatagtatatgtgtaatgctttgttcctgctccttcattacttctattaagaagagacaaggagagagacatggaaatgactaaggcaccaaaggaaaggcattttttacatttcaaagtcacaggtaaaaaacatttatcattttcatgtggaaacattcttccaagctgtaactaataatggtctctcctactatttcctcccacttctgcagctgctatttctaaaggggaacatctttttaaagcctttgttgtattaattaagaatccagggccaagcccgtggctcatgcccataatcccagcactttgtgaggccaaggcaggtagatcacctgaggtcgggagttcgagaccagcctgaccaacatggagaaaccccgtatctattaaaaatacaaaattagccaggcatagtggcatatgcctgtaatcgcagctattcaggaggccgaggcaggagaatcgcttgaatatgggaggtggaggctgtggtgagccgggattcgtgccattgcactccagcctgggtgacaagagcgaaactctgtcaccaaaaaaaaaaaaaaattcagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggggtggagactggccatgtcggaggtgacctggagtctgctgcagctctggggcgccagttttaggagaggcgccaacttcgacttttggggccagccggtggaggcgatagatgagtatcagatattagcaagacatctacaaaaagaggcccaagctcaacacaataattctgaattcacagaagaacaaaagaaaaccataggcaaaattgcaacatgcttagaattgtgaagtgcagctttacagtccacacagtctcaagaagaatttaaactggaggacctgaagaagctagaaccaatcctaaagaatattcttacatataataaagaattcccatttgatattcagcctgtcccattaagaagaattttggcacctggtaaagaagagaatttggaatttgaag

SEQ ID NO: 242382 - DNA, 1387 bp, Homo sapiens
tctctgcagctgctactactctgtcatcctaagagaagaatctctgaaattttgacagcatgtggaaatattcccactgattattggattatgaagatggagaagagtattttaaaggagttttgtaggagctgcaggagaggattcaggtatatttatattcatagtatatgtgtaatgctttgttcctgctccttcattacttctattaagaagagacaaggagagagacatggaaatgactaaggcaccaaaggaaaggcattttttacatttcaaagtcacaggtaaaaaacatttatcattttcatgtggaaacattcttccaagctgtaactaataatggtctctcctactatttcctcccacttctgcagctgctaaaacacctttgccaccagctccgacaatcaaaccatgcctttggatttcttcagtttctaaaggggaacatctttttaaagcctttgttgtattaattaagaatccagggccaagcccgtggctcatgcccataatcccagcactttgtgaggccaaggcaggtagatcacctgaggtcgggagttcgagaccagcctgaccaacatggagaaaccccgtatctattaaaaatacaaaattagccaggcatagtggcatatgcctgtaatcgcagctattcaggaggccgaggcaggagaatcgcttgaatatgggaggtggaggctgtggtgagccgggattcgtgccattgcactccagcctgggtgacaagagcgaaactctgtcaccaaaaaaaaaaaaaaattcagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggggtggagactggccatgtcggaggtgacctggagtctgctgcagctctggggcgccagttttaggagaggcgccaacttcgacttttggggccagccggtggaggcgatagatgagtatcagatattagcaagacatctacaaaaagaggcccaagctcaacacaataattctgaattcacagaagaacaaaagaaaaccataggcaaaattgcaacatgcttagaattgtgaagtgcagctttacagtccacacagtctcaagaagaatttaaactggaggacctgaagaagctagaaccaatcctaaagaatattcttacatataataaagaattcccatttgatattcagcctgtcccattaagaagaattttggcacctggtaaagaagagaatttggaatttgaag

SEQ ID NO: 242383 - DNA, 428 bp, Homo sapiens
tttttactcaagctggggcctatgtttggtattgaacaaaatggaatgctgcaattttctctctactgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatacgtcttctagtaggtgcccaggttagtatggcctgtgttaccagagtaacaatgaaaatggctacgtctttaaatcaggccactttacagtgaactatggtccttaattgctatcacatttcaaacaagaactatgaccaattaaactttactattgttgaactg

SEQ ID NO: 242384 - DNA, 239 bp, Homo sapiens
gcaattaaaaatggaatcagtagggtggatcattcacgcattcagaagaagcatcttcatgtcaagaaagctgcccttaggacctcaccaagtcaccaccctcaactggaagttgagaattctaaaattccctttcagctcaaaatcttcttctgtctttctacttgttccactcagtgtgctcctttactcagaatatcttttctctactagtctgtttaactcatggccaggtacta

SEQ ID NO: 242385 - DNA, 471 bp, Homo sapiens
ttgatcttcgtatttctctatttgataatgcctgtggtctgagttcagttagatcagtgtttctaaaactttaatgtgcaacagaatcatctggaaggcttgttaaatacagattgttgggcccgtggaccaaaccccaatgtgtttttcagcgagtctgaggtgggtggagctgacactttgcatttctgacgactttccaggtgctggtaaaactgatgttgctgatatgtggatcacactttgaggaacactaaattagatgcttaagcatgaaaggctaagatatgtctaaagactttggtccagttcacagccaaaggttttactttcctttgctacatgtctgccttcatttcaaaaattattggtagaaagtaccctcataaagttctctggttcccctggactatcctgccttctaatacactgaggaatcccagaggaggggcacgatgtagccacattcat

SEQ ID NO: 242386 - DNA, 508 bp, Homo sapiens
agggtttaagtgacatctgaagaaaggctgctatgtgaaagagcaacgtccacatggacgactgggaaagcatggttcccaaagcagcggaattcaggaggagatgaaaatgtaaacagaaaattgacctcccacccattggtatcctcagaaaggcccaagaaagcattgcatccataaaacaagaacaggatgctatgaaataagaatatttggagaacaaaaaagagctttagattaaaaatatgatagttgaaataaaaagttcattaaagggatacatgacatttcatgaaaagaagaagaaagcaaagactggaacatctgaaaggaaagctgagaaagatgcaatacaaaggcaggtgatggagtatttgactaatggaagtttcagaaactgaaacagaaaacagacgggagaaggttatacaagaacaatacaagaaaattgcctggatcaggacaaaaatcttcacattaaaacatccctcagtgtgcccagcacttt

SEQ ID NO: 242387 - DNA, 521 bp, Homo sapiens
agtgaaaccatcattacaatccagattgagaaatttgccatgccagccaggccttgaactctccaccggtcggtaactttgtttccttaatctttgggtcctcctagctgattgaagggcctcaaatcacaaagtaaagggataaaacaattatggtgtagccatacaatggaacactgcttagtaatacaaagacacaagccattgacacacaagcagatgaacccaagataattatgatgaaggaaagaagctggacaaaaaacagtacatactgtgtgattccactgatacaaaactctggaaaatgcagactaatctgtgtggcaggaagcagatcagtggttgggggcaggagtcattactgagggcaggagggagtactggacgcgttcactttgtggattgtgatgatgatttcactggctataacgtgtcaagacttcaatttgtacactatatatgtgcagttattgtatgttaatcacattttaataaagctgttaaaatattgacctgaa

SEQ ID NO: 242388 - DNA, 744 bp, Homo sapiens
ctggtcttgaactcatgggttcaagtgatcctcccatctcagcctcccaaagtggtgggattatagacatgagctaccatgcctggcctctccatgtattactattttctagctatcagttttaattttctaaagacttcatttcattattagacacagttacttcaacattaggaaagtgtcttgcagtttttaaaaaaatcagacataaaatccgggttagcaagagaattatagacttgcttgtataaaatacattaagtttcttaaccagaacttatactttaagcaaagcccttgtatacgtcccattgttcagctggaagagtatctgttcttttatcttagatatctgtgtgtttttatttaggagaggttgtaaggagtgaacactccttgcttttacaggttacatcctgttataaggaactctgcagggtatctacattgtagagtaattttattttagtgactacattgttaaaagtcacattcccaagcgttaggagttacaggaattggaagcagaacagatccaggctgggtgtggtggctcacgcctgtaatcccagcactttgggaggccgaagtgggagggtaacttgagcccaggtgtttgagatcagcctgggcaatttagtgagaccttgtttccacaaaaaaaattcgtggaaggatcacttgagcctgggaggcggaggttgcagtgagccaggttcatgccacctcactccagcctgggca

SEQ ID NO: 242389 - DNA, 738 bp, Homo sapiens
ttttaatatgattacattgaatctatagatcagttttggggagaattgccatcaacaatattgaatcatccaatcaaagaacatggtatatcttcctgcgtatttggtctttaaatttttctcagctctggtttgagtgtcttttgttaggtttgttcacaggcattgcatattttggggcgtctctttccgcctgagctggcttggtgcacctcccacacctgtttctgtgctgatgggcgttggtgaatcctcctgcgagtctcctctgccctggagtgaactggagcttctcctgcacgccctcagggcttctaggcttctcgtatcctgtccgtggcctgtgtcctcctggctgtcctctccccactgccttcggccatctctcccatctctctggcgcccccattctgtggcctctcccagctgctgtctgcccactaggtgctccccttgttttctggggaggtcttgggtgtccttcactgacaggtgggcccctccagccaggggatgccagtgcacacgagagcaggtccaggtcatccccaattctcccgcctatttacatcttggctagcagcttcagtaatttttggtgggtgcaacattaaaaaaaaaaaaaaaagaagtggaaaggtaaccaaagataagacaaagaatgggagaaaataaatagaaatcgtgtactcaataagggcctggtatccagagtagttaaagaatccttacaactca

SEQ ID NO: 242390 - DNA, 406 bp, Homo sapiens
ctccgccaactgcgtccctgggttaagtgtttgacctcaccttcttaggatggcctgtttccctcatcagaccatcagcatcatctccatcttgtacagtgtccacccagttaccgtgcttggagcatgtgggaggccttcctcctggacattttagggatcttagccctggcagtcagatgtcagtttcagcagttcgaaagcttttctgaatccttgagtcttcttgcaaataagacctggctgacttttcctgcctctgggacaagtgaagcccatcagcttttgcagtgtatattcagtttaaaacttggtattggcacccactcatagagcaaataattcttgcaggtgatgctaatgggggaaaagatctgaagaagaaggggtgtgttcatagcatttc

SEQ ID NO: 242391 - DNA, 308 bp, Homo sapiens
taatgtttttaccaaatcaagcagtttttattattcctggagccatctttagctttctgacaataatgagttcacttagaatctggggctatgtaaattacatttcactagtggctgttccttgtaacagacaacacttgaatccaagcaggtggaactagggctcatatataaatgaaggagcatgaattatacactccacttggaaaacagagggcacttcgtgttagtctccattcagagtatcctttttctgccttttgccaaccagtgaaccatgagaacgtctcaaagggctggggttgctc

SEQ ID NO: 242392 - DNA, 633 bp, Homo sapiens
cagtttattagtttttctatttttaaaaataaaccacagacaaattacaacacagaacatcatatcaaccctgacttaaggaaaaacataaacttagatttagagattggaaagtagagggagaaatggagggaagcgtaagagtgctaatgtttttatttaaaaaaaaaaatagcaggggagctccaagaaatagtcttctgtttaaaagaacaagaaatggaagtttaagtagatttttctgaggttggagaaatgattacttaaggaattgaaaaaagtgacaagacaatatgggtagaaacacaaggagggaataatgtgtgggagtaaatcctcgttgtagccagaaatcaatagataccgtctacatttcatagtggcataagcatatggtttttagaaataaaaaggtgacataccagaaaaaccaaaagtcagacagttaactaaagaggcatttggagagcaagactaagggtacggaggggtggaaaaggggactgtccttttcatgaagtggtcttccaaactcaaatatttaactgtaacatttcattattaagtcattcacatatattttttcaaaaaattttaaatattgagaaatatcatatacatgagagaacaaag

SEQ ID NO: 242393 - DNA, 480 bp, Homo sapiens
aagacagtgcttcaggatgcagaataaaggctggagggcagtggtgcagtcatgtaaccttaaaaccctgaggtgggcagattgcctgagctcaggagttagagaccagcctgggcagcatggtgaaaccccgtctctactaaaaatacaaaaaaaaaattagccggtgcgtgattgagcgcccttgtaatcccagctactggggaggctgaggcatgagaattgcttgaacctgggaaggaaaagattgcagtgagctgagatagtgccacttctctccagcctgggcaacagagcaagactgtctcctacccccgcccccaccaaaacaaaagaaaagaaaacaaaactttttgggccaggagccagtggctcttgcctgcaatcccagcactttgggaggccaaggtaggaggatggcttaagtttgagatcacctgaggcaacatagtgaaaccctgtatctagaataaattagag

SEQ ID NO: 242394 - DNA, 360 bp, Homo sapiens
tctgttcccctcactcccttcattgtgtttacccaaatttgtgagtatatatttttcctgtgataattttttaagaagtctgtctcagctgggtgcggtgtctcacgcctgtaatcccagcactttgggaggctgaggcgggcggatcacctcaggccaggagtttgagaccaacgtggtgaaactccttctctaaaaatacaaaaaaattagcctggcttgtggacaggcatctgtaatcccagctactcgggaggctgaggcaggagaattgcttgaacctgggaggcagaggctgcagtgagttgagattgcgccactgcactccagcctgggcaataaaagcaaaacttcatctca

SEQ ID NO: 242395 - DNA, 492 bp, Homo sapiens
ctaatttggttctcaaaagactgataggaaatagtggtcaggagtacttcagtcattggaagagatatttcataatctaaagtttctggtgttctcctgtaaatgttatcatcagattgtccctgaggactaaatagtttctgggagtaacttatagaaatgaattcagccatggccaagaggtcagagtcaaaaatagtctagagcagtagtcaccatagaactttctggggtcatggaaatgttctgaatctgtgcggcccaattcagtagcactagccctgtgtggctactgtgcacttgaaatacggctagggcagctgaggaagataatttccaattttattttactttaattgactcatgtttaagtatgtggctagtggctaccatattggaaagcataggtctagctagagggtactcgctcccatggacagggcacttcttagataagggataattgtgaggtagcactaagcaaaaaaaaaa

SEQ ID NO: 242396 - DNA, 567 bp, Homo sapiens
gttgtgcacatgtaccgtaaaacttaaaatatagtaaaaagaaaaaaaaaaagaatggaatgcctgattctgcatccctctagatgggatcaacaggatcaaaacatgaccttgatggccaagccaagttctctttttcccaaagggtttaaatctgccctatttaatatggtagccgtagccatatgtatttatattaaattcaaattaatcaaaatttaaaaattagttacttagtcacactagctacattttacatgctcagtagccacataaagccagtggctgctgtattgaacagtgctgattatggaatatttccatcactgcaaaaggttctgttggacagcagtaatccagatctcctttgtagaagaattggcacctggggctgcctgatcttcaaggggcacatcacagagcatggtgttgacccatctggataccatgtttgaagttgacatggcccagaaatttgacttccaccagttaaaaatgtacttcgacagttttgtatttaacctgtaaatccagaagcatgtcagggccttctggatggagcactgt

SEQ ID NO: 242397 - DNA, 480 bp, Homo sapiens
ggatattgttgtgaattccatattcctaaaatataagttggccgtccattgtggtccacctattaaaataaattaattaattaataaatagtactggtgcataagatccaaaacattgtggccgataatgtgaagaataaatgcgagttttctccattatgaggttacattgcacaatgcaactctgaacaaaaggtattccgaaataaaatcctatatctaaggtaatgtatgatgaagaaacaacacggaagccttaaaggatttgcccaagtttgcacgatttggcaaaggcattgctggctccagaacactggcttcagcttatttcttttttttttctattgcataataaaagcaatgttttccatcgtgtaaatggtggaacataattcctctggatattattatttaaaaaataaattgtaaaacatgccaaataagttcatgaaaagactacagtaaaaattaaaaaggaaa

SEQ ID NO: 242398 - DNA, 248 bp, Homo sapiens
gtcagtcatttcaggagaggggccaccttgtctgtaagacctgactcctgagtgatgatctgaattctcacccagaggctttctcaggccaaaggtatcatcagtcttcctcattcttgaggctggagcatctgagtaatacctattagtaccatagactgagctgtctcctagttaaaggagacaggaagacctacaggttgtttttcattagtgccatctaaagaggctggtaactgatggctggg

SEQ ID NO: 242399 - DNA, 294 bp, Homo sapiens
ccaggactcagacagtgccagaggaagcaggcctcccatggagcatctccccaggtaagacctagaacacggaggggcagaggagaacctgtgcacacgctgtgcctccacattgcttccccatgacacctccccggacagttccccttgatgtctaaaacctagcgactccccactctgttctctcatagcccctgttttgacctggtatccgcgttccatgctgtgtcacaatatgaccacacacttaacgacttaaaacaaaactgattgtctcacagtctctgtgtaatt

SEQ ID NO: 242400 - DNA, 413 bp, Homo sapiens
gcaggacacattccagcttctccagaagccttttcacttgctgctcgttgtgtcaccagcgtcaggtggtccttgccccaagctggtgcatgagattcttttccagggacttcagggaacctgtgctccaatgcctcaggagaggagagagtctggacagagcccaagatgaacgtcaccctgccagtccttgtgtctggagcatttgctctgctcagggtgggatgctggcacggaaggggacacagcagaggacgtagagaagggctacaggggctgaagactgagctctgtagtaggaggtgggaggccagagtactcctgacaccagcttgctgttctggtgccagctcgctatgcagacttaatttcattaactctctgagcctcagatgcctcacctgtaatgtgca

SEQ ID NO: 242401 - DNA, 570 bp, Homo sapiens
agatggaatctccctctgtcgcccaagctgaagggcaatggcatgatctcagctcactgcaacctccgcctccctgattcaagcaattctcctgcctcagcctcctgagtagctgagattacaggcacgcgccaccacgcctggctaatttttgtatttttagtagagatggggtttcaccattttggtcaggctggtctcgaactcctgacatggtgatccacccacctgggcctcccaaagtgttgggattacaggtgtgagccaccatgcccggcctggaagaataatcacttttctatctattacatttccagttaacaaggtttatgaaaaacttggctaagttaaaatgtcagaagaaataaaagtgttctgtcaaatgttttttctttcctttttattgtttcattttttgatgttcagttactttatttcctctgagctatctttttatgactccttataattttaagctaaaatgcaatacttttttgtcaattacatcatcccctttccatgtactatggttttgtgaagaaatgggtaaagtacacgttagttaactga

SEQ ID NO: 242402 - DNA, 473 bp, Homo sapiens
cttttcaccttccaccatgtgaggacacaggattcctcccctctggaggatgcggccctcaccagacaactgaacctactggcaccttgatcttgaacattccagcttccagaaatatgagaaataaatttctgttcataaattacagtgtcaggtattttgttataacaccacagaacagactaagacatataaatatcatggtttaaccccagttaacatcaccacaaaaaacaataccctttatcacttctactgaaaatactcattttataataatttaagcaattacttcttcagtttcaaataatgacacaaaatgtttataaacaaaagccctctcagtaacagtggctacctacagagaagaggctaggactggctgggaagagacttgaaggtactggaaatgtcctacattttcatctgggtagcagccacatggatatttagggaaaaaactcaccaaactg

SEQ ID NO: 242403 - DNA, 501 bp, Homo sapiens
aaacttgaactttaaatctctgataacctagttggagagaatagtttgtttccctaaagagtgtagagtgttctgcttcccctctgttggttggaatattcactagtggctaatcatctatttccattaaaaattaaaattcagtgaaaggagaaatcagaagtgttccagtaaccttataatcctagttatattatttggagaaatattttctcatacacctaaaggaaatttcaacaatgtcgcttattgtttctcttaactctgaagagttgtcaataacttttgttacttgaaaagagatttcaagtaaataatgaaagtaaatcagagttgaacattaaatagataattttcaatgtttgagaagtgtatataggatgcttcctttttaaagttattcaacaatttgtttactaaagttatctgagaacatttttgaacctgttctagagatcattataatattttctgcttttaaggaaaagttatacattactt

SEQ ID NO: 242404 - DNA, 400 bp, Homo sapiens
aggctccaggcttgtcccctaatccgttcttcacccagcaaccagggatcttttcaaattgcaaattagactgtgtcactcgccttcctaaaacctttcagtcacttaacaattgcactcagcctctgtacttccatttacaagacccttcatgagctggcccttcactcaccatgcacccctcctgctcctgccattctgaatgactttcgatttctagtatcactcaagttctctcacctctgagcctttgcacgtgttattccttctgcctggaacactgtctccctatttccccttttaccttgctgtctcctcataatctaggtctcagtttagagatcatctcttctagagaaacctcccctaatcccccaagtctgggctttacacacccctc

SEQ ID NO: 242405 - DNA, 373 bp, Homo sapiens
gaggtctccagctttccaactccaaatccagtcatggctaaaatagaagtgtttttcccccctaagaagtcgtatctctaataaggccagactcagtggctaacacctgtaatctcagcactttgggaggccaaggagggcagatcacccgaggtcaggagtttgagaccagcctggccaacatggtgaaatcccatctctaataaaaatacaaaaattagccaggcgtggtggtggacacctgtagtcccagatactcaggaggctgaggcaggagaatcacttgaacccgggaggtgaagtttgcagagagccgagatcatgctactgcactctaccctgggcaacagagcaaaactccatctcaaaaaaa

SEQ ID NO: 242406 - DNA, 530 bp, Homo sapiens
tgtagtcagtttgtacagattattatagcataataatcttaatatatgcttggggtaggttccattctccttactcttttcttctgaagtatcttggctattcttggccctttactctctatagattttagattcaatttagtagttccgtgtgttggggggcactatttgggatttcaaagagcatttcacagaatctgtagatacatttgggggagaattgccatcctcatgatattaatgtaacttaaaaaatggttatcctggccagatatggtagctcagccctgtagcatctgcacttcaggaggctgaagcaggattgcttacaatcaggagttcaagaccagcctgggcaacgtcgcaagaccctgtacacacacacacacgcacacacgcctgtagtctcagctacttgggaggctgaagtggtaggattgcttgagcccaggaattggaggctgcagtgagttcgtgccacatggcaacccagcctgggcgacagtgcaagatgctatctccaaaaaaaa

SEQ ID NO: 242407 - DNA, 663 bp, Homo sapiens
cacccagaagaatcctgtatttaattggctcatatggaaaattttagaaagagagagacatcggggctcagactatcttccgatcaggaaccaaaacgagctgggaggtaacagagttctttttcatagtaattgtgttccatatcatggtgaaatcgtgccagaacaagcttcagactctttctggtcttactccttctgaccgtgctgttccaaagaacttcccatacaggaaataacaatgatggcagtagctgtcaaattctaaagacggggatagactctggacctcctcaggcccctgagcccactgtagagcagggacgtgacttaactgaagttcaggactgcggccacagtcacatccacctgtgagcaatggaggactttcaacacagaaccctctgcatcccctgcattctgttactaagcagctcatagaacacgaagaggtattaaccttgttatttgcagagttacaaaaagctgagtcaggtattccaaagcaaacccagaccagaagccacctgagagttcgtgccggcaaggacagattcagaatgtacaaaaacgatgaaaataatattctgtgatcaccctataacctacttccttactgaccaaacacatgtctcattcccattaaaaagttatgctcagcca

SEQ ID NO: 242408 - DNA, 564 bp, Homo sapiens
ataaatatatcagtaatcaccagcagaaagatagaattagaggtgagtggagatcttgtttttcaaaaatatgtattccagtgcatattgtgaaagacctatttattctgtttcaggagaaataactttttgctaggaataactttgcaagttgcaaaagcataaagcaaatatatatttttaatgaaacattagtgtaatagctattgggcagcttatccagtaattatgacaatatagatattccctcacatgtaattcttttggagggagggcatctgcattattcagaaaatgttcgcatttttatattttgctcttctgttgattatttgagtatattcatcctttcattgtgtttccatttcggacaatctgcttgagttgaaggaatttactttattacagagatatctgtcacacaggataagtacatgctggagggagatatccttttatataagattacttatttgattgagttcaactgttgaatttgcatctgtgttctgaattcagtataaaatccacttcattacaaataaagacaaacattattatatg

SEQ ID NO: 242409 - DNA, 1016 bp, Homo sapiens
ccatgttcagttttgagattgctccaggatgatgaaagaagattagaggcggagtctagagcactgagacttagggttggatttccagtgtgtgcagtcaggaaagagaaggaatggaagtactgaggtcctcttgggattacaagccaagtgcagtgagagaggattcgagttggaaggtgaccattgagattaagaggcactgttaaaagtctcgaagactgccagagaaatccaaataaagtctgtcatttggttaatagcattctcccaaggtgagttttgataaatgtaccacggctgtataagatgttagcattagaagaagctaggtaaagaatatgccagaactctatactatctttgcaactcttttgtaaacctgaaatcatttcagaataaaaaatgttaaaagtcaaaaaaaaaaaaaaaaaaaaaaaaaaaaaaaaaaaaaaaaaaaaaaaaaaaaaaaaaaaaaaaaacgaaaaaagaggaaacgaggagacagcgaagagaaaaagaggaagaagagaggagaagtgaaggaaggacaagaaagaagaagaaggggggagaaggacaggggaggccggaggggagcgaggagaagggagaggaggggcggacgggaaggagaggagagaccaaaaggaagagaagagaggaaaagagaaaaggaggagaggcggagcgaggagagaacgggagggaagaagagagaggaagagaagagaaagggcagaaagagaaaaaaagaagaggaaagagaagaagaagagagggagcggaggagggaggaagagggaagcaagagaagaaagagaggggggggaaaaaaaggagaagaggacaagcggagagagaggaagaacacaagaaagaagacaaaagaggaggaagggaagaacacgaaggagaagaacggcgaggaagagagaggggaaaggaagagagaggaagaaagaaggaagaagaaaaggggggagagagaaggaaagaggaaagacaaggagact

SEQ ID NO: 242410 - DNA, 503 bp, Homo sapiens
tagagacagtgtttcaccaagttggccaggatggtcttgatctcttgacctcatgatctacctgcctcagtctcccaaagtgctgggattacaggcttgagccaccgcgtctggccaggatatgagttcttattaaaaagagcagattctagagatttcactctgtttgcatttctccttccatgcaagttctccttgagtttggctgaccacaagctcatcttcttccaggaagtgagaaaactggtatttgggaatgctcccagtagcacctgctttttccatatctgcactgatacctaattggaagccatccgcgttggagacagtggcgttatttatattgaagctgactcccaaggaaaccaggagggtaggaacaccgccactctggatcacagagatctcattggtcttcttggccagaccaccattgagcatgctggtgtcctggttccacaaaacagggcccatgttcactaaagtggccagaatttccctgg

SEQ ID NO: 242411 - DNA, 464 bp, Homo sapiens
tgcatttagatatctaatccattaggcatttattcttttatatggtgtgaggaatggttctaattttatccttttctgcttgtcccaacaccattattttaaagtccatatatgcctcagtatttagagataccactgttatcatacagtagatttctaggtacagttggggctatttctagactttgtatttcacagagtatttttaatgcccgtggttctagctgagttttcattaaacatttatgtatgtctcagaggctaccaggttcctgaatttacaatgcgaaggaatttttaggcctcttcccctttcgtgatagaagaacccttattatcttcttgtacttcctgaattttctaaattttctgaaatcagccgaactttttctagtctttaaaaaatcttcttaaaggtattaccagtttttaaacaggaaacttcagcatacatttttaacagc

SEQ ID NO: 242412 - DNA, 415 bp, Homo sapiens
cagaactttcttgaaaatggcaacgttctatattggcggtgtccaatacggcagccattagccataagtggctactgagcacttgaaatgaagctaatgtgacgaaggtgctgacttttttaagttatttgattttaacaaatttaaacagccacatatacagctagtggctacaatacactcaacacagggatagggtcagcaatgcacagaaagacaagcacagaatttgaaaccaggacaaatttgggtcccacttctgctacttgatgctttttattttaagcccgtatctaattctcagaagaaaacacctacccatgaactacaggtctattttgagaatcaaatgaaacggtatatgagaaagacctttgtaagctgcagaaactggtatatctgctctttcctttaa

SEQ ID NO: 242413 - DNA, 410 bp, Homo sapiens
ctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcatttttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatga

SEQ ID NO: 242414 - DNA, 423 bp, Homo sapiens
ttaaagaaaggcaagagtacatcagggcttacatttaagaaaactggacaccattctcacttaacgtgagaattctcacttaacgtgatgaattagaaaagcatccaaattgtttatccctttaaaaatattttttatcagtgagttgcaaaactgtttcttaaaacgtatttctaggtaagtaatttctgaaaggctccaaccattaagatttagtatgaggggcgagggatagcattaggagatatacctaatgctaaatgacgagttaatgggtgcagcacaccaacatggcacatgtatacacatgtaacaaacctgcacggtgtgcacatgtaccctaaaacttaaagtataataataataaaataaaataaaataaaaaataaagggaactgcaagggagcagctacaagcaaaatg

SEQ ID NO: 242415 - DNA, 419 bp, Homo sapiens
cctaagctctctctctctctggtagtgacacaggcaggagggcagggtccctggtgagggctccaccctcaagcctggacctatggccctaaatgagaacaagtattcctatttttgtgcctgaatgttgcctttccaagaccagtctggcccactccaccccttatcctatgcctgtaagaaccccaaatcccaggctccatgagcagcagagcagcagagtggcacagcagaggagagaagaagcatctgaacgtggtgaggagtttggctatggacagtcagaaaggagttcatcctgggacggctgaactccaggggaagattatcttcccattgcatcccctttccagctccctatgccactgaaagccaccctgtcactcaataaaaactccgcattcatcacctttcaaact

SEQ ID NO: 242416 - DNA, 349 bp, Homo sapiens
aaggaatgggacttttatctatggaatgagaatatttatatagtagggacaaaaaggtacttatcttgttttgcctcaaggctgtgttgtatttgctcacctatctgatatagtcttggtcagtgcttctcaaattttgacgtgcatatgaattatctgtgactcctattaaactgaagattcagattcagtggtgctggggagtgagcagagctgtggcctgactatcatcttaatcctttataccagggttgtctaatcttttggcttccctgggacacactggaagaagaattgtcttgggtcatacataaaatacactaacactaacaaaagctgctgagctaaa

SEQ ID NO: 242417 - DNA, 452 bp, Homo sapiens
gacctggagatgtgaggctccgcggctgcaaggatagcgtctcaggggcaggaggagcccttccttatggtgccagccggagggtgccctccaagttcacaccccagagagtgaggcttcaaacagattaggtctggatatcttaaaattataaaaatattagcagaaacaaaggaaagctgtccctgtagcctcggggtggagaacatcctcctgcaaagctgctgaagataaacaggtcagattccacacatgggcacttagagctcttggatgtgagaagacacacgcacaacgttagaagctggcaacacacacagcaagcgtgtgtgcggcgcccaggctgaggcgagccctgatgcgcaggggcgctcggcagtcctacctcagcggagaaagcatagtccttgcatggggatttagaggaaaaattaaaactgcgagtagatacg

SEQ ID NO: 242418 - DNA, 532 bp, Homo sapiens
gttcagttcatttccttctcaggacctctggttggctggtcatcctacgatcttcacatggcagtgtcaggcctcccaggctacagcttcagtgtcacctaagggaggccccccgaccaatgtggctaaagagcatcctgtcccatcagacctcctcttgtttcctgttggccatctgtccccctccacgaggcataccctctatggtgcaaagagctcaactaccctggtgatcagtgggcccaaggataagcacagatgtatccattggacacatgagttagtacctggtcccctggctctgcagaacactgaagaaaagccacttgattgggacatagagctgtcactgaactgagaaccactgagggcacaggctgaggtccagtggccatgagcagccgcagttggtcagtgttctgtgagaacagggaaatcaccctgcttgcctgcctgtcggaatgggcactgggctttcaggattcaacttgaactagaatagaaactacattctgacatcaaaaaaaaaaaa

SEQ ID NO: 242419 - DNA, 448 bp, Homo sapiens
acgaagtgttctgtgtgagtgtagaaacagtgtggtttcccagatatggggaaatagattatatttagtagaaatgtatccaattatgaaagttgagaaatgggctgggtgctgtggctcatacctataatcccagcactttgggaggctgagaggggtggatcacttgaggtcaggagttcaaggccagcctggccagcatgatgaaaccccatctctactaaaaatgcaaaaattagctgggtgtggtggtggttgcctgtagtcccagcttgttctttataaaaaccagtaacatgaatgaaatgtattgtgagttacagctgggaaacaagaaatagccaaggtctgaaagactgggaatgagaaaggagatacaaccacagatataggagtgattaaaacaaaaataaattaaattatgtgaaattctacagcaacaagtagt

SEQ ID NO: 242420 - DNA, 1037 bp, Homo sapiens
gtaggctaaggaccctgttaagacagtttgtgttttactaccatgtagaaatttccaactacttttttttgtcctttactaggctgcaggttctggaggttccagcatagttctgacacatggtaggccttccataaaggcttgtggaacatttaccatctagggctaggtggtaaggagcaccagagagagaggcatagtttgaaatccacagatacagggaggaagaggcatttttattgtatcaggcctaaggctaggcaatttatggttaccattttattcaggtaggtaatttttaaaaggaagagttctagctgtccctctatgtaaatttaatatcttaatgttagcgagtcacttggaacactttgctttgcatcatgcggcctctgcttattagtcgtagagaagttatttaaactctaaggcagttttcacacctgtaaaacagggacagttcttactgtgcctgtttcaccacattttaaaaaatatcaaatgaaaatatacttaagtaaatacagaacaaacacgcattaagtggaaagtctgcactgttttctcccttaattcatcctctctgcagcttctcaaggttcctctagtccttcgctggctggagaccaaatggaaaagataggtctctgtctacttcaaggctaaccttaggtagctctgtaaattttggggtttacatctttaatgcctccaatatattgagaatgcgccatgaattctcagtaagatttatagcttataaggcttttagaaagtttgctatttactaaaaacctgaaagaaaatgttattttagtcaattattgaaaattacaacatttattggttcaacgataatcaatagtatacttttcctacttctactgaaacttaacagaacatttcttatctatgatgcaatttttaactaaattgtctatacaaatggaaaaaaaaaccaccccaaaccataaataccacagaaactttttaaatttacacagtgatttcccctgaaaccactgcacaaccaagca

SEQ ID NO: 242421 - DNA, 484 bp, Homo sapiens
gcaacgctctgcttcctggaaatctgtgtttacagccaacacagttgctgcctgagacagccccacctgaagaccccagagctgccccagcttgccaggtttcccctcctcctgttatcaccccatgctgctgagaacctgcctggcaggcttcccagccaaggctggggcctaatctcaagtgaaactgacatgtccctgtgaggactgaggaacatcctctctccccacagagcctcactcaggttctcatctacttccttggggtctgccccgcctccctcagaagtttggaaccacatactgttctggaggggacctctcactgctgcagaacctgtcctccaggataccgacaagtgttcatctcggtcgtggctaattaacttaccatatggtagtgaactcccttctggggccccaatattttgtttatttttaaaaaataaaattagtaccattgtttattttctgaatgtacaga

SEQ ID NO: 242422 - DNA, 470 bp, Homo sapiens
aaaaaaaaaaaggcagtttgaccctgcctttactttctgaaaatgacagaagctttcagatatatttcaagatatgggtcataagcatgacccatagtttatgtcaccttaaatagagcagctgattagaactggccattggttataaaataaaagagtacgtgtaggtttgtgggagcaggatcctaactgctttagcaatactaagccactccttgccgtgtgatttcagtgtctttccttccagttggaactcctctctgccctttagcctgattttcttgtgtgtaacatggcaaattatttcatggctaatccttcttacagacctgaaattgttctttttaaaaaaaactttggtgggttttgagatcccctcctttgattctcagatgtggctgttagtagtttaatttctgtatgtggtttctgagtagcttccaacaacctatttttgttaacagttcttt

SEQ ID NO: 242423 - DNA, 194 bp, Homo sapiens
aaagtatcagccgttagaatgaaaactaacttcatctttgcttgctctgaaactcccccttttccacctactctcctagatctttgtcaggaagcagagcgcttctttaggggagaggaaatcccttcgacttgaagcaaccggtgaggacagcagagttttggaccaggctttattctgaggctgcagcagat

SEQ ID NO: 242424 - DNA, 612 bp, Homo sapiens
tacaattcattaatttattgcatgactcagggaagggtattcagctgccttttattaggtggtaattgtgaagggggacagtatcttacaggattatagatttttgaaaatcaaggctgtatttctttttaaggcttacttgtacttacaaattaggtaactcaatccagtgtggtgctacaccaatcatattgtatgaaatgctgttaaaaacacgcacaaagttggcttcctttgtcttcttaaaatttgaacagactaccaagcatatttgaatactatttgattaaaatagaagcaattatgaaagcctctcttcatattatcagagtgtaacattggtctttgtctttttttatttatctattttccttcatagtacctttaaaatatgagctataatttgaattacttaacagattttcttatgctgatatgtagaagcctaccttttagtatcaaataattgaaaaaaagttcatcttaatttagttgtcaatatctctttgatcacagtagataaattctgaattgtgaagggaaatgaatacccttcatagatagagccaatttgtgtgccagttggtgctcataattggcctgatgttattt

SEQ ID NO: 242425 - DNA, 206 bp, Homo sapiens
cagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgc

SEQ ID NO: 242426 - DNA, 444 bp, Homo sapiens
ccatccctagatgattttgcagtctttgcacaccagtgtggccataggcttgttttctcctggactgagcctgcagatcctatgagcaagcatatgtcctgtgctccactagtcctagctggatcgtggacatattaccatcattacaaatatcaatagtttgtgattacttcaaacaatctgaagttgaaggaccccagatatccttcaaaacaggaatctgcaggcagatgctgaaaccatgaatacagagggacaactatgtaagcacgctgacatagttttatgaatgcaaacagccaaggagagcagatgttgagtggttgccagagtgaaatgaggaagccctgctgccagcttcccaccaaaaagcaggtgcttagaccattttatttaaaaccagctctttgaatgcactatgtgctgaataaatatcactaaaat

SEQ ID NO: 242427 - DNA, 609 bp, Homo sapiens
ccatccctagatgattttgcagtctttgcacaccagtgtggccataggcttgttttctcctggactgagcctgcagatcctatgagcaagcatatgtcctgtgctccactagtcctagctggatcgtggacatattaccatcattacaaatatcaatagtttgtgattacttcaaacaatctgaagttgaaggaccccagatatccttcaaaacaggaatctgcaggcagatgctgaaaccatgaatacagagggacaactatgtaagcgtccacaagatataatgctgagaaaggctaataaatcaagccaatctaatgtctaaatacagaatagaaaaatgtgtcttctaatttactttaaaatgatgactggatgaatacgtaaccactgctctgaatggaagacttcgactggaagactttttcacatgacccagggaaaggcacaaagaaacaaagcttgtgatgctctaaaataatcaattcatttggccaacaccatgcacagaatggaaagcttttgcctcatttttcttccccccgccttcagattttcaaagtgttttataaaagcaagtgctaataaactgtggcattaactagagaa

SEQ ID NO: 242428 - DNA, 405 bp, Homo sapiens
ctttgaatttgctgatgctgaacctggagcttatctgaggctttcttggaaagaacctggcttgtctttggtgttctgagatgcaattttttctcttttgatttttctggaaattcaaacctatctgtgtttttctttccacatagttatcaacatttctgatatattgatgatactctaattgttttccactgttatgtgtctgtgcttttaaaaaaaattgtcttggttatttaatgtgacttttaacgcttaaaaaagtggagatgtatacatttgttaacaatgccatgaaagcattttctttctcctgaggaaaagtgaatttcttaccagaatatctggctgatcctgtaatttaaattaaaataaaattttggagaaacagcaaaacaaatcaacaaa

SEQ ID NO: 242429 - DNA, 361 bp, Homo sapiens
atcagagctgcccacagaggagagtcacccggtcacattcagctcactgtggtgaagcaccccacaggggcgaggagtttactttttaaatttttttttttgtgtgtgtgtgtgtgtgtgtgtgtgtgtgtgtgtgtgtgtttcactctgccctgttctgaagtttgctttttataactaatggttatatatttggggaggaagagttacaaagggacagttcctatatggtaatgaatgcaaccttgttgtctgtgtaaaaatcctgattttggagtatattcacagaatagtaactttgaaggattttcaagtatgtgttaattgttggctgaaatataaaatgttaaagaacttggca

SEQ ID NO: 242430 - DNA, 306 bp, Homo sapiens
tagcatgcttgttcctgctggagagccatggctctcggttaggagatagagctaggaaatatgtatattttgaaataacaagtttattttatttgattttagagaaaagaactcacttggtacccgggctgtagtgcagtggcatgatctcacctcactgcaacctcgacctcctgagctcaagtgatcctgctgtctcagctacttttggaaggctgaggcaggagaatcactagaacctgggaggcagaggttgcaatgagctgagattgcgccactgcaccccagccttggtgacacgtctca

SEQ ID NO: 242431 - DNA, 413 bp, Homo sapiens
cctcctctcaactcccaaatcttccttcaatgagcattcttcccgcaaagtctggagtcagggaaatcaaaagtctggtttccttcctaatcctcgctggagcattccccgtgctgctgaccgaagagttgtactatctgccctgaggacgcacagtaggactcacttcctggcttcccagtgcctgggtggggtcatgtgactactctggccaatgagacgtgagctgtcccggcgtaggggagcagcagcatctgctcccagcgccctgacatcccacagcaagtgaagacgggctgctcctccggcagcctaggtccaggggagggaggcagggagcagagcccatggccaggtgcgatggacactcagattgagcaaggaataaaccttgttattttaagccaaaaaaa

SEQ ID NO: 242432 - DNA, 323 bp, Homo sapiens
gcgcgtagcctatcctgcatatttaaagttaattgtgtttaataaaaatagagcagagatagagaagtgattgccagcccagcagctctgagctatctcatataaggcttagtagggaatcctgacccacactccaatctccaagctctagacatctcaccaacaaaacaggaagccaacacattctggatcttctttccaagataaagtcgaccattcgtaatatttttttcagagacaacggaagctgaaaaataagagctgagaaaggaagaacttttctataagaacttaaatccaaaaggctatgggatagtaatgga

SEQ ID NO: 242433 - DNA, 627 bp, Homo sapiens
acctctgtactagctgcaatttttctgtaaatttaaaactttttaagttcatttttaacaatgttttaaaaaattaatactttcttgataataatgagttagaaaataaaatgaactacaaaagtctaattatgcaaataagtactcaggaataaatatagctaaaattagtgacctaagcaaaaaaagcaaacaaaaaacaacaacaacaaaaatccccagaactgtactgatacataaaactagaaactacaaacaaatgttcttttataagaaaagttaagaacttgacagaaagtactagtgatatattttcatgttcttaaaaaaggtcaaagttattcaatgctttcttatctctcatataactgcagttgggaagtgagggctgcccaagatatgtggaaattattctaatgcactgatcatgcaagcacagaggtaccaataatgagatgatatgcacagaaatcattttaaagtaaggttagttgtttatcattttcaactagaaacagctttgtccttgagatgaaaaactgcatctctatatcagtaattccagaaaatatacattatcataaaagagacaaattatatcatatctttatttaaagcatatttccc

SEQ ID NO: 242434 - DNA, 411 bp, Homo sapiens
cagtgttcagcttggtttgtatagaacttagttgaaatttagcattgagaattattttggggcttttcaaattcttttcaatggcattttagtccataatttcattaactttattgaaagtgatattatttggccaggaacattagctcactcctgtaatcccagtactttgggaggctgaggcgggtggattgcaaggtcaagagattgagaccatcctggccaacatggtgaaaccccatctctactaaaaatacaaaaattagctgggcgtggtggcatgtgcctgtagtcccagctactcgggaggctgaggcaggagaatcgcttgaacctgggagctggaggttgtggtgagctgagatcacgccactggactccagcctggcaacagagcaagactctgtctca

SEQ ID NO: 242435 - DNA, 408 bp, Homo sapiens
ccataaagtttttcatgtctggtccttacttaatagaagacagtagcttattggaacttctgtccagttccaagcagaggaagaagggcacagtgagtggaacaaagccatgatcagcccttcaggaaaaaaaaaccctggccgggcacagtggctcacgcctgtaatcccatcactttgggaggcaggcgaatcacttgaagccaggagttcgagaccagcctggccaacatggtgaaaccctgtctcctaaaaatacaaaagttagccaggtgtggtagtgcaggcctgtagtcccagctactcaggaggctgaggcaggagaattgcttgagcctggaaggcagagattgcagtgagccaagatcccaccactgccctccaggctgggcgacagactctgactca

SEQ ID NO: 242436 - DNA, 476 bp, Homo sapiens
accaatctttgattttcagcaatgcataatgtaaagctaggcaactaatttaaatttgttaaatattgattttatcctggtagtaaggtaataagccaaagacacaaagagttaatttcaaaaagcaaacttcaattcaatttaccaaagtatcccaagctcttggcaatctgacaaatgaaagctgaaattgtttacaagaaaaaaaaatccagcatccttgaaagtttttcatggtttatctgaggaaaaatatttttctgaaatccacatttttcttctgtaatggaaacaatttggacccagctatatatgaccacggtgcatctgtcaggaataaaatgttatggaaaatttttgcaaatatgtgttacaaatatagtagaaattaaaaggcagctggcttcatacaatggagaatataaagaaaagcaatgacatttggattattcaataaactctcctacccattcata

SEQ ID NO: 242437 - DNA, 255 bp, Homo sapiens
tgggattacaggcgtgagccaccacgcctggcctgaaactcttaactcttataaaaaaaattatagaggcatatattgtatatcatataatctaccattttcaagtgcataattcaatttttagtaaacttaccaagttttacaaccatcactgtaaatcaatattggaacattttatcatcccaataagatgtgatgcccatttactgttaaccctcgcccttaaatatactttttgtctctctctgtgacaga

SEQ ID NO: 242438 - DNA, 273 bp, Homo sapiens
ggtgctgggaaaactggatttccacatgcaaaagaataaaattagatccctatcttacacatgcatagaagtcaactcaaaatgaatgaaagacttaaaatataagacctgaaactgtaaaactactagaaaataacataagggaaaggcttcatgacattggtctgggcaaggatttctttggataggaccccaaatgttcaggcaacaaaagcaaagacagacaagattgcatcaaactaaaaagcttctgcacaagaaaacaactagcaa

SEQ ID NO: 242439 - DNA, 256 bp, Homo sapiens
aattgaggaaaatcccagaagatagagccaaaagacaagagatgtaaaaatgcacaaggaaaaagaaaatagagtaaaggaaaaatgagattatcagtctaggaagacctgtgtctgaataataagtgtataagaaagagaacacaaagacatggaaggaagattattgtaagaaaacttcccagaactgaaggggacatacatctctaagtttaaaaggatcgacagttatcagtttatgcaattaaaaaaaaaa

SEQ ID NO: 242440 - DNA, 314 bp, Homo sapiens
agaaggagaaggaggagagagcttatttgtagaaataatggctgaaaacatcccaaactttcctttttttgaggaaagaaataggcatacaagttcaagaaactcaaggaactccagagaggacaattctaaagacaccccctctaacatacattataatcaaattgtcaaaagtaaaatacaaagagaatcttttaaattgacaagagaaaagcagctggtcacgttcaagggagttctataagaatttcagcagatttctcagcagaaaccttgcaggccaacaggcagtgggatgatacattcaaagtgca

SEQ ID NO: 242441 - DNA, 462 bp, Homo sapiens
acccagactggagcacagtggcaccatcttggctcactgcaacctccacctgggcaacacaggaagactccgtctgaagacaaaaaaaaaaaaagaaacttcagatagcaaaattgagagaagacattgacattcaagccatcaccacacatgttcccaattttcattgaagataaaatgtggaaggaggtcactgtactgcgcaaaaccgggggctgggccaaaccctggatcactgaagtcactgatgaaactcaagactgggggtttgtttctggggcctttcatggatggtgcatgttaaattcaattaaatttggcctaaagcagcctccctacataacaaattgtaatgtaactcaacatgtaaacaaacttgagagtatattcttgtaacaagtaaccttggacaatcagggcagccaagcttcagccagtcacaggctacaagctgcccagaca

SEQ ID NO: 242442 - DNA, 170 bp, Homo sapiens
tttatgcaacttttagatgggtctataaatgtgtcttcagaaggaatgtcagtaaagtgaaaaatccagttgctggataacagggacgcatcgtatttccaaacaaacaggaagaccctcaagccccctccccaggtccccctctagtgagcctgggtgagggtagactc

SEQ ID NO: 242443 - DNA, 418 bp, Homo sapiens
agagcgggtactcaacaaacatttgctaggtgaagaattaatattaaagaagcttacttacttaatctgaagagagtttgctaacaactagttctcaattctccattaatctgtatgagatcaaaggagaacctgaatttccactgacctgagaggaacaacaccccaggtcccacaactatgactctcattccaccctgatgctggaagggaagtgattcagtgctgtgctgcttcacctgcggtcacacagctagtgagtggctgggccactggagaggtcagaaggtgatccaggaaagactcagaatttaatgactggataaaaagccaaaagaggccggtgtggtggctcacacctgtaatcccagcattctgcaaggccaaggtggacggatcacttgaactcaggagttcg

SEQ ID NO: 242444 - DNA, 528 bp, Homo sapiens
cactcgacattagctgtgattatcgacgcagtgtttgatctgcgtatcactggaatctttttcatgcaccttctacatacaaaagcatttgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaa

SEQ ID NO: 242445 - DNA, 395 bp, Homo sapiens
ttgtgttagaataaaatcggttagactaaaaatagatgatcttcatttccagatttggatgctccatgtgttgggttgaagatcgctgtggtgtcgatcagatggctggattaactgccatgccctcattaaattagatcatgtgtgaaagttctttgcaaaccatttagtgccatgcatttctaaggtattattaatataaactagaggaaaggagcttgtgattcttatgtccaccagaaacttttttgcacaaatctcctctgcagcagggaaagtggcttttgaagctgtgaagtgcgctgcagtctcacaggtgctcgttatcagagaaaagtgaagatcatcagccttggctataggaggtcttctttatcttggatgatctggcaaga

SEQ ID NO: 242446 - DNA, 387 bp, Homo sapiens
taagtctaaacagaaagctcttgcttcctgggaatgaaaatctaatattataatgcaacataaaccgggtgaagatgggcagtgttaggtaattttattaggtttctcttagttctctctgaaactggggatatgttaggaagaggcaatggccataaaaatacattttataaagttcaacatatcaaagagaatttagaagtaattaatctgtaagattactgccacaaatcctatattaattatcaactaattaatgatgtgctagaacccaggattctggtaatattagctctgctctaaaacaaatgccaaatggtttcaaaggacttactacttatgacaggaataacacatattaaaaagaaaagcaaaaggatattttac

SEQ ID NO: 242447 - DNA, 389 bp, Homo sapiens
actttctaacatccatgaacattgtggtccccacctgaagtttcactttgcatgttcagtgatatggtttggctctgtgttcccacccaatcttatctcaaattgtaatccccatgtgtccagggagggacctgtaatccccacctagtgacggagggaggtgattgatgatgggtgtggtgtaccccatgctgttctcgtgatagtgagtgggttctcatgagatctgatggttttataagtgtttgaaagttccctcttcactcgctgtcttgcctgctgccatgtaaaatgtgcctacttcaccctctgccatgattgtaagtttcctgaggcctccccagccatgcagaactttgacacaattaaatgtcttttctttataaatt

SEQ ID NO: 242448 - DNA, 733 bp, Homo sapiens
tatggaggctggaattctgagatcaaagttgaagccacttcattttctggtgaggacactcttcctggtttacagatggccaccttcttgcttgttctcacatggcatttctttggtatgtgcctggtgggggagagagaaaataggctctcatgtctcttcttacagcaacactaattgtattggatcagggtcccactcttatggagacccaggaaagctggtggtataacaacttggttcaagtccaaatgcctaagaacctggggaggggcatggggaatgctggtataagtcccagagtctgaatgcccaggaacaagcaggagctgtgatgtccaaggacaggagggcaggatctttgtaatgaatttttaatgtcaaccttagcactcaggggatatggcctggtcatcagaacatctggaatctaatcctctttctacttctcaccagatgagggatcaagacaggttatttagcatccctgcacttgcggtcctggggatcttatttatattcatttaaaaaataaattacaaacaaacagccaggcgcagtggctcatgcctataattccatcactttgggaggccgaggtgggtagatcacctgaggtcaggagttctagaccagcctggccaacatggtgaaaccccgtctctactaaaaatacaaaaaattagccaggtgtggtattgtgtgcctgtaatcccagctacacaggaggctg

SEQ ID NO: 242449 - DNA, 302 bp, Homo sapiens
tatggaggctggaattctgagatcaaagttgaagccacttcattttctggtgaggacactcttcctggtttacagatggccaccttcttgcttgttctcacatggcatttctttggtatgtgcctggtgggggagagagaaaataggctctcatgtctcttcttacagcaacactaattgtattggatcagggtcccactcttatggagacccaggaaagctggtggctatgattgctccactgcactccagcctgggcaatagagtgagaccctatcaatcaatcaccacccccccccccc

SEQ ID NO: 242450 - DNA, 1531 bp, Homo sapiens
tactgtgaaaaggaaatgatacccttttcaacctaacaaaagagttgatttgccaagaaaatgggctcaactggaagaagctgactaagaagaaatacacagtcagtgcttttgttcccattcattctacctttgcagataagaatttttaaaaaatctctcctatgattcccacaaatacacagcattgctatttgaaaaataacaaagcacaatttgagtttcatatttgctgtttggctggagtgatggctattcatcttctctttacccaggccattgttcctgcccacataatcacagcttgaagagctcgcttgtgagttccttcctttgcaactgtggtccacactagctactcaattagttcatttcttggttgtaagaataaatagaatgtgtacatttccttcttgtttaccaatgcaacctgaaggggatccaaaaatttggcctggcttgagaagtaaaaaaggtttaggctcacaacagataaaacgtatcccaagccgggacaccacggtgctgcggaaaaacccacccttgattttcccctcgtcttgtcttcagttcagcatgatgagctggaaagctgcaaacgctgtagtgatgatctgagaagtgaaacagaaagcaagtgaggggaagcaggagtctgtacacatgtgccctgaagaatcctttgctttcgtctttcctttttcggctttaagtgctcccgtcacaccagtgattcgaacatttcagagaaacacaacggagggaaggagcccggccctgccttgtcagcgccctggaagacctggcttcctccctgacactcactctggggagggaagacacccgtgcgcctcgctccctcgtggccagtggcttccccggtgggctagggcgtgtcagcagggcgtgcccaccgagggagcaacagcgattcccaggcctaaggcttttcaaatcaaaagcgcctgacgctttttacaaccgagcagaagagggctgttccaggtggctgacgcttcccgtggcggggagggggttatggagaacgtggatgaagctcatcgtgtaagacgggaaatgccactgcaagtgagcgtccctgcaccaggccgcgtcccgcccagagtgaggcacggccgccccctcgctcagaacctgcagcccggccgggctgatgcgggaagccggccccgcctgtgagcgcgcagttctccctggagacgggccaccctcaccctgtgcctgcgtcccctcccagccctcgtccctgctctctacccacgacccggcctggggtgcctcggacggatctcctgccatttcctgcattctgcaggagcactcattgaaaatttgggtggccttgcttatttattttcctggaatgcagtgggttctatttccgtggtattttctcagcagtgcagcgtttccatttcaaactacaagaagaagaagaaaagccagtccccgtcagcacgcaaacacacaacagaaaaaaacgtcccgggtttgactcgcagtcctgcct

SEQ ID NO: 242451 - DNA, 459 bp, Homo sapiens
aggtctactgcattaatctaagggactaatgatgaaggtgtgacctaagacaacagaatagagaggacggactagatttcagatatattcagaaggtgaaatcaaaaagacttaatgacagattgaatgaattgtaagaatggaaagaaggaaaaataaatgattctcagctttttgatttaagaattgggtagacgccaggtgttgtggctcaagcctgtaatcccagaactttgggaggccaaggtgggtggatcacgaggtcaagagattaagaccatctttgccaacatggtgaaaccccgtctctactaaaaatacaaaaattagctgggcaccgtggcgcacgcctgtagtcccagctactcaggaagctgaggcaggagaattgctggaacccaggaggcagaggttgcagtgagccaagattgcaccactgcactccagcctgacaacaga

SEQ ID NO: 242452 - DNA, 750 bp, Homo sapiens
agcggtggggaccgggccgcttcttgttcggcgtgggcggctcctggcagacccatcccgcggtgcagccgccggcccggtaggcgccaggaccccgagcctcggcggcggcggcggcggcggcagcgctgccttcactcacctcgtcctcgctcccgtcctaccccgttccgcgctgggtggagtccaagtctgattgcgagagtccggaacgccgcctcgggggcttgactccagccccggggatcgagaacggcgcccaggggtccctacgtctgccttgggggctcgagtcccgccctgggcgtccgtgacgtcgcccaggggtctccacgtctgccctggaacctggagagccgccgtgggggccccggaagctgccccggagtccccacgtctgccctgggggctcgagtccagctctgagggtcctgaagtcagctttgggggttcgaacccatccatcccaggggtccctgagtctacattaggggctggagtccagccttgagggtctccatgtctgccttgggggccttgatgggatccagcggttctgagtccagcctcaggagcccctgcggtggagctctgagtggggcaggggcctgggagatgccagaaggatgagagcagggcccccctggtccaggggacagtaagaggtagccagtcccagagaagcgcccccacaaactgttacccgtggtgtgcaaagcgtcctgcaaccccagccctcaccaggacttc

SEQ ID NO: 242453 - DNA, 695 bp, Homo sapiens
  misc_feature (1)..(1): n is a, c, g, or t
  misc_feature (54)..(54): n is a, c, g, or t
  misc_feature (60)..(60): n is a, c, g, or t
  misc_feature (113)..(113): n is a, c, g, or t
ngcactctagtatagcacacttccatgatctaccagggaatataaggtctcttnggctcnttatagggcactatctcactcatagatctatgattaccctcatgcctatcacntcctgaggagacacaaatattcagaccatagtaggcagattagaaaaggaagaaggaagagagaaagacccagcatatggtgttcaagaataaaagcaaaggaattttgggtacaaaatgttacattctgtgtaatataaccagctgccatacttcccctgggaaatcttccataaaatatgcagggcttatgaatgcttttggtaaggcagatctgtctttggggagttcaaagaaaagaatgaggggacagaagaccttataaataattaaatgaatgaactttttaaaagtaaataaatctatatcccacgaaacagacggacactaagcaactaagattatcttccctttcacatttagcaggggaaatggtgtcctctcattatagcatttccctgatcagcaggatttaaaggtaatgaataaggtgccactcttttctctgcttagataattcacctaataaaattaatttctgaagttaaaagtaaaacattaaaaaaattaaaccttttacaaataacgtatataaaatgttatcaggtaagtaaactttggttttgtttgtgactcgtagac

SEQ ID NO: 242454 - DNA, 649 bp, Homo sapiens
  misc_feature (114)..(114): n is a, c, g, or t
  misc_feature (145)..(145): n is a, c, g, or t
catcgttgtagcctcagtatcacctcatgatctccaggaaatagtctctgctcttatagcatatccccatagtctatatactcatgctatactcccagcccatcctatcatccntgtggtagattcataatgatttgaggagccnaatatcagacatagtagcagatagaattttgggtacaaaatgttacattctgtgtaatataaccagctgccatacttcccctgggaaatcttccataaaatatgcagggcttatgaatgcttttggtaaggcagatctgtctttggggagttcaaagaaaagaatgaggggacagaagaccttataaataattaaatgaatgaactttttaaaagtaaataaatctatatcccacgaaacagacggacactaagcaactaagattatcttccctttcacatttagcaggggaaatggtgtcctctcattatagcatttccctgatcagcaggatttaaaggtaatgaataaggtgccactcttttctctgcttagataattcacctaataaaattaatttctgaagttaaaagtaaaacattaaaaaaattaaaccttttacaaataacgtatataaaatgttatcaggtaagtaaactttggttttgtttgtgactcgtagac

SEQ ID NO: 242455 - DNA, 339 bp, Homo sapiens
tcgggttaatttatgatgtaatgtgtttcataagaaagtcctactcaccatgaagtcacttaattcagaaattacagagaacaataaaaaccaagctgattgttggcaaacttgaatgaaaaatttatacctggaggttttcctttctaataggcaaccatatattttatggagctgaaacttttaggtttgctgcttttgtcgttgtcttcaccatttctcctttccttaaaagaaacaatagttttatatattaattttgatgtgctaagtatgtacaacttaattttttaaagaacgtttttcagatatatacatgtatataaattcatgctatac

SEQ ID NO: 242456 - DNA, 682 bp, Homo sapiens
gctactcgggaggctgaggcaggagaatggcgtgaacccaggaggcggagatcgtgccactgcactccatcctgggagacagagcgagactccgtctcaaaaaaaaaaaaaaaaagaaagaaagttctgttttgtagaatacaacattgtcatttttatgtttcttccttttatgtactattagcatttgtcttaactcatgtctcttccagcacatcctatgtatggatgcagttttccttccactatcatatatttcttgtgttctatattttcagtttgatcttcagtatcaagaggggtcttattataacagaataaaaattttcattttttcagccaagtgtaaattttttcgggttttctaaattgtagctttttcctgtatttatttcttaactataaaacaaagcagacatgatatatgtcctccccttactattttaactcttgaaaacttcaatacttttgaaagtttgcttaccttataagtggtctaagatattttcactgtggatcttgaatttctgctgagttttaggctacagctaaatagtctcatgttcctcacctatttccttaatgggtggtaacccctcaaaggagatgaccccttctaattcctttcttcgtgtgcctcaatttttgcttaaaattttaggattgcattcctagtgcaaaa

SEQ ID NO: 242457 - DNA, 631 bp, Homo sapiens
ataattcatactggagagaaaccctacaaatgtgaagaatgtggcaaagcttttaacctatcttcacaccttactacacataagataattcatactggagagaaaccctacaaatgtgaagaatgtggcaaagcttttaaccagtcctcaactctttctaaacataaggtaattcatactggagagaaaccctacaaatgtggagaatgtggcaaagcctttaaccagtcctcacaccttactacacataagataattcatactggagagaaaccctacaagtgtgaagaatgtggcaaagcctttaacaactcctctattcttaacagacataagatgattcatactggagagaaattctacaaacctgaaagttgtgacaatgcttgtgacaacatctcaaacatttccaaacataaaagaaattgtgctggtgagaaaacatagaaatatgaataatgtgacaaagcctttaaatggttatcacacttgtttgtaagtagggtaattcatactggagaaaacatcacgagtgtgaacagtgtggcaagacttaaacaatgctcacaccttattgcacaggaaagcctttatacttgagaacaaatgtgcaaatataaagaaagtaaaa

SEQ ID NO: 242458 - DNA, 394 bp, Homo sapiens
ctagcaaacatttatagaacgctcaacccaacaatagcaaaatattcttctcaagtgcatataaaactttctccaggatagatcatatgctaggtctttaaaaaagatattgaaaccctcatacattgctggtggaaatgtaaaatggtgcagccattttgcaggacagtttgagggttcctcaaaatgttaaacatagacttaccctgacccatcatttcaacagctggatgtatactcaagaaaaataaaaacctgtgtccacacaaaaacatatacaaagatgttcatggaagtgtatttataataccaaaaagtggaaataacccaaatgtcaatctactgatgaataaacaaaatctatcaataaatttattccaaccaaaaaagaaaa

SEQ ID NO: 242459 - DNA, 667 bp, Homo sapiens
cccattggtattgcccatccacagcagtcgtagcccatcacgagtggataaagtaggtggttagctggacttgcacatgacttgtttcgtgaacagtagtgcttagagttgtgatctagggacccagcgaacagtgtgtgagggacttcaaccctgcctctctccggtatgtgctgtgcctgctgtgccccccactccagtgttctccttggggctcctgaggcagctcccagtaggaggcctatcgttgttggcaccccaagggtgtccctgatccctaagtagaaacttaagcaggtatttggacaaataaatgagtgaaacaccttgtgacgttgaggcctgtggcacttccccaatagtgtgttagtgtaaaaccaccgtgtatgatgcctgttggtcccagcactttgggaggccaaggcatgtggatctcttgggcccaggaatttgagaccaccctaggcaacatggcgagacctcgtctctacaaaaagtacaaaaattagccaggtgtggtggtgcgtgcctttagtcccagctactcaggaagttgaggtgggaggattgcttgagccctggaggttgaggctgcagtgagtcatgattgtggctctgcactccagcctggacaacagagtgagacctcgtcccttaaaaaaaaaaa

SEQ ID NO: 242460 - DNA, 292 bp, Homo sapiens
gtagaatcaggaatatctctccatttttatacatataatcagaacaaatatggtatatgaagaaaataatttccaaaagactatatatttttattaagagtatacacatagccattaatattgagaattgctaatatactatttgtctttctacaatctcagctaaacaaaatgtataagtgaaatgtgatttcattcaatgaaaacttatatgcacactttgagaatactttgtataaacacatttaaagattttgatatgaataaatgcaaacagttcatttcttccgtt

SEQ ID NO: 242461 - DNA, 595 bp, Homo sapiens
ggggactttgggccatattgttggattttctgatttttctacagatgccagaaagcactcttgtaagtagtaagagtggtcttcaaattccttggagatttgttcatttcatccattgggactccactgagtgaaaggggaaggaagggagggaggccagtgtgtggaattcatttcattttctgggaacaccagctgattttgtcagcaactgaaaagctatcaaacaataacatttcactgcagttgacttgggagggaggcaggcacacctgctctgtgaccatcaaaggatgacaggtcttgaccaaagcagcatcctcggtaaaaaaatgtatgccttgtccctccaagttcaaccctctcaaatattaaaatacaacaagagcctcctttgggggtcagtaagcctgaatctcatcatttatcccagagaaaataaaattatgtctagaaactcattcattattttgccagttccaaattgtccctatcttgccttgctggctctttgagttgccacgtcattagaaaataaggtatcattgtacgtgaatcacctggttttctaggttgttacctataaacatagctg

SEQ ID NO: 242462 - DNA, 609 bp, Homo sapiens
taaacagccaatcaattttatgctttaattcaattcccccacattttgactttctcatgtctatttttaaattggctatattttatgatgctgctatagttacttttcatagacttgcatcttactcctcgtattatggatataagaggcttacacaaaacaagcgtattaatttattctgcatttgcctatgtatttgcattggccactgagttttgtaatgtcaaactttttctctttggacgttagcataattttcttcaggataaagaacttagcatttcttgaatgacgagtctagtgatgaattctcaccatgtttccttttctttttgtaaacgatgttatctctcaatctttcaaggaaatcttttgtgggtacagtattgttggttaacttttttcctttagcactttatgtcacttcactccctcctggtatgtacaatttctgatcagaagtctgttaacaaacaaattggaagtatataatgttatttgcttttctcttgctggtttcaggggcctttctctttgtagtatgtttttgagatgattatatatatatatatatatatatatatatatacacacaccacacaccttggg

SEQ ID NO: 242463 - DNA, 584 bp, Homo sapiens
taaacagccaatcaattttatgctttaattcaattcccccacattttgactttctcatgtctatttttaaattggctatattttatgatgctgctatagttacttttcatagacttgcatcttactcctcgtattatggatataagaggcttacacaaaacaagcgtattaatttattctgcatttgcctatgtatttgcattggccactgagttttgtaatgtcaaactttttctctttggacgttagcataattttcttcaggataaagaacttagcatttcttgaatgacgagtctagtgatgaattctcaccatgtttccttttctttttgtaaacgatgttatctctcaatctttcaaggaaatcttttgtgggtacagtattgttggttaacttttttcctttagcactttatgtcacttcactccctcctggtatgtacaatttctgatcagaagtctgttaacaaacaaattggaagtatataatgttatttgcttttctctctttgctttaaaagagcttttctttggccccgataataaaaaattttttgtcccccccacccgttctttttttt

SEQ ID NO: 242464 - DNA, 533 bp, Homo sapiens
agccaattagtaattgtgtaattagaaggatgtggacaggcactttaccaaaggagatatgtgggtggcaaataaatacatcaaaagctatttaacagcattattatactgggcagaataatggtctccaaaagatttccaccccttagttcctggagcctgtgaatacgttgtcttacttagcaaaagagactttagagatgtgattgaggttaagatgatcccagtctaatcatatgagtccttaaaaggtgacaacttttcctggctgcagtcagacatatgtgaaaacagaagaagggtcacagagatgtgatattgctggctttgaagatggacgaaggggagccacaaagcaaggaatgctgggagcctctagaagctagaaaaggcaaggaaagattttcccctagatactccagaaaaaaacacagccttgcctatgctgtgatatcatcacagtgagacttgtatcagacttctgacctacagaactgtaaaataataaatctgtgctcctttaaactgctaaa

SEQ ID NO: 242465 - DNA, 145 bp, Homo sapiens
ctggaagcccctactgcccacctgcactgggttcagggcccctctgggagatcctgttagagcgctcatgatggtaatcatctgttccttccctttgagacggggcacaggagggcactcaccacaggtgtcttgtgcaccactg

SEQ ID NO: 242466 - DNA, 459 bp, Homo sapiens
actcttcagggatctgatttatttggtcacacacatgcctgccgttaaaatgaatcagatctccatccttttcagcattcctagaaagggctcaactcagattcttcagaggtccttgagaacttgtcttagacaatgatgctcgctgatggagcagagggcacaatgacgatttgataataagtactctttctcttctcccaactgacctcctgaccatggctcatccattgacctaagtttgttcccatgaactgagagttgcctcaacattactgctcctttaccaccactggagaaatcctggacaaagactttctttatgaaagtggagatattcatgtgacatgactggggtagatcagtggctcccagcctccctctctattagaaaacataattgtgtgtcagtgatggcaacagagagaaatgccatctggtgtgctcaaaaaaaaaaaa

SEQ ID NO: 242467 - DNA, 590 bp, Homo sapiens
tatggagtttctgtgtcgccaggctggaatgcagtggctcgctctcggctcactgcaacctctgcctcctgggttcaagcgattttcctgcctcagcctcccaagtagctaggatgacaggtgtgtgccatcatgcctggctcactttttttttttttaattttagtagagacagggtttcaccatgttggccaggatggtctcgatctcctgaccttgtgatctgcccgccttggcctcccaaagtgctgggattacaggcatgagccaccgtgcccggcctattacatagttttaaatagcttgaaggagaatattgaatgttcccaacacagagaaatgataaatgtttgagatgatgggtatgctaactaccctgatctgacatttatatacactatgtaccccatgaaaatagacagttatcatttatcaatttaaaaaatacataaaataaaaacataaaggaaaaaaaagacagcaagaaagaagtatctggagaggaatctggtgccttagaaaggtaagggaagatgagtctgaccctgaaaaagaggagaggggaagagcagtgtggtgttcatgatttt

SEQ ID NO: 242468 - DNA, 536 bp, Homo sapiens
tatggagtttctgtgtcgccaggctggaatgcagtggctcgctctcggctcactgcaacctctgcctcctgggttcaagcgattttcctgcctcagcctcccaagtagctaggatgacaggtgtgtgccatcatgcctggctcactttttttttttttaattttagtagagacagggtttcaccatgttggccaggatggtctcgatctcctgaccttgtgatctgcccgccttggcctcccaaatagcttgaaggagaatattgaatgttcccaacacagagaaatgataaatgtttgagatgatgggtatgctaactaccctgatctgacatttatatacactatgtaccccatgaaaatagacagttatcatttatcaatttaaaaaatacataaaataaaaacataaaggaaaaaaaagacagcaagaaagaagtatctggagaggaatctggtgccttagaaaggtaagggaagatgagtctgaccctgaaaaagaggagaggggaagagcagtgtggtgttcatgatttt

SEQ ID NO: 242469 - DNA, 201 bp, Homo sapiens
aattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactg

SEQ ID NO: 242470 - DNA, 199 bp, Homo sapiens
agaaatgctgattatgtgagttctatagcatgtttattttacaaattcctgtcgcatagcagaagcctctgccaactcccatacatggctaattgcataacgctgcttctgtgagctaaaaaggtgtttgctttaaaatgtttatggagaatgctcttatcttgcctatctgattaaaattcattcatgacatgagcaa

SEQ ID NO: 242471 - DNA, 227 bp, Homo sapiens
caaacagttctacgactcactacaatcttcatccatgaaaagaaaaattgataaattatacctcatcaaaatgaggtaaaaaaatgaaaattggggtaaatatttgcaagccactttttcaccaagtgaccggtatctacaatgtagaaaaaagatctcaaaactttaaaacagtaaaatgaataaatatataacttttattcaatatattactgggaattccagtc

SEQ ID NO: 242472 - DNA, 263 bp, Homo sapiens
ggaacaggatctggcatatagcagaacctcagtaatttcatatgctctctctcagttcatatactatagtacatagtatctatctatagatgtatgtgtacagatatcatacataatattttacttttttcatagataaatggacagcaaatctaattcactttattttgcatatttactattgtatttatttaaaagatttagcctttttactttaacttctacttatgactacctagaataaaaatgtaagacataataaa

SEQ ID NO: 242473 - DNA, 421 bp, Homo sapiens
gacgaatggacggattcgagcgaagcttatttcccttctcctaacgcatctacctataaatagcgctcaccgcgctgagtcaccaaaaccccgagtttccccaaatagcgcgtaacgactgctgggatcgcgtccctcggggctctgtgacagactccaaccacacacccgctgggctggactgcgggcccacacggcccagcgggtctctcaccacccggcgccccagggacgcgggcgaggccgcggtgtccggaccgagtcgacagcgtcggacttcccgcgcgcggacggcgctctggggaaggaggagccggcgggcggctggacctggccttgactgcgcggggtccgcccccgccccctcgggagcgcagagttgcggggggccggcaccagcctccgccctgcgccgcccgct

SEQ ID NO: 242474 - DNA, 594 bp, Homo sapiens
agcttaatagtagtttttaatagtcattgactggttttaacagtctaatatttttgttcagggaaaaagtttgaattctgcaataaaattaagaaaattttaattgaaataataaaaccatctcagtttattatttggagtatgccaagaaaagcccagggaataaatagaggcaggtgtagagaaccaaaaaataagaaaaaaaattttttaatctacataaaacagaaatattaaacaaatgattaaaaagtgcctaaatacagaaatgtggggaattctggcagagtatcctgtgagacttcttatgttgtctctcacttggaagatgttatggtgagacgaatcatgtgattcaggaaaaaaaaaattgtggagcaggagcttctaaattaaacataatcatcttgagttttgtgctgtgaagaaacattcatattgggatagtacaaagaggctggacctgcaatgaggatgcctgaattcttgactgaactccaccattaattaagctaacaacattcattgagtccaataatcacaaagtatcagactatttcacttctttcattgattagaaaaaacataaaatta

SEQ ID NO: 242475 - DNA, 466 bp, Homo sapiens
gagaataattgaaggagctggctcctagtctgttcccctgcccactagcaggtgacctggggcaaatgtcataaaagcttagcttctttatgagtaagatggggatagtaattcctgccttgcctagatcactgggtgttggtgagcatccagtgaatttatctgaaaacacaaagtgttcttgaaatgtaagatataatgagccactgcacccggccttgtgttccttctttacttcactttttcttccttgtaagtgttcaggtcaattcctcttgattgtaaaacaaaacaaagcaacaataaaaaaacacaaaacaatcaggaaaccactaaacttctgagatatctttctgacagcccaaaagatggtaggaagagaaaagtttgcttgtagattttagtgtgcattttttttgtccccaaggtgactgtcagtctgataaaggttaaagcaatggtatga

SEQ ID NO: 242476 - DNA, 530 bp, Homo sapiens
caaccaatgctatatttttggagaaatctcacgagcaatatggaacattagtgagtgttgccttttttagtagctttcagcagactccttcaagagaagggcaactctacgttggaaataactgatttgaaagcagagattaaagaaagtaacgactaggtaagagaggatctctttacctgcaaccaggagtctcataacttggaaccttgctgaaataccccatttactttgtgtactcaggttgaaactagtacaagtagagacagagaggtggctttatcaggagataggacggccatcccaagataccagaatggcctctaggtggcatctctttcctcagctgttttgaattgtctcaagacaatgttttacctatgtaggggattccagagtggatgagaataggggtgaaaataagatttcaatttacaccttttagtattgctttgatgttgtaaactacatattacttatttggaaaaataaatagaaaaatattgaataaaaacaatttaaagactcta

SEQ ID NO: 242477 - DNA, 430 bp, Homo sapiens
catgttttaaatctctttatattggagattagtaatgatattatttggatgataggagaaatttgaatatggactgaatattagatattgtattgtatcaagtttaagtttctgggtgaaataactatgttgtggtcatgtagagaacagccttgttcttaggagacacatgctgaagtatttggtggtgaagtgtcgtgatgcttacaaccaattctcaaacagttcagaaaattatacacaggtgcacatttgtctctttatctatttatctgcctatctatacacaaaatgtgtatacacaaatatttattaaaatatataccctctttttctgtgtactatatggaaggggtatatgaataattgctatactattcttgcaacttttctaaattattgatatttgtcaaaataaaacatttgtgag

SEQ ID NO: 242478 - DNA, 391 bp, Homo sapiens
caaatacatcattacccagcctcaggaattgttttatggcagtttcaaacagattaatacaatcccagttggccaaatcagcaaaatcaacccaagcagccaaatatctcatgttgaaatggtactaaaatttagtttttctgatgtagggcttggttctaagtttgagataatgaatatcttgagtcatatgtatgaatacatattggtatagacacattgtacaaatataacatttgattttatattttaaatctttgttgatttgtgtatacaacattttttagtatgtgaaaaaatttgacatatacgaaatgaaacttgcatgtgccaatgagtgctaaaaatacaagactttttaaataaaagtgtatctttcaggaacagtata

SEQ ID NO: 242479 - DNA, 337 bp, Homo sapiens
ggccgggtgcggtggctcatgcctgtaatcccagcactttgggaggccgaggcgggcggatcacgaggtcaggagatcgagaccatcctgcctaagatggtgaaaccctgtctctactaaaaaatacaaaaaattagctgggtgtattggtgggtgcctgtagtcccagctacttggatgcattccagtctgggcgacagagcaagactctgcctcaaaaaaaaaaaaaaaaagaaatacactaacactaacaacggctgatgagaaagaaagaaagaaagaaagaaagaaagaaagaaagaaagaaagaaagaaagagaaagggaaggaaagaaag

SEQ ID NO: 242480 - DNA, 241 bp, Homo sapiens
acacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcat

SEQ ID NO: 242481 - DNA, 400 bp, Homo sapiens
cctttcagttgctgtcctaattctaacgcttgtctcctcttcacggtcaaagacctagaaacagttgtctacactggtctccatttcctacctaccttccctctcctcaacccagtaccttcatgtgtcatttaacaaagaaagagctctgagaaatgcgaaggcaatctcatctttgtgcaaccatcacagtgcacttacacaaaccgagatggtgtggcctcctacacatccaggctctacggtacagcctattgcccctaggctacacacctgtccagcacaagactgtcctgaatactgcaggcaactggaatgctgcagtaagcatgtgtgtatctacgcacagttagacacagaaaaactacacagtaaaagtatggtacaaaagattttaaaa

SEQ ID NO: 242482 - DNA, 472 bp, Homo sapiens
tatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttg

SEQ ID NO: 242483 - DNA, 607 bp, Homo sapiens
caagtgtactgactaacctcaaccaaatgaatttctaatagaactatataatcagaaattttatcctgattttctttttgcataagtaaatgaaattatttgaagaaagaaaacttcatctacaattccaccacctaataccacgtcacatctttttttcattattcaacattcccttcaaatccatatctaagcataaacagaattttcactcaaagacatgacccaggtcctatttctcacttaatttagacaaagattttctcaaactaagtcctatagggccctagtgctcctggatgtgcctcaggagccaccacaaaggaaacctgccagtaggcagccaagtgataaggcttccttctcccatccctgactttcctatccctattcccaattcaaccagaacagttatatttttatctgttttagattttgatgctctgcatacaattttaaaataaaataaaataaaataaaaatggtgtattactactaagcatttaaaaataaaagaatgttcccagcaccttgggtggccaaggcaggaggattgcttgaggccagtagtttgagactaacctcagacatagtggaccatgtctcc

SEQ ID NO: 242484 - DNA, 635 bp, Homo sapiens
tttagtagagatggtgtttcaccacattcgtcaggccggtctcaaactcctgacctcaggtgatccacccgcctcggcctccgaaaacatttggattacaggcataagctaccgggtctggccacaactttctagtctcagtgtcatcacaaccagtttccagcttctctgacttttcttagctaccctgttgtcctatcactccctgcctcttctccagggttcaacctctggtccacttcccttctcacacttcataggaaaataccactcaagatcattgcctcccctctcaccacaacctacatctctatccaaaaactcttgatattttagttcagactgtttttagctattttactgcagagttggaatttaagagtctggagcttgcaaatacaaactttcattgcacttgattgctgctgttctgtgaactctcattaccttttccctgggtggctgctatatatcctgactggtttctctatccctagtctcatttcagatccattctcaacactcctttagaatactttctaaaatatggaaatctgagtttccacttctgctactggcagaatagttcctataagaccaacccttccacaaataaaaacagtagactattgaaa

SEQ ID NO: 242485 - DNA, 782 bp, Homo sapiens
aagacagggtctcactgtgttgcccaggctggtctcaaactcttgggctcaggtgatcccccacgcacggcagctttgacacttacttgaccctttcctcctaagctctaccctgacgctggctgtgtgtcccagagacttaatcagaagctggaagaagggctgtgacgtgtgtgacagcaggaactgctggtcaacccacagccggccagcctgccgggacgccatcttggccccaatcttggcagggagaggggagtgtatcggactctggggagagcagctgcctgcacgggcagggtcctcccgtctcaggattaacgttctcaactgtatttgatttctcctcagccagagggggtaaggtggccttcccagaagcacaggtgggccgcgtgtcagaggccctggacagcctgtgcctctcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaataccaaa

SEQ ID NO: 242486 - DNA, 342 bp, Homo sapiens
aggtgaatggtttgtgagttggtcagttggatggagggatggatggatggatggaagtttggatggatgggtttagaagccatgaccccaatcggaccacccaaatgcaatatgtttactgagcacccctcctatgcaaggcactattggaaaatgcaagcttgaattagcagctggatgcctgatactaatgatataataacagctgagatttattgatttctcaccaaagcaggcactgcgccaactgcattgcatgaccgatctcatttactccttatatcaaccccaggaggtagatactctcgtaattcctgctttgcaattgtgaaaaccaagcct

SEQ ID NO: 242487 - DNA, 741 bp, Homo sapiens
taagtgtgggttttcccaagcataaataatttatgggactgtaagtggttacagccactttggaatgcaattagatagtatctttctgaatttaaagtgcatgtatccaacaattctacttctaggaatggattgttcaggaaataaaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagccagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctatataaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctca

SEQ ID NO: 242488 - DNA, 769 bp, Homo sapiens
caaagctcctggctccaacccctccttcctcctctgccccattgtcatcttgatcccccagaggtatctgctggtcagagcaggtgcaggcaggggtgggggtggattccctggagtggaatcccagagccttgtgctgttttaccccttccaactttgacatcctgcccaagaaaacctggggcaaggggtaggggctagaccccagactggtcctttaccagctcatcctagagaggcagagagcaaaagttcccaagaagactgtagtcctagctacttgggaggctgaggtaggaggattgcttgagcctgggacatcaaggctgcagtgacccatgattgtaccactgcacttcagcttgggcaacagaatgagactcttgtcttagaaaaaaaaaaagttttccagaagagaccttgagagtgcccctacacctcccatttgttgcataagtaaatgtgtatgagaccctatacagggtaatggttaagagcctgggctctgggttcaggcagatctgagttcaaatcctggctctgctgtcatactacctgcatgaccgtgagccaggttacttaacctctctgtgctttagtttcccttctgtaaagtggggaactagtgcctaccaaagtgttaatagtaaggattaaatgaggtaatgatgtcaagtgtctaacgcagacctggcacatccttgatgctcagtaaacatggcggtggcctagaaagactcagtggtttgccttaggggcccagctccct

SEQ ID NO: 242489 - DNA, 468 bp, Homo sapiens
cggccattgtgatttttagggtcagaaaattatttggaaatattttttattctgcaaatattttctatacattttttcttgagtgttttcccttagtatttagtaaaacttcttttgaaaatgctggcctgctgcacctgttctcagaggggcatgagaaaagaggattctcttcctagggctgtgggaagccccttgagatgttggaagcagggcagggcaggagaacccagggagggcacagagctgtggacgagggctgggaaagccatcccgcctccccagggggtctccgaggagtgctgctgtggccaaaccaggggggccactttgtgctttctgtttaggtgatgggatgcttctatctcctcagcaccccacaccaaatcccctgttattgccagatgatgtgcctaatgatcaaattgcttggaactcctaataataaaactttaaatctatccattc

SEQ ID NO: 242490 - DNA, 377 bp, Homo sapiens
tgtgattccttgcagcataataatccttataatttgagaaagaatactgtatttagatggtttaagtaggatgttaaacattttcagaaaatagtgtcaatacagtatttgtttctaacgtagagagttatagttttatgagctttacttattagttagagctatgcctctggaataagccaattagaggtttgttcaagatcagtgttacttcagtagagttctgtagatacacacacctccccctccatcaatcaccctaacaccctacatacctagagagaacattgagatgaaagactcttagtaactgatctctaagcttgcttcaggttgttggttttctttgttttgtttgtttgttttcctgagtcctt

SEQ ID NO: 242491 - DNA, 516 bp, Homo sapiens
cactccagcctgggtgacagagcaagactctgtctcaaaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacgagtaaaacattctttggatgatattcagagccttattagcactgcatctgaataataggtcattttgcctcactcatttgccaaagtagccatttctaagttaaggaagtttttagataggctcatagccttgtatttcgttttagattgtaagctcaatggtagggatactatattggtaattatgttttcatatagcaaccaccacagtatattcttggtgcttaataaatgtttataattgttaacaataacctgtt

SEQ ID NO: 242492 - DNA, 427 bp, Homo sapiens
ctctaggctctttaatttctccattgagcattgtgtgagctccgctgagcattgtatggagggtcagctgccctggctggagatggttttgaggcttgttccttcgtggaaacatctggatgcagaagttaggctgtacaactatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaaggaagattggaatagcacaggcagccgaataaggattttaatgaaacattggagaatggcttcaagttaatctgtgaatgctttgtcattgtcccatccctggacacatta

SEQ ID NO: 242493 - DNA, 322 bp, Homo sapiens
tgagaccattgcaatgggagacttaaaagtggtataaaatgtactttgggccaggcgcagtggctcacgcctgtaatcccagcactttgggaggccaaggtgggcggatcacgaggtcaagagatcgagagcatcctggccaacatggtgaaaccccgtctctattaaaaatacaaaaaaattagctgggcatggtggcgcatacctgtaatcccagctactcgggaagctgaggcaggagaatcgcttgaaaccagaaggcggaggttgcagtgagccaggatcacgccactgcactccagcctgggcaacaagagcgaaa

SEQ ID NO: 242494 - DNA, 503 bp, Homo sapiens
tcggcacagaagacccagcagccattgtacatggggacagttccacaccctggtctccagttgcggtgctaggatggtattgttctgtgctaggaagtctcctgggaacccagaatgagttggtggggaagacagcgggtcactgtggacccatccaggaggggccaggataggcttggcctcatttctggggacatcattggagacttgaacacagagacacgtccctatcactctggcaaggccagagggaacatgtccccttatggtagagtctatgttgtgtgatttttgtgctcttgtttataatttatgcaaaccaccaagaaacccaaaccagtctgatgagtgaaaattatgcagatgctgtatggccccacaggtttctgtggtaaagaccagttggagaatgtaggagatactatgtgagtgaaaatgaatagagatccttattccactccttaatggcataccaagatgaaattaaaatctcttacaaatga

SEQ ID NO: 242495 - DNA, 367 bp, Homo sapiens
tttttaatagattactgacagaaatttctcactgctctgaacgagtttctgaagagcaggaaagacatgctgctgaagtggcagttcatttttgaagttcacaataatccactattaagaatttctacaagtaccctgaggtggtaaaaggtcaaagcacaggagttgagattactttctgatagtcacatacctcattccaaaatgtaaatccaccaatcaaaaacagaagagaacaatggtagacatgggaattccaagatggtctagagcagtgctctttaaactacaggtttgcaaagaaataaggagcttataccagaacagaaagcaacacattactttgaaaaaggcctactatcagaac

SEQ ID NO: 242496 - DNA, 691 bp, Homo sapiens
tggactccagcctgggcgacagtgtgagactccgtctcagaaaaaaaaaaaaaaaaaaaaaaaaaaaaagaaggcttgataacatttgtgcattgtgcgtagagtggttgcaagtgcagaggaaaggaatgaagatcgagggaggacgtaggagggcaattaatacactaggctctcctcaagcaggagagataggatagggtaaccatacatgcaattgcccagggcagtgctagttcacaccagtttatttacggtataatatctggatacaggatacaggataaaagtggataataatgcccaattttaatcttaaaagagagcctatttttgaataattgaattgattaccctaatcatgatgcaaataaagaagttacttgtgggaaaatatggcaaaatataaagaaataaaagatagcctggttggaaaggaagaaataaacctttgtttgaagatgacatgattgtttatgtagaaaactgaaagactcaacaacaacaaaaaaacctcctggaactaataagcaattacagcagggttgtaagagacaaggctagtatatgaaagttcatcacttttctatataccaggaattaacaagtggaatttgaaattaaaaacaatctcatttacattagcacctcagacaaaacaaaatacttagatatacatctaacaaaatat

SEQ ID NO: 242497 - DNA, 485 bp, Homo sapiens
attgagaaccaaggactttatatctggccaatctgtcattcaagtatagacgttattttaaaaagtttcaaatatgcaacaattgaggaaataacagtaactttcctaaattaaaaaagtttaaaataaaagagaatcatatacagaaacaaagcaaatatagtcaaatacacataaaacttacaacaagggttttcacattatctcacaaagcaaagacagactcaatttatgctacacagggaagacaaacaaaaacagattcagaaaggtgaaaaatagaatgatggcagcagcatggcaggcaaatgccatttccatatggaaactaaggaatacatttaaagcaaggataagaagcaaattcatggcttcaaaagctttatcaataaaaatgaaagagtgaaaataaatgaattaaatccttgacttaaaaatctaaataaagaataacgaaataaagcaaaaaaagtacacgaaaggaa

SEQ ID NO: 242498 - DNA, 310 bp, Homo sapiens
ctccagcaggacgatgcagtggtagagggtcatgcggcggcggctgcggccctccttgacgttgaaccagcagaagatgtagatgatgcccacgaccatgttgtagatgatctcctcccacttggacatgcagaagtccgtctccccttggatgacccagaaggtcatgacgcaccagtgggccacgatgaagatgccaaaatagagcttgtagacgctggcgaagagcgcgaaggccaggccgcgggcggcaatgctgaacaggtgccacagcacctgtgccacggcgcccttgtaggacagcggccgc

SEQ ID NO: 242499 - DNA, 483 bp, Homo sapiens
gcatcaaaataccagcttttcatcttttctttgagactcaggagggccaaagcaacagccttttgcttttttttttttttcttcccttatcaagggttgaaggaagggagcttactgttcagagacaccaaccccctcccctaactcaggctgagaaggaaccagccagctctcaacctcctcctggttgtttttctttgccccccaagtttatttttgttttctcccggcccccaacctctgaagccattttatcatctgtcatgtgccacctgaacctccagtgaaaacaaaaacaggctttcctgtggtcttggaaaaaaaatacaaaaaaattagctgggcattgtggcatgtgcctgtaatcccagctactcaggaggctgaggcagaagaattgcttgaacctgggatgcggaggttgcagtgagccgagatcccactgctgcactccagtctgggcaacagagcaagactccatct

SEQ ID NO: 242500 - DNA, 562 bp, Homo sapiens
ccgacaccagctgcctccaccatgctgccgaagttcgacccgaacgagatcaaagtcgtatacctgaggtgcaccggaggtgaagtcggtgccacttctgccctggcccccaagatcggccccctgggtctgtctccaaaaaaggttggtgatgacattgccaaggcaatgggtgactggaagggcctgaggattacagtgaaactaaccattcagaacagacaggcccagattgaggtggtgccttctgcctctgccatgatcatcaaagccctcaaggaaccaccaagagacagaaagaaacagaaaaacattaaacacagtgggaatatcacttttgatgagatcgtcaacattgctcgacagatgcggcaccaatccttagccagagaactctctggaaccactaaagagatcctggggactgcccagtctgtgggctgtaatgttgatggccgccaccctcatgacatcatagatgacatcaacagtggtgctgtagaatgcccagctagttaagcacaaaggaaaatatttcaataaaggatcatttgacaaaaaa

SEQ ID NO: 242501 - DNA, 394 bp, Homo sapiens
ctttggggtgatggatatgttcattatctagattggttttacaggtgtgtatatgtatatatacatatatcaaaatgtatcaaattgtatattttaaatatgtacagttaattgtattttagtagatttcaataaagttgttaactttttttattgaatttatgattttttatagaggcttgatgtatttgtgatattaagatttctagacccagaacataacctggttttttttttgttgttgttttttgttttttttgcctttgggcccttcaataagttaggtgtttttgttttttaaggtataggtcctgtcttttttaacctatttttttactattatgttttatgtgaatctgcttttttccatttctatttctagtgtttattacca

SEQ ID NO: 242502 - DNA, 780 bp, Homo sapiens
gaactggatcctgcggaccgcttctcagcggcttcacccccacaccactcgaatgcacagatcgggacacctcagctgggtgacttccctcgttgcaatcggcctcgggagcggtgcggcgtgtaccgagcggcgcccctgggctcagcgcgctgcaggcgccccgggcggatccttcaccgaggcaggactggggctggcgccagagccggtgcggagcggtgttggttcaggcgctggcgacagtgctatggccacggcaggggccgcgtgcgtctcagcggtggcgccttcggaccctattggcgcccgggacttaagcggggccgccgctgctggaccaggacgaactggagaaggagacgcgggccgccacggtgacctcgggcgtagggccggcggcggcgggcacgctggtggaagcgcgggccgcggcaggggaggacatcgggccgcagagaaagtgccgatggcctggggcagcggtgcgagggtgggaaaaacgcaggatattgcatcatagagacgcggccaccttcgcccctggagagcgccagtctcaggagcgccgcaccggtcacgggtggaggtcagccaggcctccgtaagcgcggtccccttccaggagtagccttcgcctgggctcttgagtagatgccaagtaattccgcatcgtctctctagatatctgcgctaaaggccacccggtctccttatcagaggggcaaaactctcctcgtgggtcttcatacctaataaaagtcggcatcaaaccacttt

SEQ ID NO: 242503 - DNA, 377 bp, Homo sapiens
aaaagcccctccatcaactctaaggattattatatccttagtagaaataattgcacgtgcccacactgatagtggaatgcatttcctggagtgctgcattgagatagattctgaggcaatatcaacattcataggaaaaagccctatgatcaattgttcacatgtgtatatacgtgcatgtgtgtgttgctgggggcagaggggattgtgaaccatgtgctgcatttctgccatctctcaatcagaaaaataatgaatgggtggccacaataacttgggaagcctgatcaccttattttttaataattataccccatccatacccacattgtattttcatcaaattaataaaagatgattttgcagtgtcctttttt

SEQ ID NO: 242504 - DNA, 993 bp, Homo sapiens
aaccaatgaaagtaaatagcctaagggtacaaacataagtaaatctataaattaaagcaaaagaatgataagcacaaattcaaggcagtgatttcctctagctacagagggaagggaatgaagtaaggaaaaggtgaacaaggagcttaaaagtatgataattatatgtgttggtttggccaaacagtcctggtttacctagcacagttctggtttgctgattgcctggtgtaatgattaatagcactgtcactccccaaattgtcattgtttggataatgaattatatgcatcctttttagagtaaaagtaacttttttctccttaaactggatggagggcatgtgggtctttatcattcttccttatacatgtatttttaaaatataatttaaaactagtcagtattttaaaatataatttaaaactttagtcagtgttagtcactgtgttagtgacaacacagtaaaaaaaaaaaatttgtaagataaataaatataaataggatccaaatgaaactcttttcatctgggtggatacagggataaataacatactatatgcctggcattgtattaagcttgttactgatattacttcatattcatagcaagacatttaggtaggcattattatctccattttacacatgaagaatctaagacacaaagactatacataatttaaccaaagtcatattatatgtgacagcgcagaatttgaacccaagcagtgtgacatcagactacatgctcttaactaccatgccagagcccataacagattttcttaaccttttttatgccacagatccctttgacagtctggtgaagcctatagagtcctttttagagtaatgtcttttgtacatcaaatataatgcacaggattataaataaaatcaattatactaaaatatggtaatcaaaatatttaacaaatgtatactatacctgtactttttattaatgcattaaataaataataaaatct

SEQ ID NO: 242505 - DNA, 375 bp, Homo sapiens
tgcacctgctgtgggctgtcacctgtcccctgcggggtctcataagcctcccagccgcccagccaaagagggccgagcctcgttgtaccgaggaaaccgagccgaagagcttgagtgtcagcgatgagtgggcgcgataccccagccccgaagggtggccgggcgctacctgcgcccacagggcctggggaaaccttgagtacgaatgccacgccgcggcttgtgggcgacaccaccgctgtcaccatgccccagggccacctggcaatgctgctcttttcccgtgacgttcagaatcacagggcctggggaagcagaaacgtccagctctgttaggattaataaacctggtgaatgggccacacaaatttgaaa

SEQ ID NO: 242506 - DNA, 400 bp, Homo sapiens
aggaaagaatcttaagagctgtgagacagaagcaccaggtaacctatgaggaaaacctgtcagattaatggcagatttctcagcagaaaccttacaagctagaagggattggggacctatcttcagcctcctcaaacaaagcaattatcagccaagaattttgtatccagcgaaactaagcatcatatatgacagaaagatacagttgttttcagacaaacacatgctgaaagaatttgccattaccaatggcaaactactaaaaggagctgtaagtcttgtggtggctctaaattttgaaacaaatcctggaaacacatcaaaacacatcaaaacagaacctctttaaagcataaatcacataggacctataaaacaaaatacaagttaaaaagcaaaa

SEQ ID NO: 242507 - DNA, 361 bp, Homo sapiens
acatttcagttgccaaaaagctaagtggagcctgatgagctagaaagagaaaggcatgaaacaaaactggggaggtttgcaggggatagatgaggtgggtcagtaaggaatttggattgcatttgaagcacaatgcagattcattaaagggcttttttaaaatttattttcatttttttatttttttagattgagtctggctgtgtccctcaggctgaaatgcaatagcatgatctcaggtcattgcaacctccacctcgctgaggcaggagaatggtgtgaacccgggaggcggagcttgcagtgagccgagagcgtgacactgcactccagcctgggtgacagagcgagactccatctc

SEQ ID NO: 242508 - DNA, 375 bp, Homo sapiens
gtgagaagctgcctttcatctggtttccaatggtgttaactagaaaaagagaaactaaaaagtttgcgttgagcagaaatatgtagtcaaggtattaaagcactaacagtgaacctaaaaaaggtatttgaagaaagaaggattcctggagagaagtttcactaaaaaatagcctacactgtaggacattgcgaacaaagagagttggctaaaatctggattatttgcaatggtacaaagtttttctatttgaacttcaatgaaaagttttttgtcaatttatccttgcactgaaactgtccacttaaatctaatgcatcaaagatctggcattgttaaggaagaaatccttgaactctaagcaggcctggcaaa

SEQ ID NO: 242509 - DNA, 436 bp, Homo sapiens
ccatgattgtaagtttccggagacctttgcagccatgtggaatggaatcatgtttttcccgggatgtcaaagataaactggagtttcaatcttgctatcttaacaagaacagagggagaacaaagaataaaacaagaaccaggggaagagatgcatggggcagaatccaagaaggttccaaaccaggagctttcagttacccttcctcacggagtcatggacagcgctgcttttctggcaatgacatgtgacaatacacaatctaggcatatactaggctgtaacgagatttgctctgaggacacatgctgtctgtgaaacatcttctgcttcactctgggaagaatgattgaatttctttagccacagttttgttttctgtctcaaggcgttcactgccaaggtagaagggattcagcatgttctaggtcaggtt

SEQ ID NO: 242510 - DNA, 341 bp, Homo sapiens
gtaaagaagttgcttgcttccccttcagcttctgccatgattgaatcatgtttttcccgggatgtcaaagataaactggagtttcaatcttgctatcttaacaagaacagagggagaacaaagaataaaacaagaaaataaagctgactatattaaaagaacagagactatggaaatgatgttagacaaaaaacaaattccagcaattttcttatttgagttcaaaatgggtcataaagcagtgaagacaacttgccacatcaacaacacatttggctcaggaactgctaacaaatgtacagtgcagtggtggttcaaattttgcaaaggagacaagagcc

SEQ ID NO: 242511 - DNA, 372 bp, Homo sapiens
ggtgattacagctaaaccgaattctgaaaataaaaggaaccctatgtctttgtctgctcaggctgcttctacaaacaactgtagactgagtggcttaaacagcacatactgtttctcacagttgtgggaattcaaagattaaaatctgggccagcagaaccagtgtctggtgaaggccctcttactggtttgcaggtgttcttgttgtatgttcacatggctgagagaagagggctctagtctcctactcttcttattaggatgctaaccccattgtgggaactccatcctcatctttcaacatgtgcatttgttgatgcaaacatgcagtgcacagcatcttatctaatcaagtcagttgtcccttgaata

SEQ ID NO: 242512 - DNA, 349 bp, Homo sapiens
agaatttgagggaaactttgaagcaggtgaggaaggtctgagtcagacttgaaaggcccctgaaggctgggcatggaggtgtacacctgtaatcccagccctttgggaggtaggggcaggtggattgcctgaacccagaagtttgggactagcctgggaaacatggcgagacatcatctctccaaaaaatacaaaaattagctggccatggtagcatgcacctgtagtcccagctatttgggaggctgaggtgggaggatcacttgaacctgggaagttgaggctgcagtgagccatgatcgcatcactgcacttcagcctgagtgatggaatgagaccctgtctcaag

SEQ ID NO: 242513 - DNA, 427 bp, Homo sapiens
agacttcatagactttaaccctctgtattttcttttgtaaatgtcagcaggaagaagagctaaatgtcagtgaccagctgaaattatgatcctattctctatttagtattcctaaaattacatataactacctagtcctgaaaggatatggatatgaatatttgactaaattttgggtatttggggttctcttttcagcaaaaaggtgctcctgagaatttcattttgtttcttgtttggttttctggctttcaggagcttaaaacttccttcagaggaggaagaaattcatgaaatccttccctactccctacctgtggttattgcattttctgagtgttttctgtaagccaggccctgtgataagcccataatcaaaaaaattaacttcagtttataaagtgactggaactagggaaataagtaa

SEQ ID NO: 242514 - DNA, 456 bp, Homo sapiens
taccatcaatgaaagagagggtcactacaggtcctaagaagagaagtgacacgctcttttatgtaaaaaggatgactgtggatattgtgttggtaactgactgtaagaggacacttttaggaaaagtcccctctttagatattgactttatccaagaggaaaacagtagtaattcacacctcagtagacatggtgagaagtagttgattctacatattataaagtctttgggtttaagcaaccagaggaaggacttgccatcaaatgaaatggataagcataaacaggtttggtagtagctgggagatggaaatcaacaatttctcttgagtcatactttctttgagatttccattaggtatctgaagtaatcagaaactagccaggaaaactgaaatcattgagaatttaaaacaaagggaattgatacaggtaattgatggtagaaataacttt

SEQ ID NO: 242515 - DNA, 230 bp, Homo sapiens
gggaaatacttatatttaccagtttatcataaaggatattacaaaggatacaaatgaagagatgcggaggatgagatatagaaggaaagggtgtggagcttccatgccctccctgggcgcaccaccctccaggaacctgcacatgttcagctatctggaagctctctgaaccctgttctcttgtttttttgtggaagcttcatgatgtcagcattccttcctccaggtta

SEQ ID NO: 242516 - DNA, 389 bp, Homo sapiens
tgacagctgattttttttaactctccatagttttgacttttccaaaatgccatataattggattcatacagcctgtagtcttttcagattgacttttttcacttagtaatattcatctaaggttccttcgtgtcttttcacggcttgataatgcattctgtttagtacttaataatattccattgtcaagatgtaccacagcttacttatccactcacctactaatgggcattttggttgctcccaagtttgggtaattatgaataaagctgctataaacatttgtgtgcaggtttttgtgtgtagacatacattttcaacttatttgggtacagttgctgtattgtatgatcagagtattattagtttcgtaagaaactaccaaactg

SEQ ID NO: 242517 - DNA, 300 bp, Homo sapiens
acatcaaacatatcaaatgtttttccttctactcattgagctcaattacttcaattttgaatcaaattacactttttctagagacacattataggaaaagagctttgttatatttgaaattggttaggaatttaacaaggtgaggaactttaaaattgcttaagagtctaatagctgggggtattgatacatagaaagtgctcaatatatttttattgaattaatttgcatatgctttgtattcatgggcactgaatacaaattagccaattcaataataaatgcattggttgtctttta

SEQ ID NO: 242518 - DNA, 482 bp, Homo sapiens
tcatgaatctgtctccttcactgatggagggctctttgcggacatcttggtgtctccagcatctaacacagagttggacctcagggtcccaggcctgaccctgccgttcactggctccagtggccactctcagttatctgaggttagtgtgtgaaacaaaatccctacctgatgcaaggcaaaatgaggtacaaggccgggcatggtggctcatgcctataatcccagcactttgggaggccgagggtggtggatcacctaaagtcaggagtttgagaccagcctggccaacatcgtgaaaccccatctctactaaaaatacaaaaattagctgggtgtggcagcacgtgcctgtagccccagctacttgggaggctgaggcaggagaattgcttgaactcaggaggcagatgttgcagtgagccaagagtgcaccactgcactccagcctgggtgacagagcaaactccatctcaaaaaac

SEQ ID NO: 242519 - DNA, 614 bp, Homo sapiens
taaataaaatgcaacaaattcgtgggtggaagacatgaacatgacttttttctattttaaaaaccatttgatgtattctaaaaaaagaaaaagaaaagaaaaacagaagagaaccaactaaaagagcttcccagatgtccaatagatgctgcccgaagtaaaacgcatactctaatatttgttattcaaatttgcatgtaagggtttttaacctccctttattttatacttgtacagggtaacgtattgtaactgaaacactcctcctaatttattctggctgtgaaaagcctatggaaacattcacttccataggagtaatatgtatctaaacagtatatttagggaaagcactaatagaacacaaacaactaattactgatgcttttaaggaggaaccgcaacaataattgtgcactgtcttagataaaattaatatagaatttaatatttgtagaccacaaaaaagccctaatcgtggaccgcagattagaaagaacaggctttagcacactgtgtatctttgtagtattcagactcagctgccactgcgatttccatcagctgctgttaagtaaataatatactatggaaatatgactgagtaggaattg

SEQ ID NO: 242520 - DNA, 324 bp, Homo sapiens
gtctctgtcatctccccgagcctttttcctcatctgtaaaactgagacgagaacccctatgaagggctagttttatgactgtggtcaaggtcaacctgggtctgggtgtgggaaggggttactgatatctcacagtctatcttctggtctagctgcacaggtgatagccacaggtccccaccagttagatgtagtgttggagataatcaggcaggtcagggccctcggatgccccaaatttgctttatggtttatgacattctcccttggtttgtactgacaatgctggctgggaaggaataaaaacagccaaacttcttaagg

SEQ ID NO: 242521 - DNA, 370 bp, Homo sapiens
gcaatctttagcttcttattgttttaagtctcacaatctcaaagatgactagcaaataaaggctttatattaagaagaatttataggccaggtgcagtggctcacgcctataatcctagcactttgggaggccaagaagggcagattagctgagatcagagttcaaggccagcctggccaacattgtgcaaaccccgtctctactaaaaatacaaaaattagctgggcgtggtggtgcatggctgtaatcccagctattcaggaggctgcggcaggagaattgcttgaacccaggaggcagaggttgcagtgagctaaggttgtgcagttgcaccccagcctgggtgacagagtgagactccatctcagg

SEQ ID NO: 242522 - DNA, 504 bp, Homo sapiens
tatctatctctgttcaagaaaggtgtgagggtggggagaagtctgtatttctttggaatttaatttatatccagcaactgacaggtaaataagatgtagtacatccatataatagaatatttggccatagaaaagaatgaagtactgacacgtgctacaacatgaatgaatcttgaagacattacgctaagtaaaagaagccagacacaaaagactccatactgtgtggttccatttatataaaatgtccaggatagggaaatccctagatacagaagattagtggttgcccagggatacacgggatgggaggcttaggggtgatggctaaagagtacgagtgttctttctggggtgataaaatgttttaaaattgattgtggtgacatacaactctgtaaatatactaaaaattattcactgtaccctttaaatgagtaaattgtctggcacacgaagtacatcccaataaagctgttaccaaaaaacccacaaaaattgtaa

SEQ ID NO: 242523 - DNA, 417 bp, Homo sapiens
ggaaggggctatgtgctctgtggtagccccacaagaacctacactttggtcttcactggcctgggctcaaaacccatctcttctgatgcccagctgtgtgccgggtgcagacaagtggtttcacttctgtacccttcaattctcatcagtaaacatgaggcttttagtctcttaagaagttcttgaacaaaaatgaggcaatgggctaatattttctcatacccaggccaatgcttagcacacaataggtattcaataaaagccatttttactgtgtttcttctttcattgaataaagcgtatggttgtatatctatacattgtggtaattactattatcatcacaactaataataataccccaggatttgttggccttcatacaatcataggtagctaagccaaaaaataaatgta

SEQ ID NO: 242524 - DNA, 396 bp, Homo sapiens
aagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttga

SEQ ID NO: 242525 - DNA, 487 bp, Homo sapiens
tctgaacagactgatgttgagtagcaagattgaagcagtaataaagcctcccatcaaagaaaattcaaggacctgatggtttcactgctgaattctagaaaacatttgaagaactaatacaaattattcacaaaatattctaagaaactgaaaatgaaggaactctttcaaacccattttatgagaccagcattgtcttgatttgaaaaccaatcaaagacacaacaaaagagaaaactacagactggttttcctgatgagtatagttgtaaaaaaaataaaatactagcaataaagattcaaaagcccattaaaaaggtaattcaccattatctagaaggattcaacccaggaatgtaaagatggtttaacataagcaaatcagtaaatgtgatacatcacattaacagattgaaggataaaactatgtggtcatttcaattgatacagagagagcatgtgacagacttcatctttttgtgataaa

SEQ ID NO: 242526 - DNA, 379 bp, Homo sapiens
ctgcctgcctcagctgggctctgacccagccagcagactggagtcctcttctgcatgaaccaaaagaactatttcagaatgtcagctgaaaagcacgatattccagatagcttagaaaccttggcatagtgccttcctggaaatcctggattgcatctaaaaccatgtggcagagggagaaacaacagacaggacatcctgagaagactcaggctgggacgaaagctctgctctccagggacaaagcagcaggggaccagccatgctcagaaatactccactggccagtgcacatttttttgagcaatttcacttgcttcctcaccacctgtccccctaacacttctattaaagtggcaaataaatctgatacccaaaa

SEQ ID NO: 242527 - DNA, 471 bp, Homo sapiens
caggtaaggaaactgaggcttagaggagttatgaaattgcccaaggtttcacagctgaaatgtataaggacctggacttgcaaatttggcacaaagttcttctaataagaggccataaaataaccaaatgattttttatgtgcctatagaaccaaaagaactatttcagaatgtcagctgaaaagcacgatattccagatagcttagaaaccttggcatagtgccttcctggaaatcctggattgcatctaaaaccatgtggcagagggagaaacaacagacaggacatcctgagaagactcaggctgggacgaaagctctgctctccagggacaaagcagcaggggaccagccatgctcagaaatactccactggccagtgcacatttttttgagcaatttcacttgcttcctcaccacctgtccccctaacacttctattaaagtggcaaataaatctgatacccaaaa

SEQ ID NO: 242528 - DNA, 1447 bp, Homo sapiens
aatggaccaatcagctctctgcaaatgggccaatcagcaggatgtgggtggggtcagaaaagggaataaaagcaggctgcctgcgctagtagtggcaactggctcaggttctcttccacgctcacgctatgggagttttgtttttttgatctttgagataacttgctgctgctcattctttgggtacacactgagtttatgagctgtaacactcttcgtgaagctctgcagcctcaatcctgaggccaccgagaccatgaacccatgggaggaatgagtaactccagacgcgctgccttaagaggtgtaatactcactgtgaaagtctgcagcttcactcctgaagccagtgagaccacaaatccaccagaaggaagaaactccaaacacgtctgacatcagaaagaacaaactccggacataccatctttaagaactgtagcactcatcatgagagtctggggcttcattcttcaagtcagtgagaccaagaacccaccaattccagatacaccacagttatcattgtactacacggctctcagcaccactgaccttggtatgggaaaaagcacaagtgtgcataccatcttattctccttttagaatatttcaccggcgggggaggggggaggtcacacctgtaatcccagcactttgggagattgaggcgggtggattgtctgaagtcaggagttcgagaccagcctggccaatatagtgaaaccccatctctactgaaattacaaaaaattagctggatgtggtggtgggtgcttgtaattccagctacccaggaggctaaggcaggtcttgaattgcttcaacccatgaggcagaggttgcagtgagctaagatcgtgccattgcactccagcctgggcaacaagagtgaaactccatctcaaagaaaaaaaaagaatatttctccaggagaactccacacttgcacaatatcttctccaaggacagaagagggacaatatttgtccttcctactggattttgaaaccctttgcactgagtgtagactgtagttctgtgacataccatgaagagtgtgtgtgtgttttaagggagctactgtcttacccaaaacctgtgaatataaagtgttttttcatgaattgctcattattcagccagtcgttaatgaattcattcaacaagtgtctctgagatgctagacactggggattaaaagaggaacaacagagacaagatctctgccctccagaaactgacagtctattgaatgagacagttgtctaacaatcacaatcaagtgtgatcaatctctggtgacaggactctaacctagaggcatgtgcctaatctggggtgactggttagggaaaacttccaaaaaagttgtgacttttaggctaaaaccagactgctaataaacataaagtgttacaggaagtaagtggcaaagctactgtca

SEQ ID NO: 242529 - DNA, 136 bp, Homo sapiens
agaattcctggaatctgactgggaccctcgcagtgaaagctgggactgttgaaaacccaatttcagtgtttgctactcaagttgagagtgcagggccaagataactagatcccaggacaggcagtttgacagtgag

SEQ ID NO: 242530 - DNA, 271 bp, Homo sapiens
agactaagaagcttcaggagagccctaaaatcctactgattctctgcaagatattggtggattcttagttatgcatgcaataaaaccaacagaaaccagcatctgggaggaaaagaattgagcagattttcgtatctgcctactgctaaggaatgagattggagttcaagttctatcaactcagaggaacttgtaagtacacagagcttttcaccgagctctcagaagggccatgccagaataatgacaaaatagaaacataaaaaccttt

SEQ ID NO: 242531 - DNA, 289 bp, Homo sapiens
gaaatcattctcaaacattctgaagcgacttaatagcattctcccacccccaccttttaaatttttaagtaatttctacaaaaatgtctgtttacgctgatttatgcaaagtgtttgtgtttctttataaatatcatcagaatagatttatgtaagatttatgaatcacaagggtcctgaattgcaaagatgtgcaatcttgatcagtatcatgtctgtaacaccatcacacaattcgatttactgagagggaaggaaatgtactaaaaagccctcactgcttctgtct

SEQ ID NO: 242532 - DNA, 512 bp, Homo sapiens
agaacagcatcactgaggaggtgacacaggagccagccatgccacgatcttgtgaccaagacactccaggtagctggaacaacaaatgcaaaggctctgagatgggctgagtatggaacactgggaagaaggcttagaaggcaggctggtgtggcaaggcttctgggagctggggtgtccgcagctggcctgtgagcactttttggcacgggagcttcaatggacagcggcggagcacaggctttggcttccaaaggtctgagctcgattcttgctctgaaactggctagccatgtgagtttggacaaggccctgcacctctttgaccctccgcttccataaccgtacacacaaacctaactcgctggactgttgtgaggacccataagggaagcatgtgactcatggaagcaacaaaatattagctcccttctcactcgcccctctcacctctgctggaatatccccacccgcacccaccaccattaaggaaaacctacaattttgcaaga

SEQ ID NO: 242533 - DNA, 340 bp, Homo sapiens
taaaaaaaaaaaaaaaaaaaaaaaaaagactagaaaagtaaaatcatctataccattaacagccagagatggaaattctcttcatgtcttgatagattttcttgtcttatcatatacatatatatgtacatacagttcttaataatttgataccacagtgtgtatagaatgttttatactctatttactgttactttataagcctataccatttttatgcccttagttgttctttaaaaacttgatttttaatgaacttatatatatatgcactattaagtagaggtactgtaatctgtttattcagcctgggtgacacagtgagactgtgtctaaaaaa

SEQ ID NO: 242534 - DNA, 409 bp, Homo sapiens
tgccagccagtctgagggattgtgcaaaggtgttcattgctagcctgcaaactaggtggtaagcaaaacttcctacagctgccactcaacttgagctaatgaaaatgcgcccagattagttaactagtctatcagaggcctgtttctctctacattatgcagaataatcttttgcaaggttaaaacagatattatgagactttctgagaatagtcgtgagaatttatggatggagggtgggctgcagggaaaatgataaatgcataatttacactgttttttcactggctagtaataatgactataatatcatgaaacattgtttttaacaaatgaattattatgccaagtagtatagatgtgaggataaaattaataaatacatgtctcagatattccttatttatga

SEQ ID NO: 242535 - DNA, 426 bp, Homo sapiens
taaaaaaacattttctgacacttcgttctgctggtaactgtagtagttttctgggtctacaattacaacatgccacaaactgagtggcttcagcaacataaatctattgtcaaacatttctggaggttagcagtttgagaattaggtgtccaatagggccatactccttctgaaggctctgcagaagaatttgttccatgcctctctcctagtgtcaggtagttttccagcaatctctagtgcttgttggcttatggcagcataatttcagtcttcatatggccacctctctccatgcacgtccaacctctctctgtataaggacaccagttatacaggactaggaaccaccatataccaatatgacctcatcttagtaattacatctgaaatgaccctatgatcctatttccaattaagataaga

SEQ ID NO: 242536 - DNA, 691 bp, Homo sapiens
gtttctagagtctgggaactccaaatggtaccatatcacggcctccttttacggcgcactctgtgtaaagcatggcggtaagcaccttccatggatagtctcccttaattccacttctgggagtagaagatgatcattttaccttacagcagtaggtctcatcagggggttctgattttgttggtctgggcaagccctgggtatttggacttttaaacactcccccagtgattttaatgtgcagccaaggtcaggacctcttttacagtcaagggaattgaggcttcagaggtcaaagtcactggcccggggtcaccaagctgtgtggggaggcacagttaaagcacaggcctgtgtgactgcattgtttgaccctggggccctcctgctgctgccaatcagaaaatggtcaggaccaggcacggtggctcaggcctgtaatcccaagactttgggaggccgaggtaggcagatcacttgaggccatgagttcgagattagcctgggcaacgtagcaataccccatctctactaaaaatgtaaaaattagctgggcatggtggcacatgcctgtaatcccagctactcaggaggctgaggcatgagagtcacttgaacccaggaggtggctgcagtgagccaagattgtatcactgcactctagcctgggtgacagaaagagactgtctca

SEQ ID NO: 242537 - DNA, 369 bp, Homo sapiens
tgattttagataaagtagtcatggaagcttggtcattactatagtcttaatgttattttttttaaaaaggggatttagttgggctgatttcctcccctaaaggtcctctgtcaccttatttaaatttaaaactggttttaccagaaaataggtaaacaaacaccactggttgtctccagtctcttttcttgctcttcctctccctcttctttaaaaatgtggctgatgagaacctgtttccaggagccctttaatcactctgaaacacacagacactgaaaatgttgaagcataaaaataaaccttgcgttacagggagattgcctgtgtgctgtccacttcgcttataacagtgaaagtaggagatta

SEQ ID NO: 242538 - DNA, 519 bp, Homo sapiens
tttttttttctttttgagacagagtcttgccctgtcgcccaggttggagtgcagtggcgcaatctcggctcactgcaacctccacctcctggattcaagcaattctcctgtctcagcctccctagtagctgggattacagtcacacgcccagctaatttttgtatctttagtagagacggggtttcaccatattagtcaggctggtctcaaactcctgacctcaggtgatccacatgcctcagcctcccaaagtgctgggattacaggtgtgagccatcacaacccacctcaaaatatcatggcatgagccaccgtgcctggccatttttctttttctctagcagttattgaataagcactggccttgagataagcaatattgaaaacagttgcagctcattcaccaccaaatgctaacctactgattcctgttccacaagccgtaactacagctttgactggacaagagagctatttcagtagctatcaacaagttagtggtctcctgataagaagac

SEQ ID NO: 242539 - DNA, 353 bp, Homo sapiens
ccaggttgtagcctgtgtcaggatttccttccatctgaaggccgaagaatcgcccattgtgttcacatactgccttttgtttagccattcacgcaccaatggacacctgggccgctcccatcttctgcagccatcctttcctgaatgtgcagtgtgcctcgccaacctggccccgtctgcctcagccacccagcggccttcctccctgcaccagtcacctaccttgaaggatttttcttttttatcaggctagagggcagtggcgtgatcatatctcactgcagcctcaacctcctgggctcaagtgatccacccacctcagcctcccaagtagcaggaactatggacatgca

SEQ ID NO: 242540 - DNA, 396 bp, Homo sapiens
ctcttgcctacttccagtcccagagaatggggtgcagggaggagggtggaggagggtagaagaggggacagaggagggatgcgaggtcaagggtgtgggggagaagagcaggaccgataatgcagagcagctaattcctgaaaactataaagtgggtggctttgaaggcctgaagggctgtgcccaggtgtgcaatggagaaaggggtttgccagctctttgctgggcaccagggatctagggttctgagaggagtcccttatccaaggtggacccggacaaggagataacgaaaacataggtagcatccaacagcatgcagcactatggcatgccagcagccgtgctgggcgttttacagatctctttcaggctcagaacaaccttgcacatgag

SEQ ID NO: 242541 - DNA, 471 bp, Homo sapiens
caaagaagtgctcacagtctttctggccggccagtaagtgaatgatttcaggcctggtgggcaatacttgtgtccatgcgtaacacagcccaaccacagtagtaggcagctgcatgtaattttgaactccactcattgaactgtaataaaacaatataagcactgcttggggggaagattggatgcagttatccttacacaaggctcaggcatatgaaagcagtgctggctgacaagaggattttgagatttgattttgattgaattgcagaattgaacaggccaggaatgtcagtggaaggctaaacgcctgtagtgccataaagttttattcatgtgaggctttccaatatcaagtagatggattattggaaaaggtgtcaagggacatgaaatggaagtgcccaaaacataaaatgtaggcaggagggagaaattacttcttgcttagtatatataattaggtcttca

SEQ ID NO: 242542 - DNA, 413 bp, Homo sapiens
tgacaaaactaaaattgagctaaagattaacaaactattctcagtctgaacgaacaaaatacaaaagaaacaggatttaaataacagaattaataaatgttagataatagatacatagcaagaaatataggcctggtgccctggctcacacctgtaatcccaacagtttgagaggccaaggcaggaggatcacttgaggccaggagtttgagaccagcctgggcaacctacggagacccttgtctttacaaaaaatttttaaaaattggccaggcatggtggtgagtgcctgtggtcccagctactcgggaggctgaggcaggaggatcacctgagcctgggaaatggaggctgcagtgagccatgcactaccactgcactctagccagggtgacagaacaagaccttgtctc

SEQ ID NO: 242543 - DNA, 797 bp, Homo sapiens
tctgtaccgtcttcattatactacccttgagacagagttttgttctgtcatccaggctggagtgcagtggcatgatcatgactcactgcagcctcagcctggtgggctcaagtgatcctcccacctaagccttcctagtagctgggactacaggtgcatgccacggagctaatttttgtattttttgtagagatggggttttgccatttgtccaggctggtcttgaactcctgggctcaagcagtccgcccaccttggcctcccaaagtgctgggattacaggcatgagccactgtgcctggcccatcttctttgagttgttcagtgtttgtttctttgtggatgttattttagtgtttgtagccttagaatgtataaggtttgggggattcctttgttgagatgaggtagtggtgaagattttgaaaacagttaggaattaactaatttgaattagctaataacgtaataatagttaggtaataactaatttgaattagttacaataccctgaaaacagtttgtgtcttacagaagaagcccttagggcaagagtaaagtagagcagtaagaaacaaaacaataacaaaagtgtgtttagtaaatccttataactggagtacatatttagaaattcgctatctgtagcatttaaaagttactattttggctgggcgtggtggctcacgcctgcaatcccagcactttgggaggccgagatgggttggatcatctgaggttaggcgtttgagaccagcctggccgacatggtgaaaccctgtctctactgaaaatac

SEQ ID NO: 242544 - DNA, 590 bp, Homo sapiens
aaaatgtaaaaagtaatatcagtggttgagtctatgacatttacactggttagtatggtaatgttatttctcaagtattggtaactgagcaaattctgtcttgatatatgtcagtgcagtgacataatcatggctcactgcagccttgaactcctgggctcaggagatcctcccacctcagccttctgagtagctgggacaggtgtgtgtcaccacatccagctaaattttttaaaaatttttttgtagagatggggtcttgctttgttgcctaggctggtttcgaactcctggcctcaggtgatcctcttgcctaagcctgtagaagtgctagattataggcatgagtcaccaggcctggcccttttaataagctagaataagagaactataaatgttatgattcattgtatttatataaactattatatttatgataaggaatagcattaacttttttggaagcaaaatttgtttataaaagtttttaatgtcatcattgaaatactttgcaaggcttttgaaaatgttctctttggtttttgaatgttatgtattttaaatgtatgtgatgtacttgaaacaaaaaa

SEQ ID NO: 242545 - DNA, 547 bp, Homo sapiens
taatatgtatgcgttcatcaactttttttgagacagggtctctgttgcccgggttggagtgcatggtgcaatctcagctcactgcaacctccatctcctaagctcaggtgatcctctcatctcagcctcctgagtagctagaactacaggcgcacaccaccacgcccaactaatttttaaattttttatagacatggggtctcgccatgttgcccaggctggtcctgatcttctgggctcaggcaatccacccacctcagcttcccaatgtgctgggattagagacgtgagctactgtgcctaggcccaaattatttttcaccagatgaatggataaacaagatgtggtgtacacaaaaaattgaatattattcctccatatggaatattatatgtaaataatatgctatataaaaatattccaatagattattcctccgtatgcttacaatatggatgagccttgaaaacattatgctaagtgaaataagccagacaaaaaaggaaaaacattgtgtaatcccacttatatgaagtatctagagta

SEQ ID NO: 242546 - DNA, 346 bp, Homo sapiens
tctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgagga

SEQ ID NO: 242547 - DNA, 175 bp, Homo sapiens
caagtcagttgcaaaggctggtatttgtttcttctcctccaatggttttgaccccatcccaccctagccactgaaatcctaaaaactcacaatttctaataattgcaaaccatgcataatctaatttttagttatctaatttccatcttccatctgctgtttccagctttcttac

SEQ ID NO: 242548 - DNA, 431 bp, Homo sapiens
cagtactaaaaagtatcaaggacctgaaaaaacaaggaaagtctgagaagcttttacagaacagagaagactaaggagacatgacaactaaatacaatgtgatatcccagattgacagtgaaaaaaggacatgagtggaaaaaaattggctaaatctaaacaaagtctggaattttgttaatagtattattccaatattaatttcttggttgtgacaaatgtactgtagttatgtaagatgttaacattgggggatgttgggtaaaggacatacgagtattctctgtactatctttgtaacttttatgtaaatctgaatttattccagaataatgagtttttttaatacagcagaatacaaattgttaagtaaaacatatctcaaactgataattgatgaaataagaaataaaggttatttactatttgta

SEQ ID NO: 242549 - DNA, 370 bp, Homo sapiens
agaccatattgaaatacgcagagaattccatggagactctgatggctagggcaccgttgagctgttgcaactgttctgctgatttctatcatggaaaatatccctgcaagcagtaaccactatttgaatggtgaaatcagcagcacagcaaacatggttcttaatgagattgttttgcatttaaaaattttatgcaccaggcattttacaatgcaaatgatcttgctttttaagccaatattatccttttaagataattttgataatgtagatatcgttcatcgtgttttgatataagttttaatcaggcaatatttcaattagatagaagtatgtacaaaagtaataaactatatctctgaatgaacaa

SEQ ID NO: 242550 - DNA, 495 bp, Homo sapiens
actattttttttaccttgcagagctgtaatgtagataagatcctgattaagtgttaatcacaatgtggttttaccttcataaaatcagggtttctccccgtaggaggtgtgaatataattctcgctaatagaagagagtcttattgttggagttcttcggtgaaatgtcagcagcaggtctccttgaccagctgagccccagaagaggagtgaagtctttgttccagcttgagtctggatttccttgaggtatttgggcctcactttccccagcttttcaaatggggatgaggctgtcaggcatagcatgcagccaaagaggagagttgtgttggtagtccatgcattccttgaggacagatgtgtatcaggtacctattctgagccgggtgctgctctctgagctccacatacagcagtgaacagactccttgtgctggggagaggcagacagtaaacagactagtaagtgaacacgataattatagtttatgg

SEQ ID NO: 242551 - DNA, 587 bp, Homo sapiens
agaggctgcttcctgctgtggacttgattagcagccccatggacagtcactggactgttagcgaggcaggagtccagaggagccagggtgacaccattttaaaatcagcaccgtcttaaactagcaaggcacactccttgccacacacaagccatggtcctaagatgtttacagctaaggaagcagcttggtgatgcctgcaaagcaaactccaagaacagaaagtccagacgtccaatacccataattaggtctatgctttcaagatagtaagagtcatgctatgatgactgacacactaaaatgtcaaggatggttttctttaaaccaatagaatgataaaccttgtcatgctctctgctcagctgcacatatgcacagcttcacttcgctttgcagacaagacttctgtgtaagaaaaatggaaaaagaagttggtgtgtcctctgcttgctttctgctctgtaacagagtcatttctaataaacgtgcctctttcactgtgctctgtgactggccttgaattccctcttgtgtgagatctgagaagcctctcttggggtagagaccccctcttccaggaacag

SEQ ID NO: 242552 - DNA, 296 bp, Homo sapiens
atgtggctagagaggccttacaatcatggcagaaggtgaaaggcacatcttaggtggcagcaggcagagagaatgagagccaagtgaaaggggaaacctcttacaaaatcatcagatcttgtgagacgtattcactaccaagagaacagtataggggaaactgcccccatgattcaattatttcccactgggtccctcccacaacatgggggaattatgggagctacaattcaagaggagatttgggtggggacacagccaaaccatatcgttggtgatatgaatggtagtttgga

SEQ ID NO: 242553 - DNA, 366 bp, Homo sapiens
aatggttggtaaaaggttttgggcgttcgtttaattctgtcagctttgctataagattgaaaatttttaaaattgaaagttggagagaaagccaacaacattaaacaatatatcatttaaagatgcatatttatgtgacaaaaactaaagaaagtttttaaaacaaagtataaacacacaatttaggagagtggtttactttgggtgaagcagggacttaagatagggaaaggaccacataggtggttcagtgtgttggcagtgctctgatttgtatcatggattcatgagtgttgatttagttctactgtgctttgtgattttcatatatgtgacttatttgtatatatcaaacattatattaaa

SEQ ID NO: 242554 - DNA, 792 bp, Homo sapiens
cctgttcccactttttgttgttgttgttgttctgaactgttaggccacagaatgattgtggacctcataatgtgcaatctacagaacgtcagccacagaatgatttttggccaggattttgcttccctgggtaaagcagagaaactctcctgtgggatcctacctctccagtgcagtctgtgggcacggctttcctagttagtaaaaaaaataaagtaactagcatgatgatagactttaactctatcaataattgcattaaatatacataatctaaacacatcaattaagagaccaagattgtcacattgaataaaaaagcgagacacaactagcagaaaacctacatatatgtgtgtgtgtgtatatatataaagacatagacaatattttatatatagatagatagatagatagacatagacaagttaaaaataaaaggatggaaaagatattaccatgtaaacactaaccaaaagaaccgtgaaagggctgtgttaatttggacaaagtaaacttcagaacaagcactattactgggaataaagggggatattacataaatatagaggggttaatttagatacacaaaaataacaactcgaaatatgcatgcatctaacaatggagcttccgaatacttgaagcaaatatacccttagggcatgggattttaagaatggagtaaggagctcaatggaccacctcaacagacagtactttaactaatgagaattattttttaaaaagttattaaagttgcaggaaattattcattcaaaaaaatgttgt

SEQ ID NO: 242555 - DNA, 350 bp, Homo sapiens
tctccagcatcaggcttctataatgatgcattttcttatccaccctgtgataatctacccgaacattttatttttcaccttctttctagtcgaggtatgatttatataatttgttcctctaaagcagggtataaaaaaaacaatccaagtgattttcttggtgccatgatgtcaagtagaactcagatccacctagaaacattcaagtgttcatggaccacagtgtattctctagaggctgaaggtacacaagaatatgacacacctccttggcaaaaaacggtgcaatggtctacaaagggctcttccagcccctctcgtttcttctgaacgaggcgctcagatttaaa

SEQ ID NO: 242556 - DNA, 329 bp, Homo sapiens
cggcacgagggctagagggctctgcttgcttgttttgatgaacaagtgatcactcggaggcccacatagacaggaactgatggcagcctccagccaacagtcagtaaaaaaagtgaggcccacagtccaacaggcacaggaaactgaatcctgccaacaaccatgtgagcttagaggtggatacttaccactcagctttcagacgagacctcagccctggttgacactttgattgcagcctcatgaaagaccttgaagcaccacccccagttaagtcctgcctggatccctgacccacagactgtgagataataaatgtgtgttgttta

SEQ ID NO: 242557 - DNA, 505 bp, Homo sapiens
aggggcagtgctaagagggaagtttatagcattaaatgcttacagccaaagaacagaaaaatcaaattaacaacctaacatcacacctcaaggaactagaaaaaaaagaacaaagaaaactcaaagctaacagaaaacaaataacaaatcagggaagaagtaaatgaaattgtgaacaaaagaacattataaagggtcaaagaaacagaaagttggttcgttgataaaataaagttgacaaactgctagctagactaatcaagaaaagaagacagaagatccaataaacaatcagaaatttaaaaggagacattagaactgataccacaatacaagtgatcatcaaagactaccatgaacatctctacactcacaaactagaaaatctagaagacatataaattcctggaaacataaaaccacccgagattgaacacatagaaatcctaagcagaccaataacaagtagtgacacttaatcagtaacaaaaaagtctcctaagga

SEQ ID NO: 242558 - DNA, 1121 bp, Homo sapiens
  misc_feature (286)..(286): n is a, c, g, or t
  misc_feature (746)..(746): n is a, c, g, or t
tttctgataaatattccatctgctggtgttacctattgcccaaagataggtatgaatcagtcttaggattttgaaaaatctttatattggtagctaactcatttttaatgttgtgtaattttttatatttgttctcttttttcttaacttttgcacaattcatttgtcctggtgtattttatacttatgtattgatttcaaacattttcaatctatattttataattattatgtttcctgttgctttcttcattttgtataatgcttatcttgatttacaagtttnacttaaccagtaaaataaatattttaaaatttgagttaaatgatttttatactgtttcattataagaaggatttatattttaaaactttattaacattattatactctgttttaataataaaataaagttataaatattaatctattttattccattattttgctcattttgaaatttatatctttaattttcaccatttttaggtaatctgcaatcttaattttgattttccttttgatgcaaaatgaattttaaacatttatctttactctcaaattttagggtattacataatctttctttctcaccatctgttacttttacttaaataccattgtattctgataattcagcctatacaactgtggtttttatttattgagatttaatttttatgataatatgtgaaggaaatttgaaaggttttatggacattataaaaaagatccttctcttgcngagaattacaggctttgaaaaatatatcaagaaaaagaaacagagagatctatgtgaatatatacacaaatattattaaaactactgataggtcggccgggtgcgctggctcatgcctgtaatcccagcactttgggaggctgagatgggtggatcacaaggtcaggagatcaagaccatcctggctaacacagtgaaaccctgtctctactaaaaatacaaaaaattagccaggcgtggtggctggcgcctgtagtcccagctactcgggtggctgaggcaggagaacaacgtgaacccaggaggcagagcttgcagtgagcggagatggcgccactgcactccagcctggacgagagtgctagatgccatctc

SEQ ID NO: 242559 - DNA, 447 bp, Homo sapiens
tacagttaactgatcttcaacaaaagtgccaagatcatacaactgagaaaggacagtctcttcaataaatggtgctggaaaaacttgatatccacatgcagaagaatgaaattggacccttatttcatcccatatacaaaaatcaacataaaatggattaaagacttaaatgtaagaccagaaactataaaactattagaagaaaacctagagacattgacattggtcttggcaaagattttttggatatgaccccaaaagcacaggcagcaaaagcaaaactagacaaatggaattacatcaaaccaaaaaaatagcttcacagcaaaagaagcaatcaacagagtgaagagaaaacctatgcaatgggagaaaatatatgtaaatcatacatgaaataaggaactaatatccaaaatatataagaaattcaaacatctgaacagc

SEQ ID NO: 242560 - DNA, 531 bp, Homo sapiens
cttggtctcaaaataaacaaaaaaaggtgggggagggtacctgcctaattcccacctaacttgacatttaaatttgtttgaatacttaggcttccaagtattttggttacaagatattttcctgtgtactggaatcctcaatagagtaaaaatacttttttgaagcctgtaaccttcctttctgtcttctcaagaagttgtggtaagcgagagagttcaagtcctggctctactactagttaggtggtgaccaaatatcaagtcacttacccttctcagcctcagcttctacaactgtaaaatggggatgataaccaggcagagttggtgtgacgagttaacataatactatgccaaaggactgtataaatgtcaagagattttcattacctactccagcactttacaaatagtaggtgttaagttaatgtttgtttaactgaattgtataatgatcttgggaatataaagctaattttactttgcattgattgaattaaaccaggctctttctctgggaaattatgtctc

SEQ ID NO: 242561 - DNA, 1843 bp, Homo sapiens
  misc_feature (163)..(163): n is a, c, g, or t
  misc_feature (786)..(786): n is a, c, g, or t
  misc_feature (807)..(807): n is a, c, g, or t
  misc_feature (1790)..(1790): n is a, c, g, or t
  misc_feature (1840)..(1840): n is a, c, g, or t
gatgtgaggacacatagagcatgccatctatgagaaacgggctctcatcagacactgaatctgctggcacgttgaccttggactttccagcctccagaactgttcccatagaagaaatggtttccagaatgcagaagtggtccatgatgccagatgttgcagnaagagcaaataaggagaaaaagaatcctgcccaggaggcctcccaccccgacataggagggcaccacccacatggcatcagcctgcagctgatttcatattccatgctcatgacatagtaccttataggacatgtcacaactcacgccttccccttatccgccatcggggatagaacagaaagacataagcaccggcatgggcctattccacagccaaggcaggcaatgagctctcaggtacttgcaacaaactcgagtgtgcattcggtccaggaggaagagcccgcacccttttttgttgctgttcagtgttaatccttcggtggaacccaccaggacagcagtctcagtgctgttgtttttgacagggagaacatcccagggcagaaaggaaagcctaaagctacagcctgttcctctagttcttagaacagctggttactgagctctcaggccagacactggatcccggagagcttgtccactgcaacagtgcaacacgctaagggctgtgtggcggcacaggggctctgagctcctgacctgagtcatggggacctgaaggctgacacccagccctatacctacaagctgggtgagacccctggcagttgcctacacncctgctgagacccagtacctncctgtaaaatgggggaaataatgcctgcctcacagggtttcgatgaagggaaacatttggaaaccccttggaggagatctgccacatggcctccagtgaactgtagactcctgcatagccttccaaagttcttcatttggtgaatattatgagaaatgacacgtatgactttctcccaaatacgtggcttaaacccaaagtacagtgaaatcagaactgaccacacagagtaattggggcaagggagtatttgtgacacaaagccctcatcactttataaaagtacttgctactgattacattgaaaaccagtcttcctgagtaaaacatgttttttgttttgtatcgtttttgtttttgtttttttgagacagagtctcactctttgacccaggctggagtgcagtggtgcgaacttggctctccgcaacctctgccttctgggttcaagcgattctcttgcctcagcctcctgagtagctgggattacaggtgcccgtcaccacgccagtctaatttttttgtatttttagtagaggcgaggttttgccatgttggccaggttgatcttgaactcctgacctcagatgatccacatgcctcggcctcccaaagtgctggggttagaggcattaagggaggagaccacccctcatattgtcttatgcccaatttctgcctccaaagaaagaaaaagtaaaaactgaaaggcagaaatgaaatccacaagcagacagcccggtgccacaccctgggcagatcgacccctgacctaatcggttatgttatcgattacagacattggatagaaaagcactgtgaaaatccctatcctgttttgttcagatcgaattaccggtgcatgcagcccccagacacgtaccctctgcttgctcaatcgatcacgaccctctcacacgcacccccttagagttgtgagcccttaaaagggacaggaattgctcactcggggagcttggctnttgagacaggagtcttgccaatgcccccagccgaataaaccccttccttnttt

SEQ ID NO: 242562 - DNA, 1368 bp, Homo sapiens
  misc_feature (163)..(163): n is a, c, g, or t
  misc_feature (786)..(786): n is a, c, g, or t
  misc_feature (807)..(807): n is a, c, g, or t
gatgtgaggacacatagagcatgccatctatgagaaacgggctctcatcagacactgaatctgctggcacgttgaccttggactttccagcctccagaactgttcccatagaagaaatggtttccagaatgcagaagtggtccatgatgccagatgttgcagnaagagcaaataaggagaaaaagaatcctgcccaggaggcctcccaccccgacataggagggcaccacccacatggcatcagcctgcagctgatttcatattccatgctcatgacatagtaccttataggacatgtcacaactcacgccttccccttatccgccatcggggatagaacagaaagacataagcaccggcatgggcctattccacagccaaggcaggcaatgagctctcaggtacttgcaacaaactcgagtgtgcattcggtccaggaggaagagcccgcacccttttttgttgctgttcagtgttaatccttcggtggaacccaccaggacagcagtctcagtgctgttgtttttgacagggagaacatcccagggcagaaaggaaagcctaaagctacagcctgttcctctagttcttagaacagctggttactgagctctcaggccagacactggatcccggagagcttgtccactgcaacagtgcaacacgctaagggctgtgtggcggcacaggggctctgagctcctgacctgagtcatggggacctgaaggctgacacccagccctatacctacaagctgggtgagacccctggcagttgcctacacncctgctgagacccagtacctncctgtaaaatgggggaaataatgcctgcctcacagggtttcgatgaagggaaacatttggaaaccccttggaggagatctgccacatggcctccagtgaactgtagactcctgcatagccttccaaagttcttcatttggtgaatattatgagaaatgacaccgaggtgactggcacatggtcgaggcagctgcttaggcagcttaagcatgccctgtgaaacatccctgtgggggactccgaccagcccaggcaacgcggatcctgagaacgctcccgggtaggcatctgcccctgtgggatgcctcaccagagcagtgtgtggcaggcccccgtggaggaccaacacagtggctgaacaccgggaaggaacaggatcttggagtctggacatctaaaacttgcacatgtaccacccctagaatttctggtaaaccagcaccagcctgaagatcacgttctcatcaaacggtggaaagaagaaaaactcgagccaacctaggaaggaccccaccttgtgctgctaaccaccaagactgctgtttgtacagaaaaaaaaaa

SEQ ID NO: 242563 - DNA, 1350 bp, Homo sapiens
  misc_feature (163)..(163): n is a, c, g, or t
  misc_feature (786)..(786): n is a, c, g, or t
  misc_feature (807)..(807): n is a, c, g, or t
gatgtgaggacacatagagcatgccatctatgagaaacgggctctcatcagacactgaatctgctggcacgttgaccttggactttccagcctccagaactgttcccatagaagaaatggtttccagaatgcagaagtggtccatgatgccagatgttgcagnaagagcaaataaggagaaaaagaatcctgcccaggaggcctcccaccccgacataggagggcaccacccacatggcatcagcctgcagctgatttcatattccatgctcatgacatagtaccttataggacatgtcacaactcacgccttccccttatccgccatcggggatagaacagaaagacataagcaccggcatgggcctattccacagccaaggcaggcaatgagctctcaggtacttgcaacaaactcgagtgtgcattcggtccaggaggaagagcccgcacccttttttgttgctgttcagtgttaatccttcggtggaacccaccaggacagcagtctcagtgctgttgtttttgacagggagaacatcccagggcagaaaggaaagcctaaagctacagcctgttcctctagttcttagaacagctggttactgagctctcaggccagacactggatcccggagagcttgtccactgcaacagtgcaacacgctaagggctgtgtggcggcacaggggctctgagctcctgacctgagtcatggggacctgaaggctgacacccagccctatacctacaagctgggtgagacccctggcagttgcctacacncctgctgagacccagtacctncctgtaaaatgggggaaataatgcctgcctcacagggtttcgatgaagggaaacatttggaaaccccttggaggagatctgccacatggcctccagtgaactgtagactcctgcatagccttccaaagttcttcatttggtgaatattatgagaaatgacaccgaggtgactggcacatggtcgaggcagctgcttaggcagcttaagcatgccctgtgaaacatccctgtgggggactccgaccagcccaggcaacgcggatcctgagaacgctcccgggtaggcatctgcccctgtgggatgcctcaccagagcagtgtgtggcaggcccccgtggaggaccaacacagtggctgaacaccgggaaggaacaggatcttggagtctggacatctaaaacttgaatttctggtaaaccagcaccagcctgaagatcacgttctcatcaaacggtggaaagaagaaaaactcgagccaacctaggaaggaccccaccttgtgctgctaaccaccaagactgctgtttgtacagaaaaaaaaaa

SEQ ID NO: 242564 - DNA, 397 bp, Homo sapiens
ggaattgcaaatgcatgaaatggcacccattctagactagtcacggcagtgttggtgatggtcacagaccgggaacgaccctgacgtttatccatagagaactgggtcatgagccatgatccacatcatggatactggtcagctgtggcaaagaatgaggtatccttctgtctgtgcactggggaaggtttccaagatacaccgcacagtgagaaaaacaagaagcagaacagtgcacggtgtgctacctcttacattacaaaggaggaaatgtaaaattaatttacaaatggccaataagcacatgaaaacatgctcaacatcactaatcattaggaaaataaaaatcacaactacagtgagataccaccttacatccattacgatggttgttctc

SEQ ID NO: 242565 - DNA, 424 bp, Homo sapiens
tctgcagagcttcgatggtgagaggaggaactcgatttctcgttttctggagttgggatgtagacatagagagatctgttacatctgagatgaaaaccctgcacaattcacgttagggttggccaattgtttgcttgaccttaaatggttagtgtggtttaagcttccccaaaatgcgctgtgagctgagcttccacttttggaatgattgcagaattcggtgcttaagagatgagaaacttcgttctaccagtaatggaagaaacgcttcaccttaatcaccctccttgtctttcccctccctttgactatgtaggactcgataacacaacatttgaaagattctactctatgaaataagcacagattgaaattcagtatttgccaaggaatattaaacatgaattactgggattgaggaaag

SEQ ID NO: 242566 - DNA, 481 bp, Homo sapiens
aaaaagacggcttcatggcaacctttatcctgcacctgggcatttctccctccctgacccacatgcaggcgggaaataggcagaccctggagaaggctgctttgagaacaaattacggatgcctggtcattgggcagagtgaggtcagagcttggaatgtgtggacttctccaatgaccagttgtgttcctgtgggcgcttgtgctgtaggctctgggaaagaggccatggggactgagcattcttagccataactgtttccacatctgtttctgaaataaagcagagatgagaggagggaggagaggacgggagagagagaatatttcactttgctataacactttgcattgctcaccaagcgcagtggctcatgcctgtaatccaaacacttcaggaggctgaggctggaggatgggttgagcctaggagtttgagaccagcctgggcaacatagagagaaccctgtctctaccaaaaa

SEQ ID NO: 242567 - DNA, 350 bp, Homo sapiens
tcattgagactgagtctcgctttgtggcccaggctggaatgcagtggcacgatctcagctcaccacaacctcctcctcctgggttcatgcgattctcctgcctcagcttccgagtagctggatttacgggcaccagcaccatgcccagctaatttttgtatttttagtagagatggggtttcatcatgttgaccaggctggtcccaaactcctgacctcaagtgatccacccgcttgagcatcccaaagtgctgggattacaggcatgagccaccacactcagcctaagaaagctttctcttaagcctgcccccaagaattagatgtctcatctctgtgttctcaccgga

SEQ ID NO: 242568 - DNA, 484 bp, Homo sapiens
agtcctccctcctcagcctcccatagtgctgggatgacaggcatgagccaccaggcctggcctgatttgtacttttaatatggtagtgtctttttccctaaaagtgggtgtggtgaatatcggttgtttttctgcccaacacctccccctttttgaggggaacgtctcctctctctgctcaaaccatgggtttctagtggtgctctctaaagtaatattctggccaggcacggtggcttaagtctgtaatcccaacactttgggaggccgaggtggggagtttgcttgagctcaagagtttgagacgagcctggacaacacagtgggacctgagaaggcatctgtttactgccttctttttaagtggtggtggtgttcttgttgttttgagacagtttcactctgttgcccaggcttgagtgcagtgagccgagatcacgccactgctctccagcctggacaacaagagcgaaactccatctca

SEQ ID NO: 242569 - DNA, 411 bp, Homo sapiens
gtttttgtttctgttcacttttcctgagaagtccatcttgccctgacaacatgactaaacgttttggaaagaccacatactattaaactttcattgaatgccaacagttacattgcatcgggaagtatctgttgaaaagtctatccaaatttccctctcattcatgttctgaaagtttctaattacagggcagggaaaggaaaaaaagaaaggaagaaaaaaaccctgtgagtttcacatctcttacttcagacttaagagactttgtacactcactaagactggttatttagcttagttataagaaacaaaggaatagaaaccctgctattttatgagtattcatgagagtggttgtgccaactagttgcagtaaggtttccagaactgagctaattctgggacaaaaaa

SEQ ID NO: 242570 - DNA, 528 bp, Homo sapiens
agagttacaacttcacacgcagcgtcgacgtccacatccaattctgtgtcttagccaaatgacataaaaatcaacttgagaaaaatacaaagtaatgtccttctgggagtttatttgcagtagtgtctggtttgtggctaaaattctggacttgaaattaggagagctgagtagaaacagaaatggaaatgtctgtgttcctttctcattttgaccaggcactgcctcagaacttttgacagttcaactttgttgggcctcagtttcctcatatttgattgggaagagagggaggctggaggtggagacaatgaagaaagggattgactattcaatgacttctagacattttatctaaagtgttacctgcatttccccaggccatgcccaatgagctatcaagaacagcaatgagatgctaatcctacagattggatgaaatagagggagctagaaccacatgcatcctgctccccacaacttctcccaactaatgcagaaggttcccaaggtttgtcagacagcgat

SEQ ID NO: 242571 - DNA, 348 bp, Homo sapiens
gcaacaagcttctcccaaagggcccaggcactgttcccacatggaaaagactctgctcttactgctggtgcctcttccacacctgatcccactatcaagaggaggcattttctgagtgcagcccactcacatgcaacactcattcctgctcaacccatttatttctacacaaatggatattcgggactttcaaatagttcatccagctgagcgtggtggctcacgcctgtaatcccagcacttcgggaggccgaggcaggtggatcatctgaggttgggagtttgaggccagcctggccaacatggtgaaaccccgtttctactaaaaatacaaaaattagctgggtg

SEQ ID NO: 242572 - DNA, 524 bp, Homo sapiens
gtccaattagtatggtgtcaccaatatatggatccatgcgattgattatctgtggagtgtccggatggtccaggacccttcagattatattacgaaggagaacaggaaaattaaccaaaacctgggcaagactgcgaatgtgtgctactatccatcccagttctggaggccggagttggaaatcagtttcactgggcacacatggaggtgtttgaagggctgcccgtgccagaggctctcagggagaatcccttccttgtctgctccagctctacctcctcctctgctgtgtggggctgagctgttgttctagaagaaaaaaggatgtcttgtcctgtgtgaactggaacagcgcttagaaatcgaggagcgtggccctgggaacaaaggctgtgtgctgttgtttttgcttcctcattaatgagcatgggccttcagtgagctcctttcccttgctggccttcatttgtaaaatgttggctgacggctaagggtgtttattcctctaaaatcccctaattaga

SEQ ID NO: 242573 - DNA, 539 bp, Homo sapiens
gcaatgtttattacttactgacttatattcatggcagaccacatcacattctttttgaatattcatattgagcctgttatgaagcatttcacataggaaaagcaatgtgtgaatcaatgaggaaatgaaactatgtatttattgacggtatttgtgagatatgcaagtgtgcagagtcttctgataacctcagaatgctgatacatttagcaaacctcattcttaaagttggccagataatgacttattttgctgaagtctccaaaaaagctgagttgtgaagcctttgaaaaagtatcaatgaactttttctttcaggtggggctgagctgttgttctagaagaaaaaaggatgtcttgtcctgtgtgaactggaacagcgcttagaaatcgaggagcgtggccctgggaacaaaggctgtgtgctgttgtttttgcttcctcattaatgagcatgggccttcagtgagctcctttcccttgctggccttcatttgtaaaatgttggctgacggctaagggtgtttattcctctaaaa

SEQ ID NO: 242574 - DNA, 383 bp, Homo sapiens
ggttttgctgaagatagcggtatataggctgagcaagatgtggggagatggaaatcataggtgtattttcaggtgatggtaactttgaggccttcaggttgctgtggtctgaaagcaagtgagacagccaagataaggcctgagctggagatgcctgttcggagtgtccccagcatagaggcagcaatggaagccatgaacgtgatcggatcacccagagtccacgtgaagtgggaggagggatggggtctagggctgagcacagggtgcccaccaggcttcttgctcaagtcccctactctggacagatctccatctgcatccaccacaccaacttctattaacactaggccaacagcggcagaaatcctgtctgcccttct

SEQ ID NO: 242575 - DNA, 511 bp, Homo sapiens
ccccgtggctccaattatatcaatagtctttttggataagggggcgactggggtggttactactgaatgttcagcaccagtatcgacaagaattatctgtcgataattgagcctggcccctgtgcttaagagccttggcagcaactgccctgctagcactagaggcagataagctacctcttgccctaactttatgtttagggcaaaacctaaacataaaggccccctagctgggcacggtggttcacgcttgtaataccagcactttgggaggctgaggcgggcgggtcatgaggtcaggagatcgagatcatcctggctaacacggtgaaaccccatctctactaaaaatacagaaaaattagccgggcatggtggcgggcgcctgtagtcccagctactcgggaggctgaggcaggagaatggcgtgatcccgggaggcagagcttgcagtgagccaagatcgcaccactgcactccagcctgggcaacagagtgagactccatctca

SEQ ID NO: 242576 - DNA, 713 bp, Homo sapiens
acataaaggaaatgcaaaatataaatatactaaaacattaagatatataaacactcaaactatcattacaaaatctatgtgaaatataaatcaggcaattgacagtaaataatatgaaacttgtactttgtttgctttagaaatattattttattttccaatatctttacctcggtcaggtggccaaactgtctgattagaaatatcttagcataaagatgaaaaatgcattctatgaactactatagcataaaggcttttgaatttcttctgagttgccattgatctgcacgcattcatttctgaattagaaaacagctaatattttgtgaaaagaggatacatatttctttaaattgagaaactaaatttcatgttaatatagtatcagtttattgtacttcagattttagcacaagcatttcagaacactgaaaaactatatttagagtgagatctacatattccatacagatggaatcagtccatgaatatatattggtatcattcttgccagtcctaataaaactctgtctttagtgtgtttgaacaaggcttaagttatacatgaaaactgaaacatcaaaccattatataccatttaagtgtagataaaataattttacatccgtacaatatttttaaatgttgactttagcaaaaacttaaaaattctctgaaatttgaaatgaaaattcatgatgcacaaaatt

SEQ ID NO: 242577 - DNA, 581 bp, Homo sapiens
aaatgaagttaatatctgtcctgctaacagtagtgttgtcagaatcaaatgaaataatatttggtaaactataaagtgaagaccaaatttgaaggactatttgtttttgttgtaatagagttgtatatagtccagatgtcaaccaggcctcttcagcatttttatagtcaaagatgtacaagatagctcctaatgctcttttatggctgctcctgttgccagggcaacagcctgcctagtaacaatctaacagacaccccccaaaaaccaaaaaataaaggttattctagcatcttctccttttaaaaatctttaaaataagagaattcagttcttcccaaagcagtgtttaaaaaaaaaaagtatttaaataaaatcaaggataccatcccacccacctatcttacattttgtgtggtatgagtggcaccattgtgtgacccaggtaggatagtggatgtacagtttagatacccattttaaagcagttagaaagatgtaacttgacaaggaaagcagtctcttttgtcattctacatttagtgcttcaggagtacttgatatatggaaggattttttta

SEQ ID NO: 242578 - DNA, 331 bp, Homo sapiens
aacatctgaaggaactagctccagacacaccatctttaaaaactgtcacactcactgtgaaggtctgcggctttattcttttagtcagtgagaccaattccagacacaagaccatctcatctcaagagaccaggacgtccgggcacccctagaatgtagctgctggcagagcctgaagtctatccagctcatgctcttccctgatatccttgacagattgtgggatggttcagcctctgcaaggacatggccaatgatggggggctggttttgggggcagcactctaggcaagggaagaaataaagtgtctgggaactggcgtggtgaagg

SEQ ID NO: 242579 - DNA, 520 bp, Homo sapiens
ttcatgtaaggaaaagtgaaattgaagcttataaattagaaatggatgagactaaggcaagagaagggaaggaagacaggaaggagatgcattcttatctttcccccaaggtcaaagtgatgcacattttctattctgtggaaactcaagactggacttttgaatcaaccaattccctctgacatcaagtgaggagggcaaggcacagctgtcagtgatttcaattccagtcctttacaatttcatttttggaggaggggctctcagtaaaccctgtgactcctatttaaacagaagcaaatgcactttagtatttaccctcttaagtttcagaacaagtcagggaaagaggagaaaaaaaggaatatgagacaaaatatttataatatcaggaaaaagcttaaatctttgcatgaaacaaaactgtactgcaagggattgtatttattcttccacaacactaaagaatatataaatatattattaaatttatgacaaaccatattttcatttcagtaaa

SEQ ID NO: 242580 - DNA, 812 bp, Homo sapiens
  misc_feature (145)..(145): n is a, c, g, or t
  misc_feature (156)..(157): n is a, c, g, or t
  misc_feature (161)..(161): n is a, c, g, or t
  misc_feature (165)..(165): n is a, c, g, or t
  misc_feature (167)..(167): n is a, c, g, or t
  misc_feature (170)..(170): n is a, c, g, or t
aacttatgctggtacgaggctggtttagctccgggaggcgctccgccgtttgtgtgctccgcgggaagatggggaaagtgagggggttgcgcgcccgagtgcaccaggctgccgtgaggccgaaaggggaggccgcccccggccncgcgcccctgnncggnggcnanccntccgccggctcggcgggggggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcaggcatgccacaactcctcaggacacatgtgtgggccaagtagagagcgccggcccctcaaggaccatggcctgagcctggtggacgcccttc

SEQ ID NO: 242581 - DNA, 796 bp, Homo sapiens
gctccttctcaaatatagaattttaaaaaggccatctcgactgccgcgggggtcgcgtcctctccatccccgacttggacgcaaaccccgggcttgggtcccccacgatctagacagaaactcgttgtttctcgtgctccgcgccacccgcgtcctccggtctgtttctcccaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcaggcatgccacaactcctcaggacacatgtgtgggccaagtagagagcgccggcccctcaaggaccatggcctgagcctggtggacgcccttc

SEQ ID NO: 242582 - DNA, 459 bp, Homo sapiens
cctcatcgccctgctttgccctgtgctgccttgggactctgcagagtccccaccagcaagaaggcctttgcaaagtacaaccccctggccttggacttctcagcctccataactgtaagaaatacattccttttctttataaattacccagtttcagctattctgttgtaagcaacattaagcagactacgccatgcacacattacctttaatagaaacttaaggtccttttcaacacttattaaagttacatcttcccacccacctcccgagacagagtttcactcttttcacctacgctggagtgcagtggtacaatctgggctcaatgcaacctccacctcccaggttcaagtgattctcctgcatcagctacttgtgaggctgaggcaagagaatcgcttgaacctgagaggtggaggttcctgtgagccgagatcatgccactgccctccagcc

SEQ ID NO: 242583 - DNA, 700 bp, Homo sapiens
cctgtaatcccagcattttaggaggctgaggcaggtggatcatgaggtcaggagatcaagaccatcctgaccaacatggtgaaaccctgtctaaaattaattagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcctgagacccccgtctctataaaaatatatatattttttaattttaaaagatagtcatgaatacaaaacag

SEQ ID NO: 242584 - DNA, 558 bp, Homo sapiens
atgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatgctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaa

SEQ ID NO: 242585 - DNA, 990 bp, Homo sapiens
atgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatgctgaggcaggagaatcacttgaacccaggaggcagaggttgcagtgagccgagatagcgccactgcactccagcctggcaacagagcaagactctgtctcaaaaacaaaaaaaaagggctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctataatcccagcactttgggaggccgaggcaagtgcatcacctggggtcgggagttcaagaccagcctggccaacatggtgaaaccccatctctactaaaaatacaaaaaaaacccacaagaatattggccgggcatgggggtggtggcatgtgcctgtggtcttagctattggagaggctgaggtgggaggatcgcttgagcgcaggcatggaggtcacgatgagccatgatcacaccactgcactcccacctgtgtgacagagcgagactctgtctcaaaccaaaaa

SEQ ID NO: 242586 - DNA, 616 bp, Homo sapiens
gatttcattatctaaaacgccctcttcacatgtgttgagtcacatctattaggtcctctgacaaaaacaagtcttaacaacagcgttagcaccacggaaaccagaagttcatgaatcacggagggatgctctgtcagccaattcctaactgccaaaccttcacccaggacatagggtggaagtgcactctctcaacagcgtctataattatgtagaaaaaggtccggcataatgactatttggacattccttacgcctgctctcttctgcttccaaacgtagaccaatctttaacctatcccaggctcacgaactctgatttgactctttacccacaaggaacttggtctggaggaaaagcccgggtggtataggtgacctcaaaagacatccaagtcaaatgaagcacagaaaggagatggaagaagactctgatgaggcgcagagaggatgccaattctttggctgtagaggggacaaagcacagtatttgggagtccaggaccaagtcggaggagaaaagcagggaagagaatgggttctaaggcagtggatgaggctcataacaaacaagaagcgtcttttaaatgtggagaaccctgatgggagcaagatg

SEQ ID NO: 242587 - DNA, 329 bp, Homo sapiens
tgcactcaagaaaaagttgggagctgtcagtgcagtgatcaggcatctccagagaccatggcaaaggcaggctgtaagaaattgccccttttccatatgttggttgcagacattatggaaacctgaaatctagttgcgacatgtcacacttgctttttcttgcaccttcctctgatattttggtggggggtggggggtggggggcagatttgggagaggtaaattacttggagaagatgatgctcaacagaatgagggaatacttgatgtgaaacataaatcaaatttgatcattaactaccattgtcgttatcaacagatcaagagag

SEQ ID NO: 242588 - DNA, 518 bp, Homo sapiens
tttgcaaactccagaccaaccaaaagtcacctgaataaatcagaaattcataggactgcaattcgggcccatgcaaaaactgagacttaacccaaaggtgtctgacaatcttttaaagagcattctcgggagaagctatttgactaatcctggaaccgccactcaaaaaaatcattttttaaaaaaaacggtagaatgggaacgggggaagtggagtccatttgtaaggttccggggaactgactcaacatggttctccaactcgaggttggagacaccgggattccaaaatgggaatccactcacttcgcttttataggacaaacgcgtgcacaacttggcttcgggctgcattcaggtagtgccgggaaccccgagctcccgggccgcccccacccagctctggccgctccattaaggacgagggccggctcctgtcacctcgcgacccacgcgcacacacccgccctaggcccgccgtgctcgatgccgcgggcctgcaaagtttccgcggccgc

SEQ ID NO: 242589 - DNA, 438 bp, Homo sapiens
ttaaattattgagagatgggggttaaaattgccaacttttatttggtgaatttgtcttatccccttggttatttatttatttatttatttttgagatgagatgtcactctgtcacccaggctggagtgcagtggcgtggccacctgagcctcccaagtagctgggaccacaggcatgtgccatcatacctcgccaatttttaaaattatttgtagagacaaggtctcaccgtattgcccaagctgatctcgagctcctgcgctcaagcgatcatcccatcttggcctctcaaagtgctgagattacaggtatgtgctaccatgcctaacctcaatttttgtttcatggattttgaggccctcatgagagcatacactttacatttattctatggctccatagtgatttgtccttttaatattattaagtgtcctttta

SEQ ID NO: 242590 - DNA, 260 bp, Homo sapiens
tgatatgagttggagtctcactctgtttccaggctggagtgcagtggcgtgatctcagctcacagcaacctccgcctcctgcgctcaagcgatcatcccatcttggcctctcaaagtgctgagattacaggtatgtgctaccatgcctaacctcaatttttgtttcatggattttgaggccctcatgagagcatacactttacatttattctatggctccatagtgatttgtccttttaatattattaagtgtcctttta

SEQ ID NO: 242591 - DNA, 382 bp, Homo sapiens
gatatcccatagtaacatctgagaaggagagacagacagggtgtggtataagatgtcctcctctgtggaggggaagcattcaaggcccctttcttcttgtgggttcttggcatcttggcaccttttggtgagccctgttcctaaccccagggagctcagatgggccatagcactccttcaacttagtgcggagttcacctgcatccagtttatgttcccttccccaatgttagcccataaaatatggcaaatgagaaagtacaggtagagtagaggcgaaggattgcatctctagctatgttcccatcaccaaaggagcctgggaaaattccgagactaaagtgattgcaaaatgccaccaggttgcacctaccccttagta

SEQ ID NO: 242592 - DNA, 241 bp, Homo sapiens
tcagaggcctgacacttttgttacaattaatgagccaatataattactttattattaaccaaatgctgggattacaagcatgagccacagcgcctggctggtaatggtattttcaaaaattaggtactgtagaattgtttcatacctggaagttaggttccaatattaaaaaatattgaatttagtaaaaattattcttaaaaaatctgttgacaccaataaaatatatgtataaaaatat

SEQ ID NO: 242593 - DNA, 458 bp, Homo sapiens
aaatttaacaatctttcataatacaaacacacaaaaactaagaatagaagggaacttcctccacctgatcaagggaatctacaaacaaaccacacctaacattacacatgtggtaaaagacagaatgtttttgccctaaggaagtccactctcaccacttctattcaacattgcaatggaggatcaagccaggacaattagacaagaaagaaaagtgaaagacatcagatgggaaagaaagaagtaaaactatctctgtttgtagatgacatgatctaatattaaaaattctaagcatgccacaaaataaactattaggcatataaaattagttcattaaggttgctgggtagcagatcaatatacaaaagtcggttggttctatacactagcaatgaacaatttgaaaataaaagtaagaaaatagttccatttataatagtatcaaaaagaataaa

SEQ ID NO: 242594 - DNA, 346 bp, Homo sapiens
agctttcagaagatggctcaaagacgcgtgggtatgagcagcttctctgttaaatgccattcccttgtttttttcaaaagatcatagattacggccggacactttgggaggccaaggcgggtggatcatgaggtcaggagttcgaggccagcctggccaactggtgaaaccccatctctactaaaaatacaaaaatcagccagtcgtggtggcacacacctgtaatcttagttcctcaggaggctgaggcaggagaattgcttgaacctcagaggcggaggttgcaatgagcggagattgtaccactgcactccagcctggcgacagagtgagactctctcaggaa

SEQ ID NO: 242595 - DNA, 544 bp, Homo sapiens
aatccagaattggagacaatggcgcagccatgtatgtgggggtctgtttccacacaagcaagtcctgttagagggacacatgtcaaaatgctagctcccactccaagttcaagttcccaaagttaacatcacaggaaattacaccaccaactgatttgccccaatgtcggctcctctgtctggaagtcgagtctgagaaggccattggtttagttcagctttggccaaaggaagggaccagctcagacaggaatgagtgaaagtgctggcctgattttttttctttttaaactaacattttccccaaaagttatcttgccattacccaagagtcataagtgaaaagacagccaaataccaaaaagccactgaggccctcaacagtgcctgctcatttcaaagccatttcacggacagccagggggtgcctgggccaccgcagaccacccctcactccaagagcactcctgctccccagagctccatgttccatgtaaagttccacggcatgtgcacaccacttcctaagaatgatgtcagcaaa

SEQ ID NO: 242596 - DNA, 455 bp, Homo sapiens
gaaaaatgtcagaaaaatagaaatttcatggctgggagtcttagagagaccaaacagaatataactataatgttacaatgtattctactcagaagagcctgtccatggccacagttgcctttactgtggattgataatacctttaacacttcagtaatccataaattgaaaagtttaggccgggcatggtggctcacacctgtaacctcagcactttgcgaggctgaggcgggcggatcacgaggtcaggcgatcgagaccatcttggccaatatggtaaaaccctgtctactaaaatacaaaaaattagccgggcgtggtggcgtgtgcctgtaatctcagctacttgggaggctgaggcaaggaaatctcttgaacctgggaggtagaggttgcagtaagctgagatcgcaccaatgcactccagcctggcaacagagcaagactccatctca

SEQ ID NO: 242597 - DNA, 323 bp, Homo sapiens
gataatggaactgaggctcagaggacctgccacgcactgagtggcaaagcagggaatgacattggtctgcctggctccaaagccctggctccttttctgtcttgccttccaagacctgtttatttaatgcatgatctaggtgtgcttcctttcagccccctgaaaacagaagagggtacaggttgagtatccctgtacttggagacccgaagtgtttcagattctggatttggaatattatgcaaatacataatgagataccttaggatgggacctaagtctaaatacaaaattcatttgtgtttcacatataccttatacac

SEQ ID NO: 242598 - DNA, 753 bp, Homo sapiens
aagaaattcaagataccatagatgaggaaagggaaatgagtgtgaagtttgcatgtgatcgtgtgatcacacagctaataagtatcatgaagagctttgacagttggtcttttgtctttaaattcagtactttgtgcaataaacactatactgggaaacatcttgtattttgactttgttttttctccccagaggtagctattcaggaaaaccgagacactgtcttatatgaaggtgtaaggctaggtagacctgtgacataagcctaacaatagcctccttctatgacttgccacaacttaaatagaatcccattgagatatcgattcacaatattcttctgccttgtttgggatacagagggacaagattgtctgtaaattgcatgtattaaggcaaaatagtgatttatagctactacatgtatcctcacattgctgcagaaaaatcattacgtgccaataacagagggtctcagactccaggtaggaacttcttctgaattaaatttatattgaataagcttactctatggggctgtgaagatgaaatgagataatccatgtaatatgcttggcatgatggctggtgcagactaagtaattgacactaatattatcaatagtaatattatcaatattaatgttagccataattgttttaaacatgttattatcactaaagaatgtaagaatacattctctatacattatttggtttattaaaatgtttctttttaattttttatttttg

SEQ ID NO: 242599 - DNA, 612 bp, Homo sapiens
ctaacacttgcacggtcagtcatgtacgttcacacacttggtcttctttctccctcaccaccaccctctaaggtaaatgtcattatctcattttttcagatgaggaaacaggcccagagagactaacttctctaaatcaaaaagttaagaagtaacagcccagggggtgggggagtctgagagtgaagggaagagtagcagaggcaaggccatcattaaccctggagcttgcgtggagccaggactgggtctcaaggcaaggccagaccaagggaggagtggaggagggaatgacatgaaattctttgccatgggatgcagactgtggaatctgttttgcctgtgctcaaggcttgtcctggttgggcatgaggtagaggctgcaaagagtccagggccctcaaatccagggaggggaagacgccaggtctggtaatgcagaaggcctgaggagagattgggcagggatgttaccctggtgatgacggaggtgggttggagttgattatatgggtgcaggccttgtccacaagcgaatgggaaacttcttccgtcctcctagctggcctgcccaaagcccttagcacagatcccatttctcaaaaaactatt

SEQ ID NO: 242600 - DNA, 703 bp, Homo sapiens
aagatttagatttgagctcttgcttctcaggaagtctataagttttaaagtaaaacaaggtttttcacaagtgaatggcagaagggaagaggttggagagctcattcattaatagacccactgataatcacaggcattttaagctagaaacatctttcagagataattgtcaatttccaggctacatttaaactaactggttaagaaacataaaaaaatggaaaagcagtggaagactggagtcaaggagcaaaggcctagattttcatatgagagctggaattatgctgtcattgactggttgtgttactctgatctggtaacattatctcattttcataatttgaaaacaaagagattatgctatttttaaaattttacagtatttttaaagtaatgtaagaacactcttccccaaatgtcttgactgagtttttctttaaccactcttattctctgaaataacctaaaactgtcctatattttattactttttcttcttgtcctacttacaatctgaaagagaagattgccatttatttacaactttccatatatctgaaaatgtttactgaatcacctgctggccttcttcttactagaaaaactattcattatttcattaaaaactttaaggctattttctgacctttaatcttaatgatatttcttcaaaatctgttttagttctggcagtcagaat

SEQ ID NO: 242601 - DNA, 362 bp, Homo sapiens
  misc_feature (205)..(205): n is a, c, g, or t
  misc_feature (273)..(273): n is a, c, g, or t
acctttttctgagcaccttccttctttttcttttcttcctgctttttctttttcttttcttccatcaaacgttcctcttcttgtgtttcttgctctttctccctttggttttttgatcagcagcctttttctgagcaccttccttctttttcttttcttcctgctttttcttttccttttcttccatcaaacgttcctcttcttntgtttcttgctctttctccctttggttttttgatcagcagcctttttctgagcaccttccttcttttncttttcttcctgctttttctttttcttttcttccatcaaacgttcctcttcttgtgtttcttgctctttctcccttctgtcgtcttctc

SEQ ID NO: 242602 - DNA, 481 bp, Homo sapiens
gagaaatatttgctgatgtgaatcttctaagagaaaaagagaaatgaatagtacaagaaggaggaggaggagaactgaattgctgggatggtgtcctaattaggtgaaagcgaacagagactagtgtgcaaatgaaaagatgacatataagagcttagatagtgccattcacagcaacaggtggggcagcagataattagagcaaagattgtgttgctcataggaccttctcagatcacacatgctctatattgtaagccaaatggtatcccctgttggccactactctgggacacaaatgctccatcaatcaaggaaattgggtgtttgtatccccaaaaaattagttcgtttcctaagaactccctaatccttgtacaaagagtaaggtatagagtaaacatcactccaatcccacttatcctaaacccatggctatcaaaattcaaaagtgaataagaacattctaacatcttgaaaa

SEQ ID NO: 242603 - DNA, 888 bp, Homo sapiens
ttttttactttttaaaattttttgttaaaaactaagacacaaacacacacattagccttggcctacccagggacaggatgatgaagacatcaccaggcaacagggacttttccactccagtataatttcatgggaccactgtcacatatgcagccatgtccttatgcggcgtatgactgtatttagaattaacatttcgtttacttcaatcatggagtgtctatcccagttacttttgagggaaagttatccaccactaatgttataagctactccagaaacatatatgtgccatataatttgcgattcctggagagaatgttctaagcagtagaaactagtaatttctaagaaacataaacacattcataacccccttaccttatgtaaaatagagtttataatttttagaggtatcattttaagattctgcaccaatagatggctttgttttcttttcaaaatgaagcacttgcttacaattcaaccaaactatcaccaggcgatgtcacttcgagtcagagtaatatttgtgcacagctcctcctgttttgtttatatggctagcaaggcggccattcctgatggtaattaccatgcgacactcattcaccaccaccaccatcatgtgtgggtgtctgcccacctctggcagtgccaggcttcaccagtgaaacacttgcatgttggggacatagcaacccttcataaatcactgctactgtgagagaacattctgggcttcgaccctttccctcaactgttcccatatcaggcattcacaactgcaatcctcccttccaaagcaaagaatctgcagtctggtaatgctccatggcataatatcaatgttcacgcgcgttaaagcaatcctaggaagggtcaaaa

SEQ ID NO: 242604 - DNA, 614 bp, Homo sapiens
cttttccctgctgtggtcacagagaaaaacgcaaccaatgtaagaacggtcagagagattcaacattgttggctttgaagatagaggaagagaccacaagccgaagaatgcaggcaggctctagaagctgggaaagagaaggaaacgtattctctgcagagctaccaaaatgcatacatccctgtctacaccttgattttaacctggtgagacctgtattgggcttctgacctatagaactctaagataataactatatgttgttgaacatgctaagtttgtgggaattgtaacagtagcaatgggaaatgaatacaccttttatacagtggaggatgactaaataatttattttgaaaatacaactgtcacaaggatgaaatattcatgatcacaaattggtgcattcttaactgtggataattatgtatgaagccaaattgtaataaaactgttatttgccaaacatagaaaccttgcttcgtgactaggctgagcccagagtgttattctcttcttctgcctgttatgtatctgggcaattgtagggcctttgcaggtgaatccagtagagaacatgctaagaatgagcagcagtcatgcatgactgtatc

SEQ ID NO: 242605 - DNA, 290 bp, Homo sapiens
ccacaaattgcatggctacccccagcccatgagatacaccattttgatggaaagctgagttatcaaaatcttagggctcagttcagctcctgaaagcagcagaactctgaggagtctgaagaatagaggaaaactaagttcaccttatatgtttctctaagtcctttggctttttacttgaagaatccatattctgtttttgtggtatttccttttctgtataaaggatactgagtggttttatttcaccaaaaataacacaaagtaaagtaaaaagtagtaataattca

SEQ ID NO: 242606 - DNA, 323 bp, Homo sapiens
gctcctcttaccatatgacgttttgcttattttaaaatacagccaccagactgaacccaccatggtctcagacactgacacacccatgggacacagagatggtagaactaagtgactgtcaccctgccatatccatacctgttccagagaagaagggtcagcacagtcatggttggtccaggactatcccctgcccctgaatccacacacgctccagcaggaaagctgcacgaggccctccaagttacggggctggcacctgaactcctgtttctgcactcttgcaggcagccccgagacccaggtgactgatggccatggac

SEQ ID NO: 242607 - DNA, 310 bp, Homo sapiens
gcacttgtgggtactcaataaattgtaggtatattgttactaattatgagtaagactaattttatcatgaataatttaatcatcattgccttattctggagatattgatgacataaatatcttttcattgaggcactgtgtattagagacaataaacaatgattcacccttcaaaagcacttttcttatacgtaatctcataggaagagcattatttcttgggatgtggtgtgaatgaatcaacatgtacaagactgacacgttgtctggaatttaggtgcccaataaatattatttaaatgaacgaaca

SEQ ID NO: 242608 - DNA, 383 bp, Homo sapiens
cttgctgaacccccccaggggttctgtgatacaaactgacatttcttattgatggcttcctctgcagactcttacgttgtaccatgtgctctgctaattcagatacacttcttttaccctttttctgtcttgtgacaggtgttttttgttgtttgtttttatttttgttttgttttgtagacagagttttgctctgttgttcatgcttgagcgcagtggagcgatcttggcttactacatcctcgacctcctaggctcaagcaatcctcccacgtagctgggattacaggcacctgccaccacacctgggtaatttttttgtgtgttttttttttttttttttttagtagagatgggctagttctagatcgcgagcggccgct

SEQ ID NO: 242609 - DNA, 578 bp, Homo sapiens
catgcctgtagtcccaactacttgggaggctgaggtggaagttgcagtgagtcatgatcatgccactgcactccagcctcggtgacagagccagaccctgtctccaaaaaatataaataaatacatacatacatacatacatacatacatacatacatatataatgtaaagtccttaaaatggcctatcaggtgcccatcaatccaggagtggataaagaaaatgtggtatataaataagatggaatacaactcagccataaaaaggaatgagttaatggcattcatggcaacctggatgggatgggagactattattctaagtgaagtaactcagggatggaaaatcaaacattgtatgttctcactcataagtgggagctaagctctgaggatgcaaaggtataagaatgatgcaatggactttggggactttcggggaaagggtgggaagggagataagggatataaggctacaaattgggttcagtgtttactgctcaggtgatgggtgcaccaaaatctcataaatcaccactaaagaatttactcatgtaactgaataccagctgttcccca

SEQ ID NO: 242610 - DNA, 231 bp, Homo sapiens
tggaagttgtgttgtggccccctagatacccctgtagacagtttctctcgcagagggatggtgatgagggaagaataaatcatggaagcgggggaagaatgcagaatttgaagtaatctgcgaaagggagatttaggagaaattggcctgagttggtctccttcctttctctttcctgctccgttgtagttttcatcattctctgctctgggtaacttgcagtgcagagga

SEQ ID NO: 242611 - DNA, 466 bp, Homo sapiens
cttggctaggcagtctgtctaatgctggatttcctactccaaggcagcattcaaggagcctaaattatcagtatacttgagggactttttccctagatgtactccactgaaggaatcttgaatgaaaagcttgctgggtttggggggtcttttaggtgtaccttaaagtgttagcagacacagattaggacaatgctgaaaggccagcccagctccagaattcctgcaggattgattgatgcctcagttgcaaatgtgttgcaattcaacttctccctctgcccagtcttgcatccctcaatccccacagaggttgctcttgccatcattaggtaataacctcctgcatacaaatttcagagtttcagtgtctatttcctgtgaactcaagttgcgatgggtcccctgatgacttatatcaaacatgtaacatgtgtgagaaataaacctttattgcaataagatg

SEQ ID NO: 242612 - DNA, 440 bp, Homo sapiens
ctagggcatagttttaggtgtcagggagtcttatttcacagcccactccaccacttactggctgtgtggtttgggcaagtcacccacactctctgagcatctagtgcctcatttgtagaaaggagattatatctcaatgcagggattaaatgagagtgtgggccgggcatagtggctcatgcctgtaatacctgcactttgggaggcagaagtagggagactgtttgagcccaggagtttgagaccagcccgggcaacatggagaaaccccgtctctacaaaaaatacaaaaattatatggctctggtggcctgtgtctgtctgagctactctggaggctgagatgggaagattgcttaagtccaggatatagaggctgcagtcagccaagattgtgccactgcactccaggctatgcaacagaatgagactctgtctca

SEQ ID NO: 242613 - DNA, 342 bp, Homo sapiens
ctcccaaagtgctggactacaggcatgagccactgtgcttggcctatatacatcacactttcctttatccacaagctgatgggcaccttggttgactccatatctgcaattgtgaattgtgctgcaacacacatatgtgtgcaggtatctttttgatatggtaacttcctttcctccttttggcatgcttctcctctgtccttttggggaaggcagtatcttcaatatttttagcctcagaagacatggccagaagttttgaaatcaccagcatgaattattgagacaagggatatcccttggtccctgagtgctccccagtgaagacctaaacacagactt

SEQ ID NO: 242614 - DNA, 415 bp, Homo sapiens
gttaaaaagagactggcaccaccacccccttgcttcctcccttgccatgtgagctctgcacacaccagctcctgctttgctttccatcatgtgtaagcttcttgaagtcctcatcataaccagatgctggcatcatgcttcttgtacaacctgcagaactatgagccaaataaaccccttttcctataaatcaccctgcctgaagtattcttttatagcacacaaaacaaaccaaggcagtttaaccagaatcccttcttaacccttacgtttccagcttagtaattttccatccactaaccactacaccctgctccacagctatgaattcccacttttacttgtattcagagttgagcccaatgtttctttcctactgctctctctgtggagaattgaaaaatatttgataaag

SEQ ID NO: 242615 - DNA, 496 bp, Homo sapiens
ccactactttaggataaagtgtatgcatatcctcaactctactagataaaaaacgtcaaactcattttcaacatggttgtatcaatttttgtctcactatcaataaataaatggaaatgcttttatatcttactgttaagtatgtttgttatgttttagtaccccttaacaggctaaggaagttccattctatgcctaatttactgagagacttttaaaatattgtgaatggatatattatctatttttttctgaacatgttgaagtgagtgtattttgcttctatcacctattaatttgttgaattctataatatactttctaaaatttaagcaaccttgaacatgattcatgtctttactttttttcttggatttgttctgctaatatattttgtttgtgttcttgacaagcatgtttgtgagtgagattggtctgtaagtgtgttgtcttggtttgattttgatataaagattatacttgccttaaacatgag

SEQ ID NO: 242616 - DNA, 465 bp, Homo sapiens
ggaatgtggtttaaccaagtgaaagatgtgattccacttaatggaaatacatgtcactaacccaggagtgagttaaattgcaagattacagatggaaaatgagcaagcatttaaataataatatggtatgttaaaattttcaaagtgctttcacatgcgaagcccaaaaaaggcgtggcaaatgcaaaataaggcagcagtggtttgtcaagaaaaggaagggacaaaaagtgtttaaggggatggtaaacatttgatggggaaaatgaaatcctagatatattaaaatttaaggcagccagtcaagccttagacacagtatacaacacattgctcagctggaaacaattgatatcacatcaaagactttcttctggaattttattatgttaaatactggctagaaataagttagatggggcttgatggatcttggagattctttgtctctctttttttctcttt

SEQ ID NO: 242617 - DNA, 585 bp, Homo sapiens
gcactagggatgatgcagagatggtctttcctgttttgtggacaagcaggcaggcaggcagagttcagggtcatgggctagggcagtcatgcctagtggtctctgagtgtaggattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaaaaccatgtgttttgtctttagaaaaggtgttgagtggacttcaaggtttagatctgtgctgtcccatacagcagccactagtcactagcgggcctggctattgagcacgtaatatgtggctattgagatgtgctctaattatcaaatacacaccaggattcaaagacctagtacaaaaaaagaatataaaatatctc

SEQ ID NO: 242618 - DNA, 142 bp, Homo sapiens
ctgaatttagtgtggacacctgatcagcataatgcagtactgcccagaactcctgggctcaagcagtccacctcagcctcccaagtagctgtgactacaggcatgctaccattgtatctttttttatgtgaattttttattg

SEQ ID NO: 242619 - DNA, 580 bp, Homo sapiens
cctaacatctcttggtgcttgttttcttatttgtaaaatggggacaataatattacctagggcatagagttatggtaagagttaatgattaaatatatatgaagcacttttgagagtgcttagaacacactaagcactaaatgaaacttagctattatagtaatactattgttgaaattgaacattagtgaaaagagcttcccagagaatacttccaaaaggggtaataacgtctgaattataagcttccggagagcaggtataatcctctcgtgtatatgcttatatggggaggacagtataaagaacgtgggagcacatcatttactctaaacaggcagttaactggatcaagataaaaagaaatttcagggatgcagctctgatcttccaggaatttggccaagtgtgtgctgaggtttattaaatgttttactaacacgtgagttcttgcctttttttctggcgggacctaatatataggcatcttttattctgaacctaggcaaggggaaggagaaaacctcatggcaaaatggtgaggaattgtgagacagaagtgtcatggtcagtcaataga

SEQ ID NO: 242620 - DNA, 531 bp, Homo sapiens
atgacacagtcacctcttaaagacctgcctcataatacccacattggggattaagttttaacgtgagtttcagatgggataaacattcaaatcatatcacagggtggtagcaaatagataaagcgcgtaagataggctctgtaaactttaatgtagtatagggttggctggcagacgtggcttcttaccctaatcctgctgtgtaatggcttaatagccatgtaatctgaacatgtttaagctatctgtgtgcctcagttttctcatttgtaaaatgggattaattatagcaactatagcactttgggaggccaaggtggggaggtcaggagttggagaccagcctggccaatatggagaaaccccgtctctactaatacaaaaattagctgggtgtgttggcgtatgcctgtagttctagctacctgggaggctgaggcaggagaattacttgaaacgggggaggcggaggttgcggtgagctcagattgagccactgcactccagcctgggtgacagagattccgtctc

SEQ ID NO: 242621 - DNA, 451 bp, Homo sapiens
taggaaaaaaaaaaaaccttctacagcatccattttattagagggagacattctttgtcacttgggttccagattaataattctagaatcctaccatgcaggagttgtgatttggtttcaaagaatcaaagagaaaaattttaagaggagggaacccagagaagggctagcaggtgtaaataacttccatgccctttatttcatctggggatgagggaaaggagaaggatgctaagcaaacttgaaagctcctcaggagatccttaggaaccccgtactgctgggcccctttctcctgcttcccttccagggctcaagcatccttgggcaatgcttcttcaaattttgtgtgtgcagaaaacatgtaccaatcttgtttaatatatattctgatgcagaaggtcaggggtggggtttgtgattctgcatttctaacaggcttataggggag

SEQ ID NO: 242622 - DNA, 382 bp, Homo sapiens
cacaccattctcctgcctcagtctcccgagtagctgggactacaggcgcccgctaccacgcccagctaatttttttgtatttttagtagagacggggttttaccgtgttagccaggatggtctcgatctcctgaccttgtgatccgcccgccttggcctcccaaagtgccaggattacaggcgtgagccaccgcgcttggcctattctagacatatttttaaagttttttctaaaatgttttatttttccttattttttatattctattagccttgactaaaacatgaatacacttttttagatagacttcatcaatttccagttccctgaccaaagaaacctactgtttgaaaaagacaagttccctaaagatgactgcta

SEQ ID NO: 242623 - DNA, 649 bp, Homo sapiens
tgagtcatgtttggcatgtatgtgttgggggggtgggcataggagttacacatttaagaaagccctatcttttagtagaataaattaatgcagattggcctgtcttcctgcctgcctggtcagtaacagtggactttggagattgatctagtgatgataaacctattgtatgtggcataagccagagaagtcagcttcgatagcaagtttctacattggcgtgagagagaagcatttagttaacatttcaaagtaactaagcctgttagcatccatgtattctatcagtagactttattgagtcctgtcatttgtatggtcttttattgttttttgttttcaacaaaggaaatagcacacacatacatctcaaaatggattatacctgttgtaatctcagtattttgggagatcaaggtgggaggatcacttgaggccaggaatttgaaaccagcctgggaaacatactgagatcctatgtctacaaaatttttaaaattagccaggtacagtggtatgcacctgtagtcctagctactcgggaggctgaggcaggagaatcacttgagcccaggagttcaaggcagcagtgatctgtgatcaaaccactgcactccaacttgggtgacaacatgggaccctatcttaa

SEQ ID NO: 242624 - DNA, 658 bp, Homo sapiens
aaaatttgaaggaaaaaagcataatcatacataaaaacagaaacttttctcgaagtcctctcatggttccattgtgttcatgatgtcccaacagcttaatgactccagtagcgaagattttttaagtcccttcacatcactctcatttgagacacttgtaactatctattttcctcagaatttagagaccctttctgagaatattggtcatactgacatttctgctattatttccttataaacaggcaagaaataacgcagaaaaaattggagtcaccagtgtttaatggaccttttcattctatgaattcacacgggacctaaaatttaaagtttagtgctgatcagaaactaaaatgaattccatgatatatttagtagagccaacaaatttaggaaaaggtaacacccaaaacatataccaattaaaatttgctggcttttgtgagtctggggttgtatttcttaatgaaaatacatcttcttaaatgtttaaataaacctaaatttagcatttatgttaatttactttggtacagattaaagattaaaagacaaaaatactgagatccaaacacaaggaaagggagtgactggtaatactctttaacagaatattaaaaacaatggtatgatttagtctactaaaaaaaaatcc

SEQ ID NO: 242625 - DNA, 405 bp, Homo sapiens
ggtctggagattggaatgtgaccttgcacttagtgaggtcggaaattattaaattggggcttccacactacacccagactacaccaggagaaacagaatcatagttcacaacgcaaacgaatgccaggaatggtcagtgagtcaaaggaccagtcaaaaacaatcacacttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattccagttcagttcctgggcataca

SEQ ID NO: 242626 - DNA, 640 bp, Homo sapiens
actctcaggtggtatgtcacatctaaaggtcttagtgaggtcagacttcaagccatcaacttgagataaataagtagcaactacagtccttgcttcatagggttgactgcccaactggggggaataaaggaaccacccacctcttctttagccagtgccttctctttatcctcttgccttggtctgtgatgttatcctcgctgtgtgacccaggggttaccgcactgtgagggaaactcggcatgcccttctgaagagtggcccaaaagaactggttagaaagagtttcaagcttccgtgtttcaattacagtggcattttgtgtttctactgagtgagagaagtttcaagttagcttgttaagaatgatttacaccataattctaggaaaaacaaatgtgagtgactgaaatttgaaaggaaagagtataggggggaagtgccagactaaacgaatcctaagtaaatagggtgtttctttcgggggtcggtagggggattggtttcttttaaaaaaagaaaaaaaaagaaaaaatgtatgtattgttggtaattacttcttttacctggaaagagtgaagcaggaaaaaataataataataattgctccatttgctccctgtaagagcaaattttcagg

SEQ ID NO: 242627 - DNA, 418 bp, Homo sapiens
caccatgcctagcctattttaattttattattattattattttctttagagacagggtctcactttgtctcccaggctggagcgcagtggtgcgatcatggctcactgcagcctcaaactcctgggctcaagccaatcctcccgcctcagcctcccaagttgctggaactacgggcgtgtgccaccatgccaggctaatttttctgtgaagaaggggtctcttgctatgttgtccagccttgtcttgagctcctggtctcaagcaattttcccaccttggcttcccaaagtacagggattataggtgtgagccaccacacctggccaatcaatatgtgctattttttagagaaaaattaatcaatttaattgtacctgtaattgactgaataaaaggaaactgaagtgaaaccaaaag

SEQ ID NO: 242628 - DNA, 632 bp, Homo sapiens
gtaaatggttttatgtactatgtactgttaaggatggataggtttgttggtatcctagtgggtgaggggtggctttggagttgcagttgatgtgtgatagttgaaggttgattgctgtacttgcttgtaagcatggggagggggttttgatgtggacacaggctataacacgagaaaccctgaggatgttatgctgggtgaaatgagctggtcacagaaggacaaatcccgcagggtggcactgagcagaggtccctggagaagtcggagccacagagacagaaagtaggatggctggtggctgccaggtgcagggaggggttgcggagttcctgtctgatggggacagagtttaggtttgggaactctacattttaaaatgtaaattttacagtatgtgtatcacaatacaaatgtattttttaaagtatagtagactttgcctcaaaagccccagttctttcaatctaaataagaaaataatgcaaaatacgccaaaggctttaagaccctgttcatcctaaggcaacgtaaccgttcacaaataaaggaatagctaagttaattgaggcccgttaacttactagcatattgtgctaccattaggatggatggccaggaagctccttcag

SEQ ID NO: 242629 - DNA, 234 bp, Homo sapiens
tttcatctaattgttgtaagagttatttcaaattatgtgtaaagaaaaaaggtaagaaaatgccgtgcctttagtaagctcatttctctatttattatgaaactgtttttttgtccattcctgttttagcagcaacacgtggcataggctttgaggaagaataatgttctctgcttctgtaccaagattagagtttgtttcagatatagctgatgagtaatggatgaattgtac

SEQ ID NO: 242630 - DNA, 567 bp, Homo sapiens
tcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtgagccgagattgtgccattgcactccagcccgggcaacagagcctgggcgacagagtgaggctctgtctcaaaaaattaaactaaattaaagctatgagaagaaaataaattttcctggtatagtgtccttctctagacctcatgtcctacagtctctgtgaaactgggccaaagatagaatttttttttctgtgctttatacagtgactcagacaaacctatgacctcacacaaatctgtaacttcatgtatcacagtctctataaaactatatcaaagaaag

SEQ ID NO: 242631 - DNA, 585 bp, Homo sapiens
agagatcagtggtaataagttgtttgaattttcgacaccagattaaggtctctgaggtggtttaaaggctatgaggccaggtgcagtggctcacgcctataatctcagcaacttgggaggccgaagcaggcagatcacttgaggtcagaagtttgagaccagcctggccaacatggcgaaaccctgcctttactaaaaatacaaaaattaaccaagtgtggtggcacacgcctgtcatgccagctacacaggaggatgaggcaggaaaatcacttgaacctgggaggtggaggttgcaggtgagccgagattgtgccattgcactccagcccgggcaacagagcctgggcgacagagtgaggctctgtctcaaaaaattaaactaaattaaagctatgagaagaaaataaattttcctggtatagtgtccttctctagacctcatgtcctacagtctctgtgaaactgggccaaagatagaatttttttttctgtgctttatacagtgactcagacaaacctatgacctcacacaaatctgtaacttcatgtatcacagtctctataaaactatatcaaagaaag

SEQ ID NO: 242632 - DNA, 446 bp, Homo sapiens
tccaagaagagtgccactaggcatcccctgggaaatgggccccctcaggaaccaaatggcccaagttgggagggcacctctgggaatgtcacatttacatcttcggctactacctggatggaaggcacagggattcttagtagtctggtttactcagataatggtagtgtaatgtctttgtacaatatctgttactacgctctgttggcctccctctcagtcatgtctccaaatgagccctctgacgatgaggaggagtaggaaggctcctcagattacaagtgtagactctgtgaacagttcagacacactgcaaattcgtgaactcacaggccactaatggcccataaaagttgccattttctaatgagaaacacatttttggtcttaataaagaaaaacaaaattccatggaaataaataataaacaatttaaatgagaaaaa

SEQ ID NO: 242633 - DNA, 178 bp, Homo sapiens
attcaacataatttattacaggtgaaaaaaaaaatcactgcatattaacaatctaacaaagttaccaggtaagcaaatacttaatgttaagataaacatataatacagtaatacctctattaacaaagacactgtgtatcagtgacatgttttccttggtggaatcttcttagtgaaa

SEQ ID NO: 242634 - DNA, 411 bp, Homo sapiens
cacacatccctcgccttctgcgcttgctgtttccctctgcaccagaggagctctggtgtcctgtgatggccttcctcaggacaatcagccccatacccagattctgagcaaccaagggcagtctggaaatggattgtgaatattcacacagttctgttatgctgtcgttccaatgcctggaatgacgttctttcagcttctctgacaaaatcctttcccaggcccagctcagtcatctctagaaggcctcccgcttcctctgtcttcgcatagctctttgttccgttactgtggcaattcctgtaaatttagccactcacgtgtcgcattacagttcatggagtatgcgcagcgaatcattcagactcactggagtatcgtgggtcttgcttggcgctagtctactcaaaa

SEQ ID NO: 242635 - DNA, 546 bp, Homo sapiens
agtatcgctcttttgcccaggccagaatgcagtggcgcaatctcggctcactgcaagctccacctcccgggttcacgccattctcctgcctcagcctcccgagtagctgggactataggcgccctccaccacacccggctaattttttgtatttttagtagagacagggtttcaccatgttaaccaggatggtcttggtctcctgacctcgtgatccgcccgccaaggcctcccaaagtgctgggattacaggcgtaagccaccgcacccagcccatgctttctttagtatataaaaagcagttacaaatcaataagaaaaatactaataatataatataaaaatgactaagaatagtaagagactgttcctaggaaagaaaatacaaaggttggggacagggtggaattttttttgagacagggtctcactctgttgcccaggctggagtgcagtggtgtgatcttggctcactacaacctccgcctcccaggttcaagcgattctcctgcctcagcctcccaagtagctgggattacaggtgtg

SEQ ID NO: 242636 - DNA, 599 bp, Homo sapiens
agtatcgctcttttgcccaggccagaatgcagtggcgcaatctcggctcactgcaagctccacctcccgggttcacgccattctcctgcctcagcctcccgagtagctgggactataggcgccctccaccacacccggctaattttttgtatttttagtagagacagggtttcaccatgttaaccaggatggtcttggtctcctgacctcgtgatccgcccgccaaggcctcccaaagtgctgggattacaggcgtaagccaccgcacccagcccatgctttctttagtatataaaaagcagttacaaatcaataagaaaaatactaataatataatataaaaatgactaagaatagtaagagactgttcctaggaaagaaaatacaaaggttggggacagggtggaagggaaactgagagggaaggagactgtactgtaccctctttggtaacttcttttttttttttgagacagggtctcactctgttgcccaggctggagtgcagtggtgtgatcttggctcactacaacctccgcctcccaggttcaagcgattctcctgcctcagcctcccaagtagctgggattacaggtgtg

SEQ ID NO: 242637 - DNA, 340 bp, Homo sapiens
agtcagtattttgacttaaattatatcaaatctacagatcagttgatggaccactgcaatttttatgatttggagacttctgatccagggacatgttcttttagggaaggatgtagagcaaaagatatgcataaacttgtgaaactttaccactgttcagaattcctcagagagagaaactacattcatcttggaaatccatattgcgtactttgaagaactgcagttcttcttgcaaactctttatttctttgaagttaggtcaggagaataatacggcatcattctgtggacaagccatggttattgccaccaaataaaatgtctctgtatcaagaat

SEQ ID NO: 242638 - DNA, 351 bp, Homo sapiens
ctgcaggtgagccccactggcctctcctcttccttccggacctcctcagctttggtaatggaaagctgcatcctcttctgtccccagttcctctctgggtgtcaggatctctaaaaccctctcagccgctgagaaatctgtctgtctgtctcacagtgtgtttatccgtgcatcatgaaggaccctcatacggctgacgtgccttggctgatgcgaataacactgcagcaagcgtgggagtgcagatagctcttggaaatacccatttccttcagacgcatactcagaggtaggattgctggattgtttggtcattttgatttttaaaattaaaaagaattttaattctca

SEQ ID NO: 242639 - DNA, 517 bp, Homo sapiens
aggttattattgtatagcacatggagaagctggtatcagctgaggcctgtaggcacttccagcctgagcatgttggagcctgcagaataccatggcctcaccttctccttgattcagccaaactctacatgtgcaacaaagtccaggctcctgtgtgtggcattcaagaaccctgattagcccctttggcctatacagaagttcttatagtcctatgaactaaatgtttgcatccccccaaattcatacgttgaaactcttatccccccccaatgtaatggtatttggagttgtgacctttgggaggtgattaggtcataaaaacaaatctctcatgagtgggattagtgcccttataagaagagatactgtttaccacaagaggacacagcaagaagatggccatgtgtaaactaagaagaaggacctcaccagaacccgaccacaccggtaccctgatctcagatttccagtctccagaactgtgaaaaataaatgtttgtgtttaagccaccca

SEQ ID NO: 242640 - DNA, 441 bp, Homo sapiens
caggtagaaagggttttctgtagacactgagtgatccctgtggttcctgctagcccacaacgctgttttgtctgatagcacatgaatctttctgcaccctgcccgccccccaccccccacccacactgtttttaagctgtaagaatgtgtgaccaggcgcggtggctcatatctgtaatcccagcactttgggaggccgaaactggtggataaacctgaggtcaggagtttgagaccagcctgaccaacatggtgaaaccccgtctctactaaaaatacaaaattagccgggcatggtggcacacgcctgtagtagtcccagctccttgggaggctgaggtaggagaatcgcttgaacccgggaggcggaggttgcagtgagccaagattgcaccattgcactccagcctgaacaacaagatgaaaactctgtatcaaaaa

SEQ ID NO: 242641 - DNA, 344 bp, Homo sapiens
tgctttcatggtttggtacgcagcaagtcatgggctggttcagagaaagggggtagctgaatggcctctactcttggtggcataaaagtcagtcacattgtaaaggagtgggcacataaggatagaagatgttgatttggctatattatagacaacctgccacagaaggacttctgtttttctgatcctcccttgagtttgaactacatgttccctgaggaattcctgcctgtggagatcaaattagaatttggattctcagcaggtggtttaataactgcaagcagttgccttcagagtccctgaataaaatcatcctcctggggtcctgggaaaggctttga

SEQ ID NO: 242642 - DNA, 614 bp, Homo sapiens
attggagcttctggttgttgggctatcagacttccagacttacaccttctcatcctgggttctcaggactttggcctcagactgagagttataccatcagccatcacctcttctagttctcaggctttaggacttgaactaaattataccactggctttcctgattctccagcttgcagacagcatactgggggacttcctggcctccataattgcatgagccaatttccataagtctcctcttatatatctttatatattctgtcggttctatttctctggagaaccttaactaatacaaagttcttcatatgaggcttctgcttagttttcttgattaagatggtgattcctgaatgagaccaaaatactcagggccaagccacatgagctaaaaggcactgacaatgctgagttaatgtagatatatcagaccaaagggtgcctgagatttagcttctttgctcttatcctgaaatgcagcaaagctgttgcttcatcatctagcttctgactctcagcatccccatctcctgatgccttcacttgaacatctttgctgggcagctccaccaccatctttgactcctcaagtatgctagcaacctgggtgg

SEQ ID NO: 242643 - DNA, 438 bp, Homo sapiens
tacagagtgtattttcttaataaatgagaaagagctccaattacttttctattccaaagtttatattcagttccaccactcgaattacaagcacggaaaagatttaaccatatatgcaatttctgtattcatgtatgagaaaacctgctgaagtgcttttaaataagactcaagaaaatgcttctggccaataagccatttaaaaaatgtattctggttagttggagaaacatccatgtgctcatattttggagttaaaggagccccatactgttttactgaaacttgttcttcagtatattatcagaaagcatgatgcaattctgtaggtttgccgatctgaagaaggtaaaggagtgaaataaatactcctaactacagctccaagtttgtaatccaatttctttgagtcctcagatatattcttaacaaaaatat

SEQ ID NO: 242644 - DNA, 344 bp, Homo sapiens
gttttctggagtgagaagctgtgtcaggaaaagaggattaggtaacaagtgacctagaattaggatgtgattctccctgaaggattgctgcagaggagataatgaaaggtaagggcttttccaagacatttccacattggactgacctccatctaaaatcttactaaatattaacacaaataaaagggttctggctgggcacagtggctcatgcctataatcccagcagaagtcaagggtggaggatcacttgagcctaggagttcgagactagcctagggaacctagagagaccccgtctccacaaaaaattaaaaaattagccaggcatggcaccaagcatc

SEQ ID NO: 242645 - DNA, 294 bp, Homo sapiens
taactcactgatttccacttgcctgagatctattaggattcctccattgcagatgttctgacacactgaagctatgccttacctgacaagctaatacccaattccttctagaactcatggatttatatttctgttctctccccgctcttgtccagacctttacatcctggattctttaccatttctgcccccaggactcttggatattgcattgtcactcatatccataaaacacgttaggaactggacattaatatgttaatgttattcaaaacacatccatggaagctcaaa

SEQ ID NO: 242646 - DNA, 357 bp, Homo sapiens
agcggggccagagcctggcggtcaagagcttctcgcggagaacgccaaactcgtcctcctactgcccttcagagccgatgatgagcaccccacctcctgccagagagctcctgcagccacagccgcagccgcaggccctgcactacgcgctggccaacgtgcagcaggtgcagatccaccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaaaaa

SEQ ID NO: 242647 - DNA, 1549 bp, Homo sapiens
ttgtttccacagcccgttagaggcccaagctcagggagaccctccacgtggctcaggagctcatggaagaacacagggtcctcagacagagtggagagtagcatgatgccctcttgacatggccagcccagcccctcatctcatccataacactgaagctctgtaaccactgtctttccagcagcaaaatctgggtcacaggactcggagctctagcagtcacttgtgtctaataaataactcccattgattttccagcccagggtctcacccttccttccccagcagcagctctgattgctgacacccagggcgcagggctggaaaattactcacacattattggtgctcttcctcccccatcctcacccaaggtgcatataaaccctgaatagcctgcagcctaagaatgtgaatctctacataataactaagttagaagctgggtgggcacaaccattgtgctatctgataccctcatcccggtcactgctgctgctgtaagagcccaagctaagaacatggacaagctactgtttgggtttctgtcctcactagcctcgtggaagccattgctcagacaagtagggaggtcaaaggtatatgactatgtggagtagggtaggtgggggtgtcagggatagatggtaggaagaaaagacaagaggttaccgaatataaaattgaatttgtgatttttttcctgttcacatttcaggtgaagattatatcttttttttttctctcacagacatgattgggaaggtgtttatttttcctaaagaatctaatagtgctcacgtgagcttgatcacacagctggagaaatctacagaacttcactgcgtgtcttcatgcttataccgacctctcccatggctatcgcctcttctcctacagcatccagaccaagagcaatgagatggtcatttttaagtctcaaattggggagtacaatcttatcattgggggtgacaaggttttcttcaaggtctgtgagaatttccccaccctggtgcacatctatgccagctgggagtcctcctcaggcattgctgagttctgggtcagtgagaagccttaggtgaggatggggctaaggcagggtttctctgtgggagcttaccccaagattgccctgggtagcagcagggttcctatggaggcaagtttggtaagagccagtccattgtgggagagattggagatgtgtacatgtgggactctgtgctgtccccagaagaaatctggtttgtgtatcaaggtatctacatcaaacccaatattctggactggcgggcattgaactatacaatgcaaggttatgtggtcacccagtcccataaatagagttgaagttctgcttcaacaggacaaagttactgggaaggaaatccccaacatgaaagaccagctctgaagacaattctacttcatgccttatgtctatttctctgttttctctgaatttcctatctattgaactgcttaatttacaataaaaagagatgcggccgaattttttttttttataatatgacagaaagaa

SEQ ID NO: 242648 - DNA, 1323 bp, Homo sapiens
ttgtttccacagcccgttagaggcccaagctcagggagaccctccacgtggctcaggagctcatggaagaacacagggtcctcagacagagtggagagtagcatgatgccctcttgacatggccagcccagcccctcatctcatccataacactgaagctctgtaaccactgtctttccagcagcaaaatctgggtcacaggactcggagctctagcagtcacttgtgtctaataaataactcccattgattttccagcccagggtctcacccttccttccccagcagcagctctgattgctgacacccagggcgcagggctggaaaattactcacacattattggtgctcttcctcccccatcctcacccaaggtgcatataaaccctgaatagcctgcagcctaagaatgtgaatctctacataataactaagttagaagctgggtgggcacaaccattgtgctatctgataccctcatcccggtcactgctgctgctgtaagagcccaagctaagaacatggacaagctactgtttgggtttctgtcctcactagcctcgtggaagccattgctcagacaagtagggaggtcaaaggtatatgactatgtggagtagggtaggtgggggtgtcagggatagatggtaggaagaaaagacaagaggttaccgaatataaaattgaatttgtgatttttttcctgttcacatttcaggtgaagattatatcttttttttttctctcacagacatgattgggaaggtgtttatttttcctaaagaatctaatagtgctcacgtgagcttgatcacacagctggagaaatctacagaacttcactgcgtgtcttcatgcttataccgacctctcccatggctatcgcctcttctcctacagcatccagaccaagagcaatgagatggtcatttttaagtctcaagtttggtaagagccagtccattgtgggagagattggagatgtgtacatgtgggactctgtgctgtccccagaagaaatctggtttgtgtatcaaggtatctacatcaaacccaatattctggactggcgggcattgaactatacaatgcaaggttatgtggtcacccagtcccataaatagagttgaagttctgcttcaacaggacaaagttactgggaaggaaatccccaacatgaaagaccagctctgaagacaattctacttcatgccttatgtctatttctctgttttctctgaatttcctatctattgaactgcttaatttacaataaaaagagatgcggccgaattttttttttttataatatgacagaaagaa

SEQ ID NO: 242649 - DNA, 358 bp, Homo sapiens
tggctcgcgcataccaggccggggccacagcgcccgccggcgcggcccccgcagctcgcgccctcggctcccaggcagcgggcgcagcagccgcactcgtcgagcgccgagatcccgggcgccgggcagggcgcaggcgccgggcagccctctggccggcacggaccacacttggggcgccggccgcccacgtcgcggatcccaaggctcggggacagcggcggcagcagcggcagcagcagcagaagcagcagcggcaagagcagagacaagcgcggcatggcttgctccgggacagcggcggcgcctctgcttcgcgctccgctccgcgcccgccgagcagtcaccgctcccgccc

SEQ ID NO: 242650 - DNA, 938 bp, Homo sapiens
tcaatgccagtggacttcccacacccaccatcacacctccatttttgccccgcctccatttccagacatttctagtccttctctactgtgtctcttttctctccaacacatggatttctttttacttgtgaccatttttgtttctcaaaaaaggaaaaggaaaaggaaatccacagctatgactgccttaatacctgctccacagagaagggagccttctggactgcaggctcaagggcaggccaaacttggtgatgctagtaagtgtccacaccaagcagctcttacgtgtgtacctctcatctgtctacacagctcaccggaaacgtgttttttttgtttgttttttttttaattgagatggagtcttgctctgttgcccaggctggaatgcagtggcgcgatctcggctcactgcaacctccaactcccagattccagcgattctcctgcctcagcctcctgagtagctgggattacaggcgcacgccaccacacctggctaatttttgtatttttagtagagacagggtttcaccatattggtcaggtttgtctcgaactcctgacctcaggtgatccacccgccttggcctcccaaagtgctgggattacaggcgtgagccaccacggccggcctcacgtgttcatttcttaactgagctctgtctaaccctgaattatggatggggatgcctgcacaaaacacggagatgtagaaaggtgagaaatttcttagagaagccagttaatccaattattttaggcacttctccaatgaactatagggctaacacatccacctttttcagtttttttgcctctgaactttgctgtagtatttcatggtcagtctcaactatccagatctgaagtgtgctagccccttttcccaacagttaagagtgtcacctctcagcgcttattcccaacttatc

SEQ ID NO: 242651 - DNA, 410 bp, Homo sapiens
gaattcggcacgaggtgaattgaaaaattattcttggagttgaacttacaggcctctgatgagattttggaaagcatcaggaaggaaacaagagtccaaagtgctgggattacaggcgtgagccaccacccccagcctgtgtactcatttcttgaagagcaccattctctatgcctgtattaatttcctttttcttttttataaattaagtctttaaagacttctgcagttttctctctcagtcttaggcatgtctacattatttcattatgtcttgttaaattcatttaatctatgattaaccctcagcctttacttaggtcaacagtctttgtcccttaccatagaattttttgaaaatgagtgcagatggcaaatgtgaaatggtgtaagtggaagaggtaaaacat

SEQ ID NO: 242652 - DNA, 424 bp, Homo sapiens
aatacttgtgcatgaatgttcagagcagctttaattatagtagcctcaaactggaaataagccaaatatccatcaacatgtgaatagttaaacagattgtggtttatgcatacaacggaatagtattcagcaataaaaaggaatgaaccagcagtagacatgaattttgaaataattatgctaagtgaaaaaagtcagaccaaaaagagtatatagtatatgaattctgtttacataaaattctagaaaatataaattaatctacagtaagtgcaaaaagagaggataatggttatgttcattatcttacttgtggtgtgggtttcaggggtatatacgtatgtcaaaacctatcaaatataccctttaaagatatgcactttattgtgtgtcagttatacctcagtaaaaaacatcaaacttt

SEQ ID NO: 242653 - DNA, 527 bp, Homo sapiens
accctttatcccttccacccaccaacaaatatttattgaacacctactatacgcttgctctggacactggggaaccaaatgattatctgaacccatatctatctgatcctgaaggccattctttttccattagagtctagtgaataaactcatttaaataatttcatagaaaattatattactctatgattagacaagatattaaagagatttttatggggtggtgagactatgggaacacataaaaataggcatgaaagactgaataatgctagatttagacacttggcagggaagacccaagccattttgcttgataggtacttaaccccagaaacaacaaaaataataacaaaattttacagtcacattttctgattatagaactttggaaaaaattataaagaagcaaaatttatttttaatgttataagccagagataataactgtaattattttaaagtatgttctagtttctcccccaacccttggctgcttcatatttagctggctttgaactttgtga

SEQ ID NO: 242654 - DNA, 482 bp, Homo sapiens
aactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttga

SEQ ID NO: 242655 - DNA, 912 bp, Homo sapiens
tggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttaccaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggc

SEQ ID NO: 242656 - DNA, 843 bp, Homo sapiens
agccatgcccttaaaaactaattctactttcaactagtttttttttccaccttcagtctgtagtattgttcacattttgaaaacaatacctacagtaacctgtgaggtaggacatgatagtgttttattggaccccttttactttatgaattggaaaaattaaatttgcatgtagtttgtaaaaaaaaaaaataaagaaagaaaaaagaaattgattgagattatttcagcagccagaagtgtgggacaggcagggcagttattcctccttctcagtttggaaactgaagctcagagagtaaacttgtcagtgacacagttattcaagaagttgtcttcagttgagagatatgtttttcacctgtagcttctggtattggaggagtacctttttagactaaacaaattacggttaaaattataaaggtatttttggagtacctggaaaaaatcagcattttgcttttctagttccatttagtaggaaggcaggaaagtttggtatacctgaattacatgtgagttatttctatttttctaaaaattcttataaattgtgtaaggtaaaaatgactacttcttgttttatggtaaatatagttatatcctttcaagccactgctgtacaaagttgtgaaatctccctgaggctttttccctcatgtcagcttcaggtatccagtatcacttatgcttgataatgattgtatgaaaatcattcagaattatactatgttttttcatataaagcttttgttttactaattttgaaatgactgttcctccattaagcgaatacagccctaagcataaatttggtttgttcatttaaaaatggtcttt

SEQ ID NO: 242657 - DNA, 275 bp, Homo sapiens
cctggctccagaggggagtcaggaggcccccggaagaaagcgtctccctcccggctctctgcttgccatcacccaggaggccgacgtggccagggtgactgcaggacagcttgtgtctttgcaagtcaaggtgggacagcttcgtcccaaagaccgagactacaggacttgacgccgcaatcctccagggtcggatggacccagcgcagaggagattcacgatggactgccctccctcccccgcccattctccactaaactaaggagcccctttt

SEQ ID NO: 242658 - DNA, 333 bp, Homo sapiens
gggattctaaattcaaaatatattcatccttccaactgttgcattaaagagatggtatgtggctgggagtgctggctcatacctgtaatcccaacagtttgggaggctgaggcagaggaggattgcttgagctcaggagttcaagaccatcctggacagcataataagaccttgtctttacaaaattaaatttaaaaattagctgcgtgtggtggtacacgcctgtggtcccagctactcaggaggctgaggtgggaggatgtcttgaggctacagtgagccgtgatcgtgccactgcactccagcctgggcgtcagagagagaccctatctt

SEQ ID NO: 242659 - DNA, 498 bp, Homo sapiens
attgaatgggaggagtatcagagaatttgcaactgctgtgtctcagaaaacattacaactaagtactttgacctaaaggagactggtggaggtctcagaagcaagaagctcactctgatttttcctgtctttctgtgtgaaggatggttgtaaaggaattgatatggttaggcttcctgtccccactcaaatctcatcttgaattgtcatccccataattcccataatccccatgtgttaagggagagaccaggtggaggtaattgaatcatggaggtgttttcccccatgctattctcgtgatagtgagtgagttctcacaaaatctgatggttttataagggattttccttcctcactgggttcttcttcttcctgccaccttgtgaagaaggtttcttgcttcccctttgctttccaccatcaattgtgagttttctgagggttccccaggcatgctgaactgtgaatcaattaaacctctttcctttataaact

SEQ ID NO: 242660 - DNA, 444 bp, Homo sapiens
attgaatgggaggagtatcagagaatttgcaactgctgtgtctcagaaaacattacaactaagtactttgacctaaaggagactggtggaggtctcagaagcaagaagctcactctgatttttcctgtctttctgtgtgaaggatggttgtaaaggaattgatatggttaggcttcctgtccccactcaaatctcatcttgaattgtcatccccataattcccataatccccatgtgttaagggagagaccaggtggaggtaattgaatcatggaggtgttttcccccatgctattctcgtgatagtgagtgagttctcacctgccaccttgtgaagaaggtttcttgcttcccctttgctttccaccatcaattgtgagttttctgagggttccccaggcatgctgaactgtgaatcaattaaacctctttcctttataaact

SEQ ID NO: 242661 - DNA, 485 bp, Homo sapiens
ctagaagactgatgagcacctattaaaggcatcaagcttctttccccatggtgtcattggatttgtttttgcaaatgtctataccaggcaagtgaaagctacatcatggcttataactttctgaaaggcaggaaattgaagagattgcagacaaatacaatcagaagtatgtccagcattggcagagtgagtggagagcagttcaattggaactgctgaattggtacagccaacaggctagctgcctcctaggctcagtacatgtactggcgttccagagagccagaaagatgatcccagacgcaaacacacccatcgtttttgaagcctagcacagggacaaaaaaatactgttaatgtttgtgagtcaagtaaacggattttagatactaaggtcacctagaaacactcattaagtgcccatatacttaatgttttatctaaatatatttcctgttaattaaaactcttaatgtcgctgtagt

SEQ ID NO: 242662 - DNA, 433 bp, Homo sapiens
ccagaaataatgagagtcaactttattatgcagtattaagatctttttatttttttactcttctctgttgaggtgacaatgttaagatcttaattatgtctactaattttaatattattagtttgacgaaagcttttatagcacttgctacgtgccaggcagtattctaagtactttacagatattgttgtttaatcctcataacatccttgcagtgtaggaacttctctgtcctacagatgagggagctgaggcatgagagattaagtagcttgactgggttctcacaggtgctgatggaaatagaatgtgaacctagtagagcagcttcagaactgatgctcttctttgccatattggaatatattactactttggaaattaatgatttattcaaggaagatagattaaaatgacaattcaaaactttctg

SEQ ID NO: 242663 - DNA, 475 bp, Homo sapiens
gattttctccccaaagcttctgctgcgtatagacacatctgcaaggcaccttttaagctgtttttgaaagttataaccagatactgattttgtgacaattctgtgatatacctgaacggttgcttaaacatagagacctaaagctaggggaagcattacataatggacatgaagcaaatgacacgaaactaagtgaacccactgggttgccagattatttctctcttctggacacaaaatcctgtaaggttttttctataggaactttcatttttaaattgctgggctaagtttagccaattgtctattatattcagttgtgatttttttttctaaataattttcttggacatcttttcttaaatttaaaaattgcatactaatggttacatatcactaagctgattaggaaatgtagtcttcacaaggtaaaaataagaaatttcccatcttaatacattaactttgttttcct

SEQ ID NO: 242664 - DNA, 594 bp, Homo sapiens
tttggagatggctatctacttactgtatccttgtatattggatagtagccagggagcaagctctcatttctgttatacgggcactgatcccactcatgagggcttcaccatcatgatctaattacttccctcaaacctcacccttaacgccatcacattggggcttaagatttcaacataaattttgggggaacacaaacatttagtacataactaacagactatataacaaaaatgcttttttatgtatatgaagtatagttgttataaccaaacaccagaaaacctattctgtatctgagacctgttttgcaataggctatttggtgttaggtaatgatcttctgacttgtaatcactcttggtattgggaaagtctaaaatattatagagatacttgctttcagtgtgtcatgaaattctctttcagtcactttctgaataaagaaactgttctgcaacagacatttgtgaaaggatttgtgaagacttacacaggattttggttgatcaaatgcaatctcaaaaataattatacttgttaagcagtttagactcttctcatgatatatgcattaaactgaagattataga

SEQ ID NO: 242665 - DNA, 496 bp, Homo sapiens
gctttcccactgggtgaattcctcagaagaagcaacttcagaatgtcactgcttgctgtctgagctgtgccacaatgcctctgaattagcctgagaagccttggtcaggaaaagcaaagaaatcagaattgcaggataaggcttctcccaaaagactctcaagaagtgtcctttctatctgtacagatcagagtgtttggacactgtgcagaagtctcatgaaaaaacatgtaactttatcctgaagacatctcagcttccctttttatgtggatgatcaagggtgtctgcaagtctgggaaaaagggatagaggagaattaacagccaatactccagggcctggcttactgatagggaaatggctgtgatgacagaggaatctggggaggcaggaggagcttgacagaaacaaatggatgtcccaaataggctagttcataattttttaaaagttgaatattaaaaaaataaaacatacaagttaaaaatgccat

SEQ ID NO: 242666 - DNA, 459 bp, Homo sapiens
aaatattgaattgtacccatgagaccatgtggccaggcaagaagaatgagataggccctttcttcaaagtatatgattttttttattattgaagaaattattcataaacacttgaaaacaaagcatattcaaagttttaaactgtacctaaaagatagtgccataagagttgtgagcttttgctaaaaactttgaccttaaaatgggcaactcatgaactatgaattattttaagggtctaatttattgcattttttgattcatatgaatttcccttgacaatgttaattcagttatcagggcaaatgaaaaaataagctctgtaaattaaaatacagaaatatttacatattgtggcttgtctctggaacttttataatgggatattatattttaacataatgttggcataaaatattataatcaagatatcagcaatatagttacaagttgttcttt

SEQ ID NO: 242667 - DNA, 575 bp, Homo sapiens
gtggtttaaaaaaaaaaaaaaaaaaagcacatagcagactggggaaaacctttgtggcaaatgacacagagtaactaatttttgtatttttagtagagacggggtttcaccacgttggccaggatggtctcgatctcttgacctcatgattcacccacctcggcttcccaaagttctgggattacaggcatgagccaccacacccggctgtacgtcagcttttaaaagctcccgtttgagttcatggggcttggtttacattttctttttctgccgggccttctctgtgtacagacttactggcatttttagctccgtggtccttgtgcacctgatccatggtttgacggaatcagtgtggtgttcatggaagccagatcttggttactctgatgccccatcagtgtgtgtcttcgtgtggacctgggcaggtggttggtacgtgtgcctcctctgaagcatggtcttgtcttggaactgagctagggacagccaagaagtgactcggacccaggactaggcttagctgtcaggccaagtttcaacggtttggcagaaacaaactcatggaattt

SEQ ID NO: 242668 - DNA, 383 bp, Homo sapiens
ctcacggcttcccttgggtaggggaaacaattccctgaacccttgcacttcccgagtaaggcaacaccccaccctccttctacttgccctctgtgggctgcacccagtgtccagccactcccaatgagatgagccgggtacatcagttggaaatacagaaatcacccaccttctgcgtcgatcttgctgggagctgcagaccagagctgttcctattcggccgtcttgccttattagattttccattgccaaatgtgtgccttacatttcaagggctttaccccatccttgacccttacaggtgtgcatcaacacgtgtaatcataagcttttattcccctttgcactcatctctaggtcctcttagtgcattattagtggac

SEQ ID NO: 242669 - DNA, 820 bp, Homo sapiens
ggcacatctcacatcgtggcagacaagaaaagagtgagagccaagcgaaaggggtttccccttataaaaccatcagatctcatgagacttattcactgtcatgagaacagtatgggggaaaccacccctatgatttaattatctcccactgggttcctcccacaacacaagggaattatgggagctacaattcaagatgagatttgggtggggacacagccaaaccacatcacgcctgtaatcgacactttgggatgccaaggtgggcagatcgcttgagctcaggagttcaagagcagcctggaaatgtggtgaaaccccttctctacaaaaaaaagagataagaatgaaaactactcattggctgtaaccacatgaaagttatctttatcgcaagctatataagtagaagagggtatggagagttattgtttaatgggcacagagacagagttggtgtttgggatagtggtcatggtggtacaacattgtgactatactttaagccactgaatggtacacttgaaaatggtttaaatggtaaattttttgttatttatatcttactacaattaaaaaaggggctactttggtatgctaaaatataccatcaacaactgaaaatgagctgaagaaaatattttcaaaaatgagattatatttcttaattcatagagtttatacaagtcaatttttaaaaagcagaacgattgcagttttacaagtcaggaatggttgattcacaaaaggaaataaagatgaacgaaatagtttaattatgaaaacatcacccttataaataataaaaagaagttaaatt

SEQ ID NO: 242670 - DNA, 414 bp, Homo sapiens
tatttttatgtgaactcatcattttagaaaaaaaagtacatggatcagctcaaagactgatttaatgaagtatcctatcattgggttatacataggtgctagttagagagtgcattattttgtcttgaaatatttacattgcaaaaataaattaaagaatgttttctaaagccattttagatttttttatgaaagtgtactttgatcaattgacacaaaaattcatgataattgcatcatatacttacataactccataacaaataaaaaataaaagaaattttgtgtgattttatgtacataatgtaaggatgtgtctttttttggccattctgaaattttatttgattcaaatattcttaattgactggtactgagtgacaagaattaaataaaaattgaattagtttaata

SEQ ID NO: 242671 - DNA, 396 bp, Homo sapiens
ttgccttttccaagcctgaagcagcaaagaaaaaggagataaataaattttgaactcttctctggagcctggagagctgcttcctctcaataaggagaattgcttcctgaacccagatgagaagtggtttctccttcagtccctattcactgcacagagtatgtggcctatgtatgctcgtgggtattatcttctgaaagagagttactgccatgtgcgcccctgttggaaatgtttcattggtacagaaacaacgtggagaccgaggcattgccttattgccttgtctgtttttgctttttttttttttttttttgaggtggagtctcacactgtcacccaagctgaagtgcaacagcacgatgttggctcactgcaacttccacctcccggatt

SEQ ID NO: 242672 - DNA, 286 bp, Homo sapiens
gcagaaccgagattaacagaaccttgtagactcataatggaagggtgagacatttgtaaaaatagtctgtctccaggagaaataacaaatgccaataaacagagaaagatgttcaacctcactaataatcaagaaatgtaagataaaacagtatatactacttcttatctgacagattgaattagaagacttgttggcagagcatgagaaaataaacccagtcacgcatctttagtggagtgtaaattggcagcagtcttctaggatatagtttctttgcctcctt

SEQ ID NO: 242673 - DNA, 720 bp, Homo sapiens
cctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcaggtgaagctcctgcctttctgcagcctctacaggcccagctcctgccttgcagtggcctctttaggccaagctcatgccccatggcgacttttccaggcacagcttttgccttttgcagcctgtccaggcccagaatgtccttaactcagcatctccaggacgagctcatcctcccagtgcgtctacaggcccgtctcctgcctcacaacctcctttggcccaactcctgctgagcagctggcagcctctctaggccacagacttcttaaggtaaagcttttcaggcccacctttggcctcccggcagcctcagcaatcaaactattccctcactgcggccaccgaaagccaagtttctccctgcctcacggcatcctccgaaaactgagcatttgcctcacggtggcctccccaggccacgaatctgcctgcctcccaggcagctgctgcctcacaatggtctctttaggcccagttcatgctaaaagatggactctccaggcacagctcttgcctcctggcagcctctgcaggcccaaattctccaaaagatggcctctcctaactcagctc

SEQ ID NO: 242674 - DNA, 255 bp, Homo sapiens
agtttttcatttctggccatgatacataaattttcttgtaaaatagatatcttgaagtaaaagtacaggtttatttaaacagttgagagtgatagtactctgctgtggactttttctccttgataatggatctattcattcctctgtgaaatgtaaaaataaaaataccaacctcgcaaggttgttgtaaatattacacatgactttgtcaactctcaaagtacaattaaaatgttcaaatgggaaggtaagaat

SEQ ID NO: 242675 - DNA, 626 bp, Homo sapiens
acatcacttttattatagtataccactacaattgttctatttttattattgttaatgtcttactgtgtctaatttatttatttatttatttttagatggaatctcactctgtgagtctcactctatcgcccaggctggagtgcagtggcacaatctcagctcactgcaacctctgcctccagagctcaagcaatccgcccaccttgacctcccaaaatgctgggattaccgacctgtgtgtactttataaattaaactttatcataggcctgcatatatagaaaaatatatagtctatacagtgtagagtgtgctactatctgtcctttcagacatccaccaggggtcttgaagcttatcccccagaagatgaggtgggaactactgtaaataattttgaccctttgaaatctgatgagacttgttttacttcctaacatatggtatattttgtgaatgttacgtgtttatttgaaaactttaattcctgtcagtaacagcttgaagtcttcagtacaaagcgtctgaacatctttcattccgtacaatgcattctgtattctgttttgtggaggtgccatttaggtataatacgttaattacttaaaaaaaattttgtatcttta

SEQ ID NO: 242676 - DNA, 295 bp, Homo sapiens
gaattatcagacccaagcaagtggagaataggaggcaagcaggagggaggaaagaaatgggcagaggccaggtaatgaggggccggggtaaggaccatgaccttttaggtcatgggtgatgggagtgtggattaacctaaccagtctactctgccctcccctcatccatccaacaccactgcccctcatccccatgtccagttcaaacccctgtccaaagtaacggttctcaaacagtggctcccagaccccttgatgacccattgtattattcaacatctatgttcataatgtg

SEQ ID NO: 242677 - DNA, 594 bp, Homo sapiens
ccctggtgaccacttggttaagggggccacactcattgagaaagttgagcccacccccatcaacccagtcccccactaccccactcctttctgcaggagtttccctgagacacaggttgttgggttttaaatcagggtaatgttggtggattcataaagctagatatagcatgtcattcttctcccacactccctctcctcagccccccaaaattgcagtgaatttaagcaaatcctacaaaattaaattgcccctttgctaaagatcctatatgtctccaatcctgccaggtgtagagtcagatagttggcttttggcctttaattttgctgctagctattaaatttaaaagagtatcattgaagtaagtaatattctcatttctgaaattaattttcccctcccagtctctctctctctctttttgccagcacagattaaatggttctttcagatctgcaaacaataaaggataaaattatttatagggaaatgaggatgctgttttattgttggcatattgttccagaacataacaacattttattttcaagcaggagaggttagaccagggggagaaagagggggaaagg

SEQ ID NO: 242678 - DNA, 468 bp, Homo sapiens
gcagaattccagccaaggagcctgtaattgacaacactggctcagcccagtggctgcttcacatggtttctctacttctaatgacatcaatttctctcatgccagtagtgccttcctttggcgagcaactatgcaataaggacatccgcttccttcggcgcttgatatcagccaggggattaacctgtgcagaggtgacttgttagtcatcagttactgcctcaccaaagtgaggtcaagttcacagcaggtttttgcaaagctacgtttttattgtcagcataggaagcattttcttacacatgcaatggatggttcactttagaggcacatctgaccactatgagagtttgtgggaggcatcagtgcacttgggttacagacaactgaataaagtacaaatacatcattagaaaagcagagggtgtgtgctccggtgacgttgcaataaagcaattctttggcata

SEQ ID NO: 242679 - DNA, 417 bp, Homo sapiens
gacctgagagagtctgtgtcgtgacctggcgttcactgcactgtcttgctgattgacaaggtaccagcttgagactgctacctgtgtctcagacccccctcaggagcgggattgaacaaacccagtgacaagtcccttctcagagctgtgtatcccaaaaacacaggaagaaatgaaacatggtcctcctgaggccggcaaccttggtacccatctgtgctctctggatgttaccagcctctgtaaggcagagatgttaacccagccagaaagcagaaatgccatacgggatgaggtggcttttcacagagccacgtgcagtttattcagcctctgcaagattggcgagaagcacatgaggttttagtttgggcgtgttttgaaaatagatgccaaaggcccctgtgccaactgcaa

SEQ ID NO: 242680 - DNA, 818 bp, Homo sapiens
ttcctgcccagaacgagggttccgcagcagaagccaggactgtgtgactgcacagtggggacaaagggcctggggcagccctgccccatgggacacaacagcctttgcaccaggatgggtgccccggtacgggccagctgaggaatgagctcctctgtgcctgccggggcccccacacccacagtgggaggaggcagggcagagaagccagctgcccgccccgcaaaacccgcccgaggctccgacagcgctggcctcaggccactcagccacttctgacccccaggtctcgcattcccttccccacaggtcttcgggtccccggcctcggcctcatgtcctgcagaactgccgaggccagggaatcggacaggcatggggaaggggatgtgagatctgagggccagatgactgccccctttttcttcaattattttcactgtggtaaaatacacataaaataaatttaccatcttaagccactttttttgttttttaaagacagggtctcactctgtcacttggcctggagtgcagtggcacaaacctggctcactgcagcaccaccctctcgcctcagcctgccaagcagatgggactacaggcaatgccgccaagctctgctaattcttgtcttactttttgtaaagacggggtttatgttgcccacgctagtcttgaactcctgggctcaagcgatcctctcaccttggcctcccaaaagtgctaggattacaggcatgagccactgcgcccggcccatcttagccatttataagtgtacagatcagtgctattaaatacgttcataatgttgc

SEQ ID NO: 242681 - DNA, 403 bp, Homo sapiens
tttggcaaataggaaattgcaggacactcctggggtcgtcctcaccctcccacactcacacagccacaatgttacagctgaccctgtgagtctagagtcgagacacggactgagggttgctccatgacctggtccccttctagatgtgaatcagtgcaagggcccaggacagcggaagaggtgtgaagccatcctgtgatcgggaagccacagggtgtccagacccagcgggagccgaggattcaggagaatctccccagtcagctccagaggtgcccacagtgtgagctctagtgtctcccaggtaggggccaaagcgtcacctgcccggccctgggggtgcaagtggagtggattttactcctgtccagaaaatggagtgagaccctgtctctaaataaat

SEQ ID NO: 242682 - DNA, 539 bp, Homo sapiens
gctgactctcttttcagattcagcccagttgcacccaagtaaaataaacagtcttgttgctcacacaaagcctgttggtggactctcttcatatggactcatgtgacatttggtgccgaagacctgagacaggaggactcctttgggagaccggtcccctgtcctcgccctctctccatgagatccacccatgacctcgggtcctcagcccagccgaaggaacttctcaccaattttaaatcggggacgcaaagccaacaagaatgaagaagtggccagatgtgaatcagtgcaagggcccaggacagcggaagaggtgtgaagccatcctgtgatcgggaagccacagggtgtccagacccagcgggagccgaggattcaggagaatctccccagtcagctccagaggtgcccacagtgtgagctctagtgtctcccaggtaggggccaaagcgtcacctgcccggccctgggggtgcaagtggagtggattttactcctgtccagaaaatggagtgagaccctgtctctaaataaat

SEQ ID NO: 242683 - DNA, 600 bp, Homo sapiens
gctgactctcttttcagattcagcccagttgcacccaagtaaaataaacagtcttgttgctcacacaaagcctgttggtggactctcttcatatggactcatgtgacatttggtgccgaagacctgagacaggaggactcctttgggagaccggtcccctgtcctcgccctctctccatgagatccacccatgacctcgggtcctcagcccagccgaaggaacttctcaccaattttaaatcggagacagaggagacacgttttgtccatgaactcaaaattctgctgctggtcacagactcgggaagacagtcttcccttggtgtctaatcactgtggggatgcatgtctgattattcacccacattccagaggtgtctgaccactgcagggacgcctgccttgatccttcaccttggtggcaagtaccacctcccctggatgggacgcaaagccaacaagaatgaagaagtggccaggtatggtggctcatgcctgtaatcccagcacttagggaggccgaggaggaagaattgcttgaggccaggaatcccagaccagcctggacaacatggcaaaatccagtctttacaaaaaaaa

SEQ ID NO: 242684 - DNA, 419 bp, Homo sapiens
ttaattgttaaattaagtgaatattttctagtgtaacattttaatttctttaataattttcacttttttggttatttttttagccattgctctaggacttgctgtatacaatttgatttaccagaatctgcttcatatttgcactcaattaattctggcaagatatagaaatgttatttgggaggccgaggtgggcagatcacgaggtcagaagtttgagagcagcctggccaacatggtgaaaccctgtctctactaaaaatacaaaaaaaaaaaaaaaattagccacgcgtggtggtggccgcctgtaatctcagctattcgggaggctgaggcaggagaattgcttgaacctgggaggcagaggttccagtgagccgagattgtgccattgcactccagcctgggcaacaagagca

SEQ ID NO: 242685 - DNA, 583 bp, Homo sapiens
tacattttcatcaataattttcagtctaaccctatgattacatgcttgccacctgccccccaaaataagtggtctatagccttgttagcaattcttcacaatgatacttatcatcaactggacatacttctacatttcaatttcaagatctataagtggaattttaaacatagtttttttttttttcattttcagtaatgatacagaacagatgttcaccatccaaagtatggcaggctttcatatttttaatactaacttattttagccatgtgtatatatatgcataggtaagagtcattaattaaactttattgacatataaaaataggaaaaatgcacaaaagtaaaggtacagctcctttacttttttttactgaaaagtagttttactactaaaaagcaaacacttttgaaatgaaatctaattaaaaaaaaaattactagcacaacggaaatgtgctttttgttctcctaatcagtacctacctttctgctccccaaaactaccaggtatacagtatacattttttgtgtatggcattttttgctcaatgttgtgtttgccaaactcattcactgc

SEQ ID NO: 242686 - DNA, 516 bp, Homo sapiens
caccagcatggaagcttgcaaatggatgccagctgcttggaaggaaatcctggatagagtggtgaagcactgttttaaggactgctgcatcacccacactgctgaggccacataagaggattttgtattggaaaatttgtgcattgtcaactctgagataaaacttgatttagaagtcttggactctgaatgtttaaaagatctagtagtacatggggctgggcgcagtggctcacgcctctaatcccagcactttgggaggccgggcaggtggatcacctgtggtcaggagttcaagagcagcccggccaacatgacgaaaccctgtctctactaaaaataccaaaaacaaaaaacaaaaaaacagctaggtgtggtggcatgcacctgtagtcccagctactcaggaggctgagacaggagaatcgcttgaacccaggaggcggaggttgcagtgagccgaggtcacgccactgcactccagcatgggcgatagagtgagtgagactctgtctc

SEQ ID NO: 242687 - DNA, 521 bp, Homo sapiens
atatggaaaaattgcataattatctatgggggtatggcacaccaattttaaaataatgttcacgtctctggagaaatggggtctcaggatgagtggagtctcagctttatctgtgacactttgtttcttgagagatgtgtggaagagaggagggaagtgatgagagggagtgaagaggaagagaaaggaaaacagagaagaaaggaaggggtgaagaggaagagagaggagaacagagaagaaaagagcttctgcacagcaaaagaaactaccatcagagtgaacaggcaacctacacaatgggagaaaattttcgcaacctactcatctgacaaagggctaatatccagaatctacaacgaactcaaacaaatttacaagaaaaaaagaaacaactccatcaaaaagtggacgaaggacatgaacagacacttgtcaaaagaagacatttatgcagccaaaaaacacatgaaaaaaatgctcaccatcactggccatcagagaaacgcaaatcaaaacca

SEQ ID NO: 242688 - DNA, 445 bp, Homo sapiens
gtaaacgtcaaaatatataaataatgtatctttttaaatgacagtatacttttatatatatctgtgtgtgtgcatgcgtgtgtgtgtgtgtgtgtgtgtgtgtgtgtgtgtgtgtgtgtgtgtttagagattgtgcttcactctgtcacccaggctggagtgcagtagagtgagcatagctcactgcagcctggaaatgctgagctccagggatcctcatgccttagcttcctgagcaagtgggaccataggcatgcaccgccatgcctggctaactttaaaaatgttttcagagacagggtattgctctgtgttgcccaggctggtcttaaactcctggcctcaattgatcctcctgcctcagcctctgaaagtgctgaggttataggcatgagccactgcacccagcttgatattatgttttaaaagtacagggtcaacagtt

SEQ ID NO: 242689 - DNA, 421 bp, Homo sapiens
gggatggaattctgccatttacatggtaaagattagtgattcttaaccctggctgtatattagaattacttagggaatttgaaaaaatatcatatgtggattctacatccagcatttctgagagatgtgtgtgttgaaaggcttgtgggtgggacaggggtggggagtggtccttgataggatgccagcatcagagttttttctaaaaggtccccagattctatatgtatccaggatgagaaccactctctacccttcgagctgaggcagggtcagatctgtgggcactgcataaaaaatggcaacaaaagggaatgtcctgagttatgtttatgaatgttgttgctaatgataagagacgattgagatatcattgagttgaacttcttattaaaaacacaactgaaacataaaattgata

SEQ ID NO: 242690 - DNA, 329 bp, Homo sapiens
gcaaaacagaattagaaggtgggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaaatcataaataaaaaaatagaatcatttagtatgt

SEQ ID NO: 242691 - DNA, 265 bp, Homo sapiens
caaaaacccttccctccacctccacttcccctactaccaagttttcctaatcccagtattccacagcaccattcacccagttgtttagagataactaggagccactcgtgattactccttttctctcgactttcctctttcccacttgcccatgctgtatttggagttcagccaatctttctccccaactgcaaaatcccattgcagtagtccctgtacctactgcagtagccctgaataaagtctttcttactgtgctttaaca

SEQ ID NO: 242692 - DNA, 390 bp, Homo sapiens
cactgcaagagttccggtctggcagagagcgcggagagacgcagagcgcgggccgctcctccagggcgctccaggccctccggccccgggtcggcgggtgagctagggggcgccccgggacaggccgcgccctctgccctgcagataccggaggcctctgctgtggctgcccactggctgggcccaggccttgaagcggtggcgaacgtctcttccctaccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgc

SEQ ID NO: 242693 - DNA, 615 bp, Homo sapiens
gtagacatgaaggagaaagaaaaggataagggagaagaaagaaaggacagagagaaaaaaatgaacaatcagagtaaaggcagcaagcattctctaactcctgaccgcgagtgatcctcctgcctcaacctcccaaagggctgggactacaggcgtgagccactgcgcagggcctcaaccagcgttctctagagcggtggatcccaaatgccatctgaggaccagcaacagcagcagcatccggttaatggagtcatggtgacactgaaaattcttcctgtgttggcatctgacagaggatttgaaaccgaatgctgaactcatgttaggaaagtgaagcagcaggttctctggagagagatggtctctgcatagcagaaatggagttcccccaagtgaagcgagtctggccgctggggcgctggcttcctcactgagacaccagagagggagccttcttccacattgtcatctgaagatttctcatcattagactctctcagcgcacccagaatgggacatggtgggtctgcagaaaaggaaacagtgtttccagatccttctagacacacgcttagtgcattaaaggaaaatcattcgcagtctaaatgggtt

SEQ ID NO: 242694 - DNA, 492 bp, Homo sapiens
gtagacatgaaggagaaagaaaaggataagggagaagaaagaaaggacagagagaaaaaaatgaacaatcagagtaaaggcagcaagcattctctaactcctgaccgcgagtgatcctcctgcctcaacctcccaaagggctgggactacaggcgtgagccactgcgcagggcctcaaccagcgttctctagagcggtggatcccaaatgccatctgaggaccagcaacagcagcagcatccggttttcctaggataatgtgttggagggctctgaaccccagaagcttcacacctagagctcttcagatctacccttggtcattgacatcccagcatgaatcagtgactcagtccttccagatggatgcaggaggagtcggagctggaggaaaaggcgatgtgatgacagaagcagaaattggagcgatgcactttgagatggaggaagaggccacaagccaaggaatgcaggtgcctctagaatctgata

SEQ ID NO: 242695 - DNA, 560 bp, Homo sapiens
gtagacatgaaggagaaagaaaaggataagggagaagaaagaaaggacagagagaaaaaaatgaacaatcagagtaaaggcagcaagcattctctaactcctgaccgcgagtgatcctcctgcctcaacctcccaaagggctgggactacaggcgtgagccactgcgcagggcctcaaccagcgttctctagagcggtggatcccaaatgccatctgaggaccagcaacagcagcagcatccggatttgaaaccgaatgctgaactcatgttaggaaagtgaagcagcaggttctctggagagagatggtctctgcatagcagaaatggagttcccccaagtgaagcgagtctggccgctggggcgctggcttcctcactgagacaccagagagggagccttcttccacattgtcatctgaagatttctcatcattagactctctcagcgcacccagaatgggacatggtgggtctgcagaaaaggaaacagtgtttccagatccttctagacacacgcttagtgcattaaaggaaaatcattcgcagtctaaatgggtt

SEQ ID NO: 242696 - DNA, 814 bp, Homo sapiens
ttaaccaattactctctttttggacacacgaacaagaagcctttatggagacttaaaatcatgtaagaatagtgtaaagcaataaaatccatgtccaactcttctcatttgtttcagggacaaactgaagattctaaaaatggtatgaggagaaatgtatgtagcatttaagagaaaagccagtaaaagaaaaagattgttcattaatgtacatagcaaaagaaatatcaaggcaaaatataccttctcttgccccctgccaactgatacaaaaatggaaaacatgatttcagaagtacagaggcttatcaaaagaaaaaaaattcaacgttatcattattagtcatgcctattttaataaagaagcacaaaatctagtcaagttcaatataaacctcatgcagataaatggaaggtttaggaaagaggttgatgaggaatgtaatgtttctgtgacaaaagaaagggaagaaacatattcactgagagttagaaaaaaaaatgtaattttaaagggaaaggaataatggaaatttggatctttcccaggttcttggggaaagtgtttacacgaatcccaatggacattaaagcttttggctgaaactctattgtctccttttgttgataagcctttggtatatgtatgcattcctgaatagacacacttacgtgtaacactgtcttctaataacagacagctgtagtgaaattttgacaagtctgaatagttgttaaacgcaaaaggctgcaaagatgatttttttcattaatatgttgttactctgggcagaggacagctgagtccaaaaga

SEQ ID NO: 242697 - DNA, 457 bp, Homo sapiens
gactccttctatgacaggtagtgatgggggatgcatcttgattttatatcagcatccattttactacagtcgctgcaagtcccattcttatcggattttaaaataagagtttcaggagttggcatatttttattctgtttgattctccttctaatcagattttccatgagctgatattaaaagtagtgtgcctttacttcatcagatagtgaagaaaggtgcccaggaatattttgaaaagtgaaaaaaaaaagggggagtttgcccagaatgaaaaattcaccacctgcaagctgcatttgcataattaagagttgctgctccatccatgggctctcactacaccctgccacgtgggcggggccacattgcctctcagcgctcttatctggccttcccagaccgtggatggtctcctcattagcttgcagatgtttagtcctcttttctgatgaga

SEQ ID NO: 242698 - DNA, 550 bp, Homo sapiens
ttgcagcgacaaggtgtctacctggacatctcatattgaaggctcttatttccagtgtcagctctgtaggaaaaatatctgtatctgatctgttttacctttttgacttgcacgaagtacttggtaacaagacactgcccttcaggagagaagcagcagcatgccggggcctcagcctggccactcttttgtttttctgtactctttgaaatatgcgtggctcaaatgccagggatgtaaatagaagtaagttaccagaataaagatgctatcagcgatgtgaaccggaatctacaggctgaggctgaggcaggcgtctgattagatgggctgagtgactccacgagacaacagtgtgcatttgcacctgacgccaggtgagatgagatactgagggtctgttacagccacttttaaatccatacgattaagaaatttgtgtgaaagagtgccagaaatgaggtgaaaaaaatctagcttccaattccaatgaggtaatttgtgtaagtctgatttggaaatgtttctctttattacatgttgaatctaa

SEQ ID NO: 242699 - DNA, 378 bp, Homo sapiens
ataaatatatagtttatatatttatatatttatatattatatattatataaaatatgaatatatatatgatatatttatataaatatatagtttatttatattttatataaatatatagtttatttatgtagtttatataaataaattataaaactatatatttaaatgtaaatatataactatatataactatagctatatatttatatatttaaatatatagttatacgtatttatatttaaatatgtttttatatatttaagtatatatttgtatatatttaaatatatgtatgtatttatatttaaatatatgtttacatatatttatatataaatatatataacaaaaaaacaataaaacagttaacacaaac

SEQ ID NO: 242700 - DNA, 516 bp, Homo sapiens
tttgagtgcttagtaggtgccaggctctgttctttgtgttaaatattcaaaggtgaatgaaattcatgcgatttctattcttatggagcttatgctttctcagtgttaaattttctattctcctgaacttactttctataattcatgtctttttatctttaagtgcttccatgtcactaatgagagttttcctcatgagaagaacagatttgtattttgctattctgggataaacaagaccaatatatttacatttttcttacagatgcacatccttatctatttggaaacaatgaatgctttttgctattctctttcaaatttaaagatcaattgagtaaaatattaatatatgctgatgtaatgttgactgtaaagtattagctcctgtctcaattgtggtttattagtcatgcttgaattttgtgtttattgattataaatatttacttttattttgtcatagattttgatttcaaatgtaatttttgcaacataaatgcccattcaaactct

SEQ ID NO: 242701 - DNA, 674 bp, Homo sapiens
ttcacctctacacctttgtgtaagcactctctgcctgccaagtttcctcctgttctccatctaatccaaactttccagagccctcctgcccctgaagataccccttaccacagcacagacttaagagccccttaaggtctgaggtccatgtttgaccttctcccgcttgtaagccaaaaataaaattcaaaggcccccagcaaccatctgaatgcactccctccttgaatagggcactcttggtttccacaacctcttactgtagccaagacattcctttctagtgataaccaattctcgacgagaaacagaaaatctatccaaaacctcgaagtgccgcctttctggaccaaaccaatgtatgccttatgtgtatttgattgatgtctcatgtctccctaaaatatgtaaaaccaagctgctccccgcccaccttggacacatattcttagggtctcccaagggctgtgtcacgggccatggtcaactcatatttggctcagaataaatctcttcgaatatttcagagttcaactcttttgcttgacaccttcataaagaaagcaacattttggaaacaacagccaaaggatattgtagtagtggaaagtggctattattgcagtgttcacaaagcagtcttttcctggtcttgggtctctacacttagaaga

SEQ ID NO: 242702 - DNA, 1001 bp, Homo sapiens
tgtagacacggagtctcactatattgcccaggctggtcttgaatgcctggcctcaaacaatgctccagcctcagccttccaaagtgctgagattataggtataagccaacatgccctgcccattgtttatttttaaattttcctctttttttgagccaaacctaagcaggttttccccctgacttttctgccagaactgcttttgtcaaattaaccattgaccatggcatcgctaagtctgctagtcattttccagtcttcatttttcttgtcataacagcagaacttgacagttggtcattctcttttctttgaaatgcttttgtgtcagtaggcttctgtttgtttgtttatttgtttgttgtgagacagtcttgctctgttgcccaggctggagtatagtggcatgatcgcagctcactacaacctccgcctcctgggttcaagcaattttcatgcctcagccacccaagtagctgcgatgacaggcatgtgccatcacgcccagtcttttgtcagtaggtttctataataccacaatttcctggccttttctccaccttgctggcttttctcagactctttactggatcctcctcttctccccctgcatctaaatgttggcaaaagatgtaagtaatttcatctagtttcatggctttaaatatttgttggctgatgattcctaaattcgtatctttattataggcctttcctttaactccagactaatccaactgtacttgaatgtctaaaaggcattgtgcacttgacatgttcagaacagctcttgacgttgccaacactactacttgaccagcctgtcttgcagaagtctccatctcagaaatgatgatacctctattcttctagttgctcaaaaagcttgagtgttgtcctttgactcaactttttgccctcccacatcttgtttgccagaaagtcctgaggcctctttcgcctaaccacctgtaccctcatcattttcatccaagccacca

SEQ ID NO: 242703 - DNA, 369 bp, Homo sapiens
tgtggtttttattttatgtgtccttaagagttaggcagagtttattttgcagttactaggaagtcatcaaatggaagcctctttcattcatgttatttcaacattctttgagcatctttcaaggtctaccagtcccggagccttccagctacatcctggaggggctggagggttccgcttatatttgtgggtgggtgcaggcctggcctgtagaaagaaggaaagcacacaggaagcagaagtgggcccaggcagcgggctttctggctggtgctggagaaaaggcgctgaaccggatctgtcaacttcagttacagctggctctgagcagtgaacctctctccttgttccttactgactgagaactta

SEQ ID NO: 242704 - DNA, 238 bp, Homo sapiens
gacagtcccagtttattgccaagtgctgtcccacactaattattaatactgtccccttttactctcaagagtgatgataaattaggacaccctaccaataagttgttatctagcttctgctaaagtgctctggaaatggggggaggcttgctaactcacaagttgcccattctatttttaaaaagctatactaaaaatatatactatatatgtaatacataaaatcttaagagtatta

SEQ ID NO: 242705 - DNA, 806 bp, Homo sapiens
agaaactgggtggacggggtcttgccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactctttttactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtgtttgtatt

SEQ ID NO: 242706 - DNA, 429 bp, Homo sapiens
ttgccctgattttctggaaagactaccacacaactagccagcctgcttgtgtatacatagctcgacagtcagtccagtggtaacccagctccacaaagagagctcaccagatggcctgttggctctccatgcccacttacactgggctagaaatccaacctggtgccctcatccccagcaaaaacatgtcaccactatcacgaacttctgtagcttaagtcattgaggcaatcccagacaccaccaatgaggatcacaatagaagaaattgtatggagaccacactactgagtccaactgaaaccaaagccaatgcaccatacccaaagaacccacaggacccacatatgatgtactccataaaattagaaaaaaacaacccttccactagatgcatagatatcaacatagagacacaggaaacatgga

SEQ ID NO: 242707 - DNA, 160 bp, Homo sapiens
tgaaagagactcagttgtcaaacccacagaaatacaaatttgatttttcccgggggaggaagaaggaagtgaagagaatttgggtaaactccatccatcctgggggttggatctgaacacttacagacataattggtaataaaaggcattaaaaactgga

SEQ ID NO: 242708 - DNA, 460 bp, Homo sapiens
gacaccagcagccaaagcactcctggttaagactcatttttacacaaatggctctcctagggccgtatgtattcaaagtaaatgcatctaaacgtattgtataatatgcccagaaaaatcatctgttcacccccatttccatttttatggggactccaatgaaggattctctttgtttagtaattaaacaggactaggatattaagagaaaggttctgacagtaggcagctttgagtcaaaagtattataattaaacagaagaaatgaaaggaaaagaaaataaagtaccatgcaaagatcgaacttgaaaattaatcggagatcagcggaatttctgaaactttccccctggttgaggtatagtcagccacacaacaaaagttcaactgatgctaattaccttctccattttctccattgtcttcctctcttttccctaactcttttaagttttctatg

SEQ ID NO: 242709 - DNA, 527 bp, Homo sapiens
taattttagcccagtgaggcccacatcagacttctaatctacagaactacagtgataatacgtttatgttgttttaagtccctgagcttgtggtaatttgttaacagcagcaaaaggaacctaatacacgaagggcaataatagtgccttcctcttgaggtggctgtgagctttacatgaattatgacatggcagcacttagaacagtagatggctctgccaggtatggtggctcatgcctgtaatctcagcactttgggaggctgaggctggtggaccacaaggtcaggagatcaaaaccatcctggcaaacacgatgaaaccccgtctctactaaaaatacaaaaaattagccaggcatggtggcaggcgcctgtagtcccagctacttgggaggctgagacaggagaatggtgtgaacatgggaggtggagcttgcagtgagttgagatcgcgccactgcactccagcctgggtgtcaaagcgagaccccatctaaaaataaataaataaataaataataaaat

SEQ ID NO: 242710 - DNA, 633 bp, Homo sapiens
tggcaggcagccctgcaccggacacacagtgacattcaacttcctgcctgccagccccagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccagggtctctctgtgttactcaggctggagtgcagtggcgtgatttctgctcactgcagccttgacctcccagcaggctcaagcaatcctcctgcctcatcctcccgagtagctgggactacaggcatgtgccaccacgcccagctaagatcttttttaaaatgcttaatccagaagtcattacaaacaaatactagatcttatttattctatctaactatatctctgtacccattaaccattctgccttccctgcctccattacccttcccaatctctggtaaacatccttctactctctgtctccaggagttcaactgtttttcatttttggctcccacaaataagtgaaaacttttgaagctt

SEQ ID NO: 242711 - DNA, 492 bp, Homo sapiens
ataccggccattgaaccccaagacagaatgccgtagctttgcccgaagcaaaataacacactaccaacatcaccgttgaatcctctgactcctgttccctgagatcactccctcaaataagctatctatctgcatccatcccttttctctggctcttctttttggggagacccatgataaaataggcagagaatgggtagctctagagtagtaaaaagaaagtaaccaatccaggtgtccatccttctcccaagcaatgcaagagtaaataactccattccaaaattcaggtgtaaactaggcatggtggtgaagacctgtaatcccaattactttggaggcttaggcaagaggattgcaggagcccaggagttcaacaccagcccagggaacacagagagatcccatctcaaaaatgtaaatttttaaatctagatacagattcttattaatctacagtaatggtttagtaatggttgtgtgaccagtttt

SEQ ID NO: 242712 - DNA, 462 bp, Homo sapiens
ccaggagtccaggccaggtgctgactcagttcaacagaagaattaataatgttttttaaaaaaggtgaaagaacaaatagaacatttaagccaattagaatatagaatgacctatgcaggaagcagtgtaggttatgattaaaagcttgaaccttggggtcagacagacacaggtttgaatcctagctctgtcacttttttgttgtggccttccaggcaggatacttaacctccctaaatcctggtttatttgtcgataaaatggggatggttttgggagtggtgagaactcagtgaggtaatgcatataaagaccttgcttttagccaccattattataatcactgtctcactgttgaaaaaggccagggattccccaaagtgacagtgccagagaaatatgctctgggtgctacaacagagagtacagacctcagaagcagagctcccggattccagacc

SEQ ID NO: 242713 - DNA, 438 bp, Homo sapiens
ccctacaaatatagggcatgttggggcttatgggactgaggaataatactcttgctcacccccaagcccctgggttaggtaccagttgagtgacacacgtggagtgtgacaaatggagaaatatcggcattcgaagaaaaaaaaaagggcaggctcaggggctcacgtctgtaaccccagcgctttgggagaccaaggcaggtgtatcactggaggtcaggagttcgacaccagtctggccaacatgatgaaattctgactccactaaaaaaaaaaaaaaaaaaaaaaattagccagggttggtggcaggcgccagtaatcccagctactcgggaggttgaggaactagaatggcttgaactctggaggtgaaggttgcagtgagctgagatcatgccactgcactccaacctgggtgacagagccagactctgtctc

SEQ ID NO: 242714 - DNA, 333 bp, Homo sapiens
aatacaagattggagggggaaaaagtcatacgcatatataaacaggcagtgggagaaaggaacccaacattattcggcatatttttaccctaatgtgttactttttcaaaaaaagctaaaaatgattgaagggaatcctgccacagaaaaagcctcctcaagctctactcttacactttcaagtgaatccttctttaagatttcccaggaagtacttctccacaatctcctcaagcaagctatatcaagtggtaaagcagccttacaaataagtgccaacaagttattattccacctcaggaacaacttagaaaataaatgcactaaagcaaa

SEQ ID NO: 242715 - DNA, 513 bp, Homo sapiens
agaagagcgtgtatttatcaagcactcgacacaatgtcagatgcggagtcagcgctccataaatgttggctgtcatttttgttctaacgtaagagaaagctggatgatcccatctgggtttcagccccgttttccctcttcactcctccggtgggtcagtgggagctctgccgaccgcctggctgcggccactcactgctgggactgcgcagcctgcccgctcccagcagctggcggagccgcaggacccccgcgccgcccgggccgccgccgttagggttggctcaagcctctcggcccagtccgccagttttacagcccgaactcaaagagggcttttaacttttcattcagcagcagcgtagctccgacttttaataacacacctcgtgcacgacaaaaatttgctcctggcaatcatggtttcgaccacaaaaccacagcggggaggcgttcctgattaactctttcagcgctccaggcagtctggagccggcgctcctggagatcaga

SEQ ID NO: 242716 - DNA, 608 bp, Homo sapiens
tcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatccccttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttatgtctcctaagactgtttctccaataaaccatcagcctgtactttttgttttcaacaataccaaaactagaaggttagaaacaatgactcatttgaaattattagcaaactttaaaaattctgactatggatatcctgtctccctttgttatgcagctgccaaccataaacctccaccactataaatgttgcatggaatatacgggatcacct

SEQ ID NO: 242717 - DNA, 400 bp, Homo sapiens
agactcataggggcttggccctgccctgagagagggtcatttatgaccattaaggccagaaggagagctttgtagtcctcactgccccgacttctctgtgaggcacatgctggcaagactctgcacccgccccttggcacgggtctggactctatccaggaagggacagagcatacatggggattatatgcatatttgacaagtgctatgctggaactctcacccaaatctaagaaaagcagcttacaaagaagacaaacacaggcaagcttgagtcatgaaaggagagcagcatgcgggatgggacttcctggattgagaccatggtttggctctgagcttcctgggagtcaaagcaaaatgaccaacaataaataattatgccattatcaaactaaca

SEQ ID NO: 242718 - DNA, 323 bp, Homo sapiens
tgtacctctctagtagtgctctctgattgaaggtcacagtggataaaaatattaatgaaggttcacaaacgaaacaaagcaaaaacagaaacaaaaccaaaaaaccagtggcttctatgcagtgaccatgtcccctgccccaagccctgtcttggctttgacagctgctggcccaggacatagaggaagaaatcaaggctcgtaactttatttttctccactttaaccaacccttgaatgctgaattgcataaaagacctgcttttttatgtggccaaaaaagtagttgtattacataaataagtacatcaccaactaagttt

SEQ ID NO: 242719 - DNA, 319 bp, Homo sapiens
gctggaagtggaagagggcagagcctcttgctggtgctctggcagggcccccgctcggtcaaaccagtgctctttctcttttggacctatgtatgttggtcttggtctcctagagctgcctccaccagaggcttccagcaaggattttttttccttctccttgctctgctcatgatcataaaagtcacacaccctctcctctaccctcgaacactggaaaagctggaaaagcacctatctctacgaggcaacctcagacactttaccaccatcttaactgtatggagccaataaaagaaaatgctgttgctatgccccc

SEQ ID NO: 242720 - DNA, 372 bp, Homo sapiens
tcctgggtttattgtttgtcatttgctagttttattttgcattgttttttgcccacatgcaggttttgcacatatttctgtcatggatttcttagtctgcatatcctaagtaggtgtcactattcattgagatatgaatagctctagttttgtatctcagtatgtttggatggtctgctaattttggtggatttttatctcttctttaatctacttccttgaaggaatgatttaaaactctaaaatcagttacactattttgttgaaaatatgaaatgctgtagagttgtcttctgatgccatgttactcatagctatcgatgagcgagtcacagactagattagtggaaggaaggaaggaaacaaatgaaa

SEQ ID NO: 242721 - DNA, 3677 bp, Homo sapiens
  misc_feature (45)..(46): n is a, c, g, or t
  misc_feature (200)..(201): n is a, c, g, or t
gaaggtaaatgacctactagtgcggcgaaccctgcgaggcgtcanncgtcgggtgcgcgattacttcgtataatatatcagtaggatagcaatcgcgagcatcatcatcagagcgcgacggttacgcgcgagctgcgggatgtccgcgcgcacgtacgccgcgcgcgcgcgaggtactgagaagaggcgctctcgctccnncaccgcggacttcaatgcccgtccccagctcgccacgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtattgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctc

SEQ ID NO: 242722 - DNA, 1459 bp, Homo sapiens
  misc_feature (45)..(46): n is a, c, g, or t
  misc_feature (200)..(201): n is a, c, g, or t
gaaggtaaatgacctactagtgcggcgaaccctgcgaggcgtcanncgtcgggtgcgcgattacttcgtataatatatcagtaggatagcaatcgcgagcatcatcatcagagcgcgacggttacgcgcgagctgcgggatgtccgcgcgcacgtacgccgcgcgcgcgcgaggtactgagaagaggcgctctcgctccnncaccgcggacttcaatgcccgtccccagctcgccacgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacaatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctc

SEQ ID NO: 242723 - DNA, 857 bp, Homo sapiens
atgcgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaggctaaagaacttgccactaaactgggttaatgtacactgttgagttttctgtacataaaataattaaaataatataaattttccttca

SEQ ID NO: 242724 - DNA, 797 bp, Homo sapiens
atgcgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgttccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaggctaaagaacttgccactaaactgggttaatgtacactgttgagttttctgtacataaaataattaaaataatataaattttccttca

SEQ ID NO: 242725 - DNA, 692 bp, Homo sapiens
atgcgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaggctaaagaacttgccactaaactgggttaatgtacactgttgagttttctgtacataaaataattaaaataatataaattttccttca

SEQ ID NO: 242726 - DNA, 770 bp, Homo sapiens
gtgtcaatccctgagcgctacgtggagctagatcccgaagagccacccagccttgaggagctgcaggcgcggtaccgcaaagccgagaagatccgcaacatcctcgcccggtcaagcatgtgcaacctacagccgacctcaggccaggaccagaacagtgtggctgacctggacttgcagctgcaggagcaggagcgcatcatcaacatctcctacgccctggcctccgaggcctcccagcgtagcaagcaggtggcagcccaggcagtgactgacccgtgacccagcatgcaaagaagcctggagccaggggcccagtggaaccagcttcctccaaggagatgacctttctgcccccaaggaaaccccttccagctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcagctgcacgtacagattcaggtacttctgggtgacaggtgttgtgggggcaggaagggcggggcaagccgaggctagtccaacttccaatgacctcaggagaaagtgagatttgaagaggtgttcccagtagactccagcaagaggctggttggcgtgctgt

SEQ ID NO: 242727 - DNA, 641 bp, Homo sapiens
gcggccgcattgccagagccccctgctctgctgctctgcctgtccgcctatctgccattccatcatgtgtgtgcagacgtgcctgctccctggatgccagcctctcactgtctcctgtgctttttgccagcccaggcagtgactgacccgtgacccagcatgcaaagaagcctggagccaggggcccagtggaaccagcttcctccaaggagatgacctttctgcccccaaggaaaccccttccagctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcagctgcacgtacagattcaggtacttctgggtgacaggtgttgtgggggcaggaagggcggggcaagccgaggctagtccaacttccaatgacctcaggagaaagtgagatttgaagaggtgttcccagtagactccagcaagaggctggttggcgtgctgt

SEQ ID NO: 242728 - DNA, 527 bp, Homo sapiens
ggtccctgcagggaggtgctcctggttttctacctcggtgaaggatctttgacacaggcaacctccatccaggcacccagtggaaacggacagctgaccatatagcccagtgccttttctgacacacttcttccttggggaagttgaggttgggggcgggctgtgcacagggctccccagcctccctgtgtgtctgcttccttccctgccctccgcccggtggccccatggcccacagcccacagggaagcaagttggtgccacccctgcctcccctccgcagccggcgggcctgtaaatgcctcccttgggcccccatgaggccagtgagccagaagcccctctgacccagaggtcactgtgaccagcacatcctggagaggaggcctcgcccttgcacctttcatctgcaagagttacttttacatttattttaaatgttgatttaagtatatacttcatctacagttatccatataaatagattcattacagggcctggctctgaataaacacagtaagttgga

SEQ ID NO: 242729 - DNA, 491 bp, Homo sapiens
agggtacagagaaacggatgtactgtttttcagtattttgggagggtggtttgagcagcatttattgacaatttcattagtggggatgtttctattgaaaacagagttaggaagtcataaaatgttcttgcaatataaggtaataataccactggcgtttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcacggatgtatgtttgaagtaagaagtaaagcataaagtat

SEQ ID NO: 242730 - DNA, 322 bp, Homo sapiens
tagatttaatcctcctttttctccttttaccctagcacttacttgttctctgattacaactcagtgtctcggagtattaattctttctttaggaattggccttcctactgtgttgtgagctcctggggacaggacctcagctcagtcatcttttatctccctctgcacatccagcatagtatgttacattgggtaggcctccatacatttttgttaaaaataattgaggtgaatagattagtaattaagcagaataattggaatatatatatgaactttggtccctagaaatatcaaattttttcctggtgttacttgtgtt

SEQ ID NO: 242731 - DNA, 374 bp, Homo sapiens
cacagtagcacaatcttggctcactgcaacctccgcctcctgggttcaagtgattctcacacctcagcctccctagtgggactagggaggactccctatagtcctagctgggactataggtgcatgccaccatgcctggctaatttttgtacttttagtagaggcagggtttcaccatgttggccaggctggtctcaaactcctgacctcaagtgatccgcctgcctcggccccctaaagtattgggattacaggggtaagccaccgcgcgcccagctcgaatgacttgcatttagtgttctaattagctgtgtcaaacacttctaaaatttttgaaagtgcttctcctcctatttagcttatttcccttgtgg

SEQ ID NO: 242732 - DNA, 577 bp, Homo sapiens
gagtctcgctgttcctcaggctggagcgcagtggcacaatctcggctcactgcaacctccgcctcctggtttcaaatgtttctcctgcctcagcctcctgagtagctgggattacaggtgtgtgccaccatgcctggctaattcttttgtatttttagtagagatgaggtttctccatgttggtcaggcttgtctcgaactcctgacctcaggtgatccccacaccttggcctctcaaaatgctgggattacaggtgtgagccatgcctggcctaaatttttttttaaagaaaatatgctattttgaagaaaatatgtatgatgacatgttactatatgatgtatatggtgatatgttactatgtgaggtaatatgtatagtaatatgttactatgtgaggtattgtgtgtggtgatatgttactatgtgaagtagtatgttactatgatgtgaggtagtacattaattagctagatttagtcattccacagtgaatatatacttcaaagcatcatattgtacaggataaatctctacaagttaaatctatttaaatctaaaaagataaatctattt

SEQ ID NO: 242733 - DNA, 498 bp, Homo sapiens
caaatgaccacatacaatgatggtcctgtaagattataataccgtattttactgtgcttttttatgtttagatatgtttagataaacaaatacttacaatatgttacaattgcctacagtgttcagtacagtaatatgctgtacaggtttgtagactaggagcaataggctatacactaggtgtgtggtaggttatacaatggaggtttgtataagcacacctacgatgtttgcacaacaatgagatcacctcatgatgcatttctcagaatgtatgtccatagttaagtgacacataactctatatgtatgtgtgtatgttatgtatcatttatgtattttttaatttgtatgtacattattttgctgccctcctccaacccatagcaagtttctccagactattacagttgacccttgaacaacatgggtttgaactgcacaggtccacttacatgaagattattttcaaataaacatactggaaaattttttgga

SEQ ID NO: 242734 - DNA, 615 bp, Homo sapiens
caggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgcatacctagaagacctgaggtttatcacaagacatagacttggaccaggcgcagtggctcatgcctgtaattccagcattttgggaggccgagataggtcccctgagcccaggagtctgataccagcctggg

SEQ ID NO: 242735 - DNA, 325 bp, Homo sapiens
gagtagtggtttctgttccattgtggtttttttgttcatttttctgcatattccattctgtttttattatagttttaaaatgtagtttgaaattatgaaatatgatgtccctctactttgttctttttcctcaagattgctttggctattcaaagtttattgtagtttcatgtaaattttagaattgtattttttattactgtgacaaaaatgtcactggaattttgatatggagtatattgaatttgtagatcactttggataacatggcactttaacaaaatttattttttgaatccatataaataaaatatttttaaattta

SEQ ID NO: 242736 - DNA, 284 bp, Homo sapiens
gttctttcagtggcccttgttctttcccaattgttagttatcacaggacctttggtcttgtttttatttttaggaaccagttgttttatctggaacaccgtagagttgttttttgttttcagctattttacttagtaagactctctgaaaatgttcagtcgtacattggagattttctgaagtggcaattttccatttctgattttttcccctaagtttcttgtttgaggtctgggcccatttattcaaacaaacaaacaaaaataggacaagattccctttat

SEQ ID NO: 242737 - DNA, 482 bp, Homo sapiens
cagacctcagtatttgtgccagaacctcaatggtctcctctgttttcttccacatttggtctcagattgatagtggtcacaataaggaaacaacctgtatttattttagaaggtaaagtttaaaaaaattgatatattaactaaatcaagtaacttgacatcagataatgtgttttctcattatttctggttttttttgtactgctcatcttctattcattattccttctctagataaaatctgtcagtgataagagtttcagattgtacatttctagataatttatttcacttccatttattttatgcccaaaaggttatgagataatattaatttatggtgagtagcttgaactttgactagttccctgaaccttgttgaaggcatatgaacacaaagtacacccgtttagcccattatttgggggaaaaaaatgtgtgcccaagtgtttggatgttttattgtgtatttccaagtaatc

SEQ ID NO: 242738 - DNA, 261 bp, Homo sapiens
tttattttttgtagagacagggtctctctatgttgcccaggctgatcttgaactcctggcctcaagtgatcctcctgccttggcctcccaaagcactgagattataggtgtgagccaccatgcttggcctggtttatgtcttaaggggaccattctgcctgctgtaggagggaagggtggacattgagggacctggccaggcatggtggcagtgtggcctagggcagcagcaggggcagagagcaagacgggtcaggcctg

SEQ ID NO: 242739 - DNA, 618 bp, Homo sapiens
tatctagaggcgaggcggcagatcttctgcaggggcacgatgtcgccatccatggaaaaggccccatcggtggccaccaggaacagccgatgcttctgggcctcctgaagcttggtttctaggtaggccacgtccaggtggcaatagtggtacttgtgggccttgcacaggcagatgccgtggatgatggaggcacagttcagctcgtccgacaggactgcgtcctcgggtctcagcaggacctcaaagaggccggcgttggcgtcacaacagctgggatagaggatggcatcctcccgctggtggaagcgggctatttttgcttctagattcttgtggatgctttgggttccacggatgaagcggaccgagctaaggccagctccaaagagcctgcagacctgcctgaatcacctcagggtggctgctcaggcccaggtagttgttggcacgttaagttgaggattcctccggagacgccgtccacgtggatgtgcggcccctgacgggacgtgatgacccgctcactcttccaggtgccagctccgcggatcccttccagctccccctccagaatgccgcgcagctgggccagtactgactgcgcgctgcggccgc

SEQ ID NO: 242740 - DNA, 285 bp, Homo sapiens
gctgggtcctgccaagcagaagctcccaggctagcaggggagacagctgggcagcgagtgtgggagagaggaatgcagagggctgcagctgtgggcaaaattttagaccccaaaggccacacagcaagtccacactaaatatgggctatttgaagttgcttagggcatcagtcatagatgcacaaaatgtcagagttggcagcgggaatgttagaaatcatcagttctaacaacttatttaaaaatatttaattatagaattgttagaaaatactgccaagcata

SEQ ID NO: 242741 - DNA, 815 bp, Homo sapiens
ctcaaagtcatgtatgaattcagtgcaatctcaatcaaaatctcaccatatttttgtagtggaaattgacaagctgatgctaccatttacaaataaaaatgcaaggggccaagaatagccaaaataatcttaaggaagaagaaaatggaagttttacctcaccagataataagatttactctaaagctacgataattaaaacagcgtgttcttagtgtgaagatagacaaatagaagaatggaacagaatagagtctaaagaagaactcaagggccaaaagtagccaagaagaacagatctggaagacattatccctccagatatcaagatctcttataaagatatgtggtatcgacgcaaggaaaggcaagctgaccaaggcaagctgaccagtggaactaaacaaagtccagaaacaggttcacacatatagtcatccggtgtgtatctttgtgtgtgtgtatttcacaaaggcttaaagtaatgtgtcttcaataaatggtgctacatccaaaagagcataactatatgtttccattttatatgaagttcaaaaatagacaacagaatagtgattacctctggagcagctgggggctgcctctggtagggtgggggtgttgcctgggaagaagcatgagagaatcttcaggggtcctggaaatattccatatcttgatttggttggtggtacactgttgtgtataatatacacgtatttgtacatgtgtgtataaaatgtcattgagctccacatttaagattttttggactttattatatgtatgctaacctcaataaaactaaaaaattc

SEQ ID NO: 242742 - DNA, 522 bp, Homo sapiens
agaataacttaggttatggatttggctgtcatttactagttgtgtgatatttgataagttaaataacttctttgagtctcttatttcctgacctttaaaatgggaatatttcaaatggtggtgggatggaagaggtatcatatcacatggtgcctagtgcggtaagcactaagtgtcagctctcttcctccctgactgcaaggcagtttatttaaataaaatgattcttggccgggagcagtggctcacacctgtaatcccagcactttgggaggctgagatgggcggattacctgggatcaggagatcgagaccagcctgaccaacatggtgaaaccccatctctactaaaaatacaaaaattagctgggtgtggtggtgggcgcctgtaatcctagctacttgggaggctgagacaggagaatcgcttgaacccaggaggcggaggttgcagtgagctgagattgcgccattgcactccggcctgggtgacagagcaagactccatctcaaaaaaaaaaa

SEQ ID NO: 242743 - DNA, 496 bp, Homo sapiens
ttggtaaacacaatctgccacattatttattgccatttttatttttccttttgtgaattgcccagccatggctgtgtccttccatttttttctgttgatttataaaactatagtacatacctcaaatcttttgcacggataaaaattcttttttccaagttttaatttagaattcttctacctcaagtagaagaatataataagagtgtgtttcatttactttatatgcttccttttaaaaatctgttaggatgaaacaattacagaatcctatgtgtctaaaaaattaatatgatattatatatataaagccatttctcaaatattttaaaattaactccattacattacaaattcaaattctatcagaaagtaattatagcaaatggtacacaaaagctaaaaatcactgtcttcattttaaccctctactacaatgggcccttttctccccttataaactacatataatcaatacctttggttaataattaaa

SEQ ID NO: 242744 - DNA, 437 bp, Homo sapiens
ccatagtttaatctagtcactttctgaagcttcctgctagcatgaaattgatttttttacctagaaaattaacatgaatatttattgacagaagtgaagactatatttgcacagtcagctaagagtgccagtaaatttaataaaaatatttgggttttgttttacccaaaagtatacaaataggtgatagaaggttttgttttcttttgttatggagttattgactttgtttgttttgtttttcaagctctagcagtacctttataatatgtcatatatgcccttaaaccatctcctcttcctcttcctccttgtttttttattggatagtgttttttcagtagtgcatggaaagactgttctttgcttcttttaatgtcttcatttgtctttaactaggtaaacaggatttactgctactgtagcctacccagaaa

SEQ ID NO: 242745 - DNA, 684 bp, Homo sapiens
cgctgcagcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagttggaactgataatgggagagaagcaattgaaagtggggctgcatttctcttcatgacatttcacttgaaggactctgttggtcacaaggaa

SEQ ID NO: 242746 - DNA, 3490 bp, Homo sapiens
  misc_feature (1683)..(1683): n is a, c, g, or t
  misc_feature (2837)..(2837): n is a, c, g, or t
cgctgcagcggggcggtgacgtgtaggccggcgccagctccactctgtccctcctcgccgggtctgtgcgtctttgcgtctgtctgtctgactgatggtcctcacacgcggttccctgtgactgggcgcgaccccggcaagcgcggcttggagggcggacggggcgcggcgatacagctgcccgctcgcatctttggccctgcgctcagctcctcacccggcgtgggaagttaaagtaaaaccgaaagggaagaaggcgcggtggcaggagctgacagagtgatgggaaacgcgtgagccaggccgagagtttcaggtttcttgctgtatggatcactgattgaataatagatggctttacctcgtctcacaggagccttgcgttccttttcaaatgtcaccaagcaagataattataatgaagaagtggctgacttaaagataaagcgatctaaacttcatgaacaagttttagatttgggcctgacatggaagaagataataaaatttttgaatgaaaaactggagaagagtaaaatgcaaagtataaatgaagacttaaaagatatattacatgctgcaaagcagatagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtttaaaaattacatgattcagtagagaaaaagcattttatgaatatctaacattacttatgataaaaaatctcagcaaactaggaatagaaggggattttgttaatctgataagctgtagctataaaaaacttggagaaaacatacttaatgctacaaagttagaagcttccctgaggtacggaattagacacaaatgcctgttaccacttctgtttctcactgtattaaaaatccttgctaacataatatggcaagaaaaagtaagggcataaagactggaaaaaaaaacttttccatttttcacatgactgtacctgtagaaaatgaatttaacaaggttaatataaaaatcaattttatttctacttactagaagcacattaaaaattacacttatctttatgtaacgtaatacattttaccttaaattttaaaattttattttacgtttacaaaagcatcanaaacatcaaatacgtaggagtaaatttaacaaaaaataagcaagacttcatggaaaactaaaatattgagagaatttaaagaagatctaaataaacagagggatataccaagaattggaagactcactattataatgatatattttttacccaaattgatctgtagattcagtgctatcccaggcacagtcttatgtttgagggtgtgtgtgtgtgtgtgtgtgtatgtgtgcatgtgtgtgtgtggaaattgacaagggtaatatgaaagttatatggaaattcaaaggcaaagagcagcctggttaactttgaaaaataaaaagggagaacttactctagtagatcttaaaacttattataaagataagtatacagtgtggtgttggtccaagaataggcaaatggactagtatgacagaatatagcccagaaacaaacctacggatagaaatatacttgatttataatgaaggccaaacaatagtgagacaaggctattttttcagtatatggtgctgggtcaactgcatatacagatgaaaaaaagtacctattttacaaataattttaaacagcctacagaattaagcatgatacacaaaacaatacatcttctaaaagatgtaaaagagtgtcttcaggatctttgtatgtgcgaaaatttatcaaacagagaacaaaaagtacaaagggaatgattaagttggactgtagtaaaattaataccttctatttattaagagtaaaaaggcaaaacatggagtgggagaatatagcttcaagatatataaccaaaaagagagcttttatccaggttaaatacgagctcctacaaatcaataaggaaaggacagataatcctatatgaacatgagtaagagctttgaacaaggacttcacaagagatagttgaccagtaaacatgaaaagggcttcagcttcattggtagtcaaggatatgccactgcatgcccattagaatggttaaaatgtaaaagactgacatacctattgttaggatcaagaatgtgaactagaatttttgtctactgctgctagagtttacaattggtacaaccactttgagtaactgtttgacagtgtctactattacctactgtggttggacaagtgaaattttaaatcttagnacataaatatccaataaaaatgcttgtacatacatgtatatcaaaaataggtgcattcattgcaacattatttgtgatagccttaatgtagaaacaacccagttcattgttaaaaagcttaagttgtagtatgtagactgccttatagcagtaacggattacagctatgtataacattgtaagtgaatcttataatgttgacaaaagaagccatacaacacatattatgattccattaatatgaaactgaaaactaggcatgaccagtctctggttttagaagtcaggatagtggctgcttttgaggaaggaggtagtgactaggagtgaatatgagggaggtttctggggagctgataatgttctgattcttgaagtagttaaccagattacacaggtgtgttcgttttttgataattctttgaactgtatgtgtactgtatattttcttgttatattcaataaaaagaattactatgatttttatattacatagattaaataagaagtatttcagattgataagtaacacatgcttgtgtatttatttagcttaaggtttggctatcatggtgagaactcctatgtaccctgctcaggtcctggtaaacagtatcataagtataataaattggtgtttttcattctcatgc

SEQ ID NO: 242747 - DNA, 504 bp, Homo sapiens
agagttcaaagagttttacttcccacaaagtggcagacagggtaatgtggaacaaccctctacagagaatacctagaaaaactgcaaaatacaaaatttgtttgactatatcagagaagttatcaaagcagtgaagatttttggggccaagatgtggaagcagaaattaacccagaaaatgtgatcctggcatttgggctactttttcctagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataat

SEQ ID NO: 242748 - DNA, 219 bp, Homo sapiens
  misc_feature (9)..(9): n is a, c, g, or t
gaattcggnacgagagagaactagtctcgagtgacaatggaaatctctttgcatagttgtaagcctgagtgattgagagaatcaggatttctatgctgtgcaactcctaggggcgacattgaccttgaagcacacttcagtggcacataggatggcacagaatgtagctcctgtagccatgtgtagcaacaagacatgaggcagaagtctgccggcatt

SEQ ID NO: 242749 - DNA, 564 bp, Homo sapiens
atgagaatttactctttcatcttagttttccctgaactggagggcttactgacgtgtccatatttttttaaaccctgataaactatgtagagcacagtttagcaaagactatcataatttaaaatgcagatactctttgactcagtaattctgcttcatgagtacagagatacagcattgtatggcaaaatattgcaaatgcataatcagtgaggggctgattaaattgtgatgtattcatatatcatgagattgttaaaaaaaaaggatgagggagccaggtgcaatggctcatgcctgtaatcccaacactttaggaggccgaggtgggcggatcatgagctcaggagatcaagaccatgctgactaacgtggtgaaaccctgtctctactaaaaatacaaaaaaattagccaagcctggtggcgggcacccgtagtctcagctactcgggagactgaggcaggagaatggcgtgaacctgggagacggagcttgcagtgagccgagatcgcaccactgaactccagcctgggcaacagagtgagactctgtctcaaaaaaa

SEQ ID NO: 242750 - DNA, 417 bp, Homo sapiens
tgtgttgtgtttattcagcagcacgctaaatcacacccgggcacaagtggagcattcatcaggaaccacgagcccctctttcagtctgccaaacctatccaattactggggctggaagagcctgcacaaacccttctgccaggccttgcaaaattctaaagaacaaagtccaaccatccaagcaatattttaaagaatgagatctgtgttaacacttaaagacattttccacgttgacctcatgaaccccaaaagaaggatgaaagaagtctggaattaatgaatttagggaacctgtaaaactccaaaaatgtttaatgcaaaaatgtgatatttttggtaggaaatttccattgctttcaacagatttgggaagggacccaaaagatgactaaaagcatctgcattttaaccaaa

SEQ ID NO: 242751 - DNA, 437 bp, Homo sapiens
gattttcacaaactaccatttgttggcaataaccttcctttgcttcaaagctcagctaagccttcacttcttccaaaaagctgttcctaacccctcagtctgatttgtgctcctcctctgtgctcctatcgtctcctgcattcctctgctctagcatttacactatgtcatgattttatttccaccttgggccctccctggcctgtgagctccttgaaggcagggaccacttcttttcatctttctggttccagcactttttatagtgcctggcacacatcagatgctcaatccatttctatgtgtattttgtctacttccattctactgcagtgttcagaaaaagcccctaacctcaatttgcatgatgacctaatctcggaatctggaacaatgtgagtttctgagactccggtggtgctggggctgttgggtca

SEQ ID NO: 242752 - DNA, 300 bp, Homo sapiens
gagggaagtctagggcgcacacacccagctccctggcagagggcaggaggggccccactgctgcggcctggcctggctctgatatgatgtgtcctgccacctggcagtatccagcaccccgcccccaggagtagagcttcctgagtacccccagccaagctccaccctttggaggagaaatggacttatcagtcccaagtgatgaacagaccggggacgctttgggacagggcggggctgggggaatctcctctataagaggtcaatactgtcagtaaattggatggctgatgtgagcct

SEQ ID NO: 242753 - DNA, 606 bp, Homo sapiens
ttcttagaaaagtgattaggtgccgggctgtccttgtgtgacttaagttggtaagctttgattcgtttctgttatcaggcaaatcgtgcatgaaatccctcctttcatagccttccctggctccacgttgtcagggtttgacacaagtgactccattttgaatctgacaacttttgcgtgagcaggactaaccattagaattcaccagaggtcagtcagcttcagtcctcacacaaggaaggcaattacacaaggctttaataccaggaggttggtcatttgaggtcatcttaaagaggctgcctaacacatgggtaaatattttaaaaacctaactatatctggctttcaagaggcatactttgagtgttaagagaaaaattgaaagtaaaaggatgataaaaaacacaccaaccaagaaaaggctgatatagctatgcaaatatcagttgagataaatgtaagtcaagaagcattactaaggacacaaaggaacatttcatagagataaaaagataaatctaccagaaagatagagtttgtattttaatgcaactaataatatagcttcaaaatatagaaaacaaaattacagacctagaagta

SEQ ID NO: 242754 - DNA, 533 bp, Homo sapiens
agtcctagtgactcaggaggctgagtcagggggactgcttgagcccaggagttggagacttcagtgagctatgattgtgccactgcactccagcctgggcaacagaacaagaccctgactcctgcagaggagggctccatgtccaaccaatgggatgtacaaaaacgacagtgtgacttccaaggtcagatcacaaaagtccttgaaggtttcaccttactggatcacttgctctgggggaagccagccgccatgtggtgaagacactcaagcagccctctggagaagcccatgtagcaaggaactgaggtctcctgccaactaccagcgctaacttgccaggcatgtgaatgactcaccgtggaaggggattctccagccttggtcaagtcttcagatgactactaacccaagccaatatcttgattacagccttgtgagacccccagagaaggaaccgccccagctaaccacccactccagaattcctgaccctcaggaactgtgtgagatcataaatgctgattgtttca

SEQ ID NO: 242755 - DNA, 378 bp, Homo sapiens
agcaatcctcacacctcagcctcccaaagtgctgggattacgggcatgagccactgtgcccagaccagggagttgtttctgacactcctgatgtcaaaaggagtgaaggtgtagggttaagactttactgcttttgttgaaagccgagagtaatgatgaacacctctaactggtatgtcaatatgaactgttaacaacacatatcagtatgtgctaatctaccaaaaggacttcctagtgaaaaatgctaactccatctgggtgccttggctcacatctgtaatcccagcactatgggaggttgaggtgggaggatcacatgcggccaggatttcaagaccagcctggtcaacatggcgaaaccccatctctattgaa

SEQ ID NO: 242756 - DNA, 649 bp, Homo sapiens
taaggcttaaagacatagtatgcctgagaagaggataagaaccagactgtccacagtctgttctcctatgaccttaaaggacatggcaaggaccactgaggttttgtggttccatgagttgaggagaagcagaggagcatgatccaccccaaggagctgctgggtagtaaagagcacaacccagagatgaagctgggaggtacactactggtagacctgagggaagcctttcttttcctcacagtgacagaggggtgctgggtaaagctgagcgttgcccaaggtcacccaccacacttgacctgtctggaggccacatgaagccttgatgcgctggcatctgacctgaacatgctgaactggagtgaggcccgtgttgcctccctacccctgacccaagggccatcgcgtaagaagctggatcaattccctctccctccgccagagactgctccccaacattagtccgttctggcttctactgtgtggcggaaggaaaagaggttgaatcagaaatgagattgaagttttaaactggactatacttcaaaaactgaaagtaatcagaatattatagaatgtgtccaaaatgtttcaatgatgagactctggagttcccctatgcatagttgaaagcagtgattagaaa

SEQ ID NO: 242757 - DNA, 458 bp, Homo sapiens
aggcatataagaggggcttggtaaatttttgattattggttgactcttttttaaaaaaatgtttaacttgtgtaaaaactatttcaaggagggtactcaaatgccacacttttgtgacttttgctgtccttaccaaaatgaaatatgggtggtggcttccctctaaaggctgataacaatgcctttaatctaatcttgcaaggtgtgtaaatcacaaaccccacttgctgactctctgcccccgtctgtcatgctttaccacaatggtgaacaacagctttgaatcatgctaaatgtcaaccttcctgcccattagttgattgctttccattctgtaaatacaggagttatgcagaattgattgtatcaaagtgatatatttcaggttgcagtataatatcttatgtaccttgaatgccttgaaatttctataaacacaggttttgtaattgtgtgtg

SEQ ID NO: 242758 - DNA, 409 bp, Homo sapiens
aactattgttcgccactaaaggaaagcgtgaggcgagcactcactacacctttggagaaagaacactttctttaaatgttctaaagcctcttgctttgagctgcttgttgcccttgtttgcaggaacccatgctggctgcaggcagaagtcgcagagtttcaagcatgtctcatctgtctacagtctcgttctcagaaacttctgtttgggcttcaagacagcgaagggcaggaaagacagacaccagaagtgtcccagctaagatatgcaagttctcagcagtgtcaggggagcaagagtggggcattttagagatcagatgagatgactgcggcacagttaccaacataaacgccaacgtctgtatgtacacagccctttgagattaaaacactgctacacatataa

SEQ ID NO: 242759 - DNA, 515 bp, Homo sapiens
gtgttagcttttgagcatgggaccttttgttgtatttggatttttgaatatgcagtgaggcacatgagagctttgactgagaccacttaagagtttaagtgggaaaggttaaaaccataatggcatagaagggaggtgcaaggacaataaaaatgtatttttttttgtacttttatctttcattattaagtgtagctttgtcctattccctttttccatgggcctggtaaaatttcctggccagagacaggttgaggtatatgatagaggtatgactcactttgtctttgaaacatattttaaaataacactaagtctttgttttaaaataaagaagaaaaacaagacctagagtcaattctgttactcataccctgttagcttgccgtaacattaaagaaagaaaagatgttggtacatgaaaaaggaataataaaaagtcaaaattagtcttcttcatgaagatcctttcttatttcattttccaaattccaggtaagtttcttaccagaaaa

SEQ ID NO: 242760 - DNA, 407 bp, Homo sapiens
aaacctgtgcagcttgttactgcactaaataccagagcagttgtaacacactggtaagtacttatgtacttaaacatatctaaacagagaagaggcacagtaaagatatggcataaaagataaaaaccaggccaggcgcatgagcctataatcccagcactttgggaggccgaggcaggtgaatcacctgaggtcaggagttcgagaccagcctgaccaatatggtgaaaccccgtctctactaaaaatacaaaaattagctgggtgtgggggcgggtgcctgtaatctcagctccttgggaggctgaggcaggagaatcgcttgaacccgtgaggggcagaggtttcagcgagccgagatggcaccactgcattccagcctgggtgacagagcaagactccatctc

SEQ ID NO: 242761 - DNA, 421 bp, Homo sapiens
acagagtcttgctctgtcgcccaggctggagtgcagtggcgcgctctcagctcactgcaagctctgcctcccaggttcatgccattctcctgcctcagcctcctagtagctgggattacaggtgcccgccaccacacccggctaattttttgtatttttagtagagacagggttttgctgtatcaggtcttgatctcctgacctcgtgatccgcccaccccggcctcccaaagtgctgggattacaggtgcgagccaccgcacctggccaaatagtccataattttatcacgtgtagatttctgtatccaccactataatcaagatgtagaaccattccatcaccacaaagatctcctagtatccacattttgccagttggatgaagtatagaaaccttacctcccttcaagtctctttgc

SEQ ID NO: 242762 - DNA, 1225 bp, Homo sapiens
cgcgcgcctctgccgtttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccggtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggaaaaaaaaaaaa

SEQ ID NO: 242763 - DNA, 1119 bp, Homo sapiens
cgcgcgcctctgccgtttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccggtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggaaaaaaaaaaaa

SEQ ID NO: 242764 - DNA, 295 bp, Homo sapiens
cccaacctttgtttgtctttggtctccaggtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtg

SEQ ID NO: 242765 - DNA, 1468 bp, Homo sapiens
cgcgcgcctctgccgtttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccggtaccgggcccaaggaccagccgcctgcgctcagacgttcagctgtgccccactcagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgaggttcttaaattttgatgaagtccaatgtgtcagcttttccttttataaaacggaaatgtaatgaaatactgctcagtaataaaaaggaatgaactgttgataaaaagcaacaacacggatgtcactcaaaatagttatatgaaggagaccgccaaagaagtggacatacaacatgatttcatataaatctctatgaatagtgcctttggtggtgtatctaagagacctttgcctaatccagtgtcacaaagattttctcctgttttcttctagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggaaaaaaaaaaaa

SEQ ID NO: 242766 - DNA, 1302 bp, Homo sapiens
cgcgcgcctctgccgtttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccggtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtgtgaccccatttgctctgatgatggcttcttccagagctttcttggggtttgtcatttcattagtgatcagaatggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggaaaaaaaaaaaa

SEQ ID NO: 242767 - DNA, 504 bp, Homo sapiens
gtggactgtgtttagggcctgtttagtatcagcttgtgaaacgcagttttcactgtgtgtgtttcaatgactttaaaattatttttgcattgtatgtaaattaccaaacataaacgatttagaagaaataaaaagcttatttttcttaagaaacagtggctactgtcacttctcggccttttggctaagatcaagtgtgtaaaaagtggctactttaataataatggtgtcttacatttatatagcactttattgcttataaaatcctttcacatgcattaggtcatttatacctcacaacagctctgagaggtagctattatagttcccatttaatagatgaagaaactgaggctcacagagttccagtaatttgtccaaggtcacaaagctgttaaatagtagagccaggactgatactcaactattctgactctaaagccagtgaaatttttcctctgccttttttttataatagtaaaaagagaaaaattaatatgcttt

SEQ ID NO: 242768 - DNA, 331 bp, Homo sapiens
ccaggagagagaaaaagagaaaggaagaaagagagataacacaaagggaacaaatataaatcactgacttttttctttggagtctcctttaccaagagcaaaaagaatcttgatagtgagatttctgtctatgcttgtggccctcagagaagcatttcaatagattattcatctgtaaaactggaatggggagagaagatcctctgtcaaccttaagatgcaagctgtgctatataatagttgaaaggacacagaaaaatatttaggacaattaaagcaagctaccattctagacatagggattataaataaattgattttgatattgatg

SEQ ID NO: 242769 - DNA, 528 bp, Homo sapiens
ctggaaagtgtcagcgggtcccagaagcgcgatccctgcctgggcttcctgggagtgtgtgtgggttgctggggtaggtctagccacacctcactgacccgcctcccatgcttacacgtggacatgagagaggccccgtctgcgtgtctgtgtgcctgtctatccccactcacagtcaagagctttagcgccgacacctgctttggaatcctgactccactacttactagctggttgaccttgggcaggaaattttccctttcacccatttctaaatctgagtgtttactaacttccagccactgggcttctccaatagaaggttattagtatttccactttgcagatgaggaaaactgaggtagggagaaagagcgagcaagcaagagacagacacacacacacacacagagcgagtgagcgagcgccaagtggtttgcctaagatcacacagctggtaaggtgcccgagggccctttatcttacaagggtgctgcgagagtcaagtgagtagcagaggtaaagctc

SEQ ID NO: 242770 - DNA, 399 bp, Homo sapiens
aatactttcttaattcgtctcttaattttctaattcctgcttaactttctggttttataccacatggtttgcagttcccagaactgttcatattccttcacattttgataatttgctcttttctatctacacctttggcatccacttaccaacgcttttacctaaccccagtttagttgtcactttgaagaacactagtaaggtcctacatccagactgggtaaggttttctatcctatgtgctccttgatatgatgtgagcacccatgtacagcttatattgatctatatacctatctgtgcatcttatctgttttaaacattgtgagaccttgtgctttttatccttcaagtcttgttaaaatgcctggtgctcattcaatattgaaaaacaaaata

SEQ ID NO: 242771 - DNA, 451 bp, Homo sapiens
atcaagatacagaatatggatttagaatgcgaagtctctaagtcaagggaaaggtctaggtcgaacagtggtgcccttcaacaagtaataccctacatctcagccaaagaatctatcagtgaatccatggatggatgcatgagggatcagacagcccctgtcccactatgtctggctctatggaaatgtgggactggtgacaccctccttctcacagtattataagtaaatgcagcagagagtccactcttgaagcttgtgactgggaggaagaaagcatggagaggaagtatgcattcagatccacagaggaaaatggtaacctttgaagtcttcccacaaatccctaaactaggcctaaggccagaagagttctatatcagaacgttttgggaatcgtcttcaaaaccggaatccatttggccaataaagagtctatttgaattacaaa

SEQ ID NO: 242772 - DNA, 457 bp, Homo sapiens
cagtccctgagtccccgagaccatcttgaatgctgagcaggaaccagccaggctcagccctggcccctcgcccctttctctgactttctcactttacatgcccttgttgttagaagacttagatagaaacatccagcccagctgggcctagtctcaaaagatggggagggtgtgaggtaaggaaaggcttttgacctgtcccaacggctttcctgtgaggggaagaattctgcgagttggtgaccccctttgggccctcctccacttggatgtgatgttggtcactgaaaccgtttcctcctcatgtttgtctggctctcatttcaaagccgtagaggagcaaaataaacaaccatgtgttaggggtacctctaaagtgcaggcacgtgggtgggccagggtgcagctaaactgctgagtggatcatttcaataaaaccttatcctcagccattctc

SEQ ID NO: 242773 - DNA, 470 bp, Homo sapiens
aaagccaagtttttaacttggtgtttgttttttgttgttgttattgttgctatattttggtattggcaggggcagcaatgaaggagtgagatatggaagttggattttccatagcattacttttaaattgaatctcaactgacctctctggcaagctattcatactttgccttagactggatttaaaaaaaaaaaaaaaaaaagtctccataggcaatgattggttaagacggagaaaagagataacggtgcacccatgggaggaggctgagaaaagcaaagacagtgacaggcagataaacagaaaaagaggaagtgattaaaaataaaaataaaaataaatctcaggtacttgaaaagccctggctgagacagtgatggagataaaaagagaaagaggagaaatacaatcagcactactggtaactggagaggctggaggaatgggggatggaggctcagagactgaa

SEQ ID NO: 242774 - DNA, 565 bp, Homo sapiens
ccgctgcttgcactggctcagtgggcttctgatcctgactcggctaagtatttgctggtgaactcagatgagcccattggtgtgtctgtacctcagtttcccctctgtaaaatgtgtctggcagcagtctctgtgtgagcttaaccggaggctcatggaggccgtgggatgctgagcacagtgcctgtgctgagtaccactcagcaaactgaggctgacgctgtggttgttacctggagggtctgggcttataaccccccactgcccgccacaacacacacacacaggcgcacacacatccatgcactcgcgcacacatgcacgtgcacgtgcacacacatcacaggttacctccttcaacattgtgtacatgcacacacacatccatgcactcacacacacgcacatacacgtgcacgtgcacatacacacatcacaggttacgtccttcaacattgtgtacaggcacatacacacatccatgcactcacacacacatgcacatgcacgcgcacacacatcacaggttatctccttcaacattgtgtacaggcacacacacaca

SEQ ID NO: 242775 - DNA, 478 bp, Homo sapiens
tcgctctgtcacccaggctggagtgcagtggcatgatctcagctcactgcaacctccacctcccaggttcacaccattctcctgcctcagcctcccaagtagctgggactacaggcgcccgccaccacgcctggctaattttttgtatttttagtatagacagggtttcactgtgttagtcaggatggtctcgatctcctgacctcgtgatctgcccacctcggcctcccgaagtgctggaattacaggagtgagccactgcgcccagcacatctcgctatctttcagaaaatcattgttatcaggtttggtgcagtggctcatgcttcttgttgcagctgctcaagaggccaaggtgagaggatcgcttggggccaggaatttgagaccagcctaagccacatagcaaaacccagtctcttaaacatatatatatgaaaaaatatacattacatcaggaatttcagtttccttcttt

SEQ ID NO: 242776 - DNA, 481 bp, Homo sapiens
tagcctgtggccccatggtcagcctgtgtccagatcctgggtactctacttcataactggccatatgaacttaggcaagtcaatttaacttctctgggccttggttgcctcatctgtagaatgaggataataataataaaatctatctctaagatagatgggaggtaaaacctatctctaagatagatgggtaccatgggtaccatgctcactacctgaatgaaaggattaatggtacccccaaacctcagtatcacacaatataccattataacaaacctgcacctatacccccaaatctaaaataaaaactgaaaagaagttttaaaaaaagtaaaaacagaaaaaaatggagctatgtgtattactggaaggttctggtaatttacctattgtggctcagctacacatctctttgctctttcaaccctgcaatacttctgtaaccacccccctgtattaaattccttctggctgaaaa

SEQ ID NO: 242777 - DNA, 416 bp, Homo sapiens
agaaaattaaaaacacctcctacacacggatgcagcaaagcccagtgtagatttttttttttgtatttttattcttttgtactcaaaagcctcaaaagacctttataatccacacatttttctaaagtacaaggtaatcaatcagtgggattgttctttaatgtgtgggaatattctcctccttattctcctcctagaccaaacgctgactactaggctaaacgctgactactaggctggaatattcactgagaacatcaacatgccaaagagaagccaatcatcgaactaacctggtggtagcaggctactgggagttaatgaaaatggaagtgggaggcaacacaagcagtgcccttgggtgggaagggatggagcagtataaagacagtggaaaggcctcgttgagtgaaaaa

SEQ ID NO: 242778 - DNA, 329 bp, Homo sapiens
atgtaaatgatgcatctttagtttcatcttcctcaatttcataactgatttttgtgtagctttcatatctgaaaatgagtacaaatatggagaaaataaaaggatctttcctaaacaatattctaacatttttaaaaaggttgcactggtaatgcaaacagataaagtaatgaaacttctcagatagcaattatgtggcacaggctctgagagctaatctctcaaagagtcaagcctagtaagataccagagataatatctacatggacagaagattgatagcttctttgacaagagcaaatatattgctttgggcttaaagctcagca

SEQ ID NO: 242779 - DNA, 609 bp, Homo sapiens
tgctggttttgtccctaaacacagactagtgctaagcatgtactaagaacttagcacttggttgtggaaatgaattaaacttcagttcaccaaagttctgagcattccatgaagtattcagcctcatccaatcaattcttggatacacaacccatgaaaccattcagtgtttttaaagaaacattaacaaataatattaaagaataagtcccctgagaaagtgtatgcatataaaataattctaactttattcttgtaccatcattgaatacttaatcagcaagccaattttcttttgacaccaagactggaaaatcatcaccaatatacagtctggcacaggagacagggactagaatttcacaagagagaggagggctagctctattctcactagaaacaagacctaaagcaagtcacttaccctctgtcagcccttatctctaaaataaaaatagttgtacttttcccagtgaccccatagtgctattgtgaggatgatttttttaaaatttgtacaattgctttcttgaatataaagcacctaattggtataatggctttatgggacaccctgacctttttaaaagagggcctattatactattg

SEQ ID NO: 242780 - DNA, 467 bp, Homo sapiens
ggtgtctttaatttttctcagcagcattttgtgattttcagtgtagtggttttgtgtcttttgtaaatgaattgttacgtagtttatgttttttatgtcattataaatggtatttttaaacgtgtgattttccagttgtttactattagtgaatggagatgcagatgcatggttgtgtactaatctcgtgtcctatggcccctctgaaccgtagcttctgtggagccgtgggtgacagttgtaaacagttggcatttgcagatagagccatgtgagcacctttttctccaggcttgaggccgttcctttcttttcctgcctcgttgggctggtcaggacctttggcatcgggtgagtcggcgtggggagctgggcctttctgccatgctcttcctttcggggaaagtattgagtggttcaccagtaaggatgtgagtatctggagtgtttttgtcattgttccttta

SEQ ID NO: 242781 - DNA, 419 bp, Homo sapiens
tgtctcctgcctgcccctgggaactgaacgtcttggtataaaacccgattgtacatttgttcaattctgagataggagaaaaaccgccctatggtgggaggtgagacatgttggcagcaatgctgccttgttattctttactccgctgagatgtttgggtggagagaaacataaatctggcctacgtgcccatccaggcatagtactttcccttgaacttaattatgatatagattcttttgctcacatgttttttgctgaccttctccttattatcaccctgctctcctactacattcctttctgctgaaatcatgaaaataataatcaataaaaactgagggaactcagagaccggtgccggtgcaggtccttggtgtaccgagtgccgctctcatgggcccaatgatgtttataaa

SEQ ID NO: 242782 - DNA, 382 bp, Homo sapiens
attgagatggagtctcgctctgttgcccaagctggagtgcagtgatgcaatcttggctcactgcaacctctgctggccaggttcaagcaattctcctgcctcagcgtccagagtagctggtattacaggtgcccatcaccacgcccagctaatttttgtatttttagtagagacagaggttcgccatgttggccaggctggtctcgaactcctgacctcaggtgatccacctgccttggcctcccaaagtgctgggatgacaggttggagcctctgcgcccagcccaattcttgagtattaaatgcttaactgccttgttatacctcctgtactaagaacactaaaaatgtagagcattttagacaagaaacctaattaaaa

SEQ ID NO: 242783 - DNA, 317 bp, Homo sapiens
ggagaaacacctaatgtaaatgacaagttgatgggtgcagcaaaccaacacagcacacatatacctatgtaacaaacctgcatgttgtacacatgtaccctagaacttaaaaaataaaaaaaaacaacttggtatagccacatacactacctttgaaagatctccaaaaagtgaatgaacattacaggattaaaaaaaaaacctacatgacattattttccaaaggtacatacaattatgtgattataaatccattaattgtaaaccagttacagtgattacctctgtatcaccactctggtaagcggaggaaggca

SEQ ID NO: 242784 - DNA, 448 bp, Homo sapiens
ctatggtgtcagcgctgatggggtctcaggtctgtcactgtacccggccccacagccagagctaagtttgggagctggccacggagtgtctgcggctcatgatggtaggctgaaaaatggcccctaaagatatccaggtcctcatccctggaacgtgtgggtgtcccctttacagccaaaaaatgggctcctgcagatgtgcaaagttaaaggtcttgagataaggagatgatcctgggctatctaggggttccttaaatgctgtccctagtgtccacaacagagagaggctgagggagactcgacaacacaagcacggaggaggagactgcgcggccaccgaggcagagaccagagtgatgcaaacacagccagggatcaccagggcagctggctgaggctgcaaggggccctgcacaggttctcccctggcgcctccgagggggca

SEQ ID NO: 242785 - DNA, 147 bp, Homo sapiens
cagggagagagggaagaaagagcatgacattgttctttttaatgcgattttctttttggctaatagaaaagaaaaaacagtttcttttttttttcttttaaaaataaggggtctcagacactgaaaacccagctctcctaaaacagt

SEQ ID NO: 242786 - DNA, 345 bp, Homo sapiens
cgttgaagctattttatagaacctagctcttatagctggacaaaccatgtttcccatcttcccttcctctacttcccctggatttcttttttttaatttatttttttaattttttggagaaaagagtcttagtgtcgcccaggctggagtgcaatggtgcgatctctgctcactgcaacctccacttcctgggttcaagtgatcctcctgcctcagcctcccgagtagctgagatcacaggcatgcgccaccatgcatggctaatttttatatttttagtagagacggggtttcaccatgttggccaggccggtctcaaactcctgacctcaggtgacccaccca

SEQ ID NO: 242787 - DNA, 495 bp, Homo sapiens
aatatttgaatgtttgatttttttatagtatcaacagttgtactgtgtaccagatcacatagtacagttttacatttaatctatattggcctgaaaagaacacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaaa

SEQ ID NO: 242788 - DNA, 435 bp, Homo sapiens
cgaatagctgggcctacaggtataagtcccaccatctttatggcagaagttctgccttcttattaagagtgagaagaatgttttatggttgatattagaagttttaagacagtgactgtcacatgtagggataggctcagagggagctagagagaaacccaagtagggacctataaagaggtaccgattgctggagggcccagctgaggttgaaaatcccaaagcccaattttatgctgactgctaaagccttgttcctcgaaagaaaaaattataatgattataaaacataattatataagtattatataaagcacaacttagaaaagatttaagaggtattctaggaagattgatttagaatgtttggattattttgaaatggatcttaatacttattgcattcctacttatctttcagagatttccttcaga

SEQ ID NO: 242789 - DNA, 535 bp, Homo sapiens
gtgtgtgtgtttgtgtgtgtgtgtgtgtgtgtgtgtatagtgcatgtatagcatttacactatcgtgtatatacaaatatatagcatatgtatagaatatactgtattattgtacatatacatatgtacaagtatatatgtaagctcagtgtcttatgatttcattctgacctattgccaacttcattacacacaactcctttcataaatgtatccttcatgaacatttcatgatctgcacagaccttcagtgacatgcttaaactttctgctttgttttatacttccccttaaacaactggtcatcctgctttaggataaaaagttactatgcaagactcatacagaattattctgttaattttgtaaccatccttaccaaaggtacattctcacacccattaacttccttcatatttctctcctcctcctacttagtggttcctttctgtcttgtttccatatttgaaacaacctctaataaactctgaatttaaacaacttttttcccaataaaaagcaatttttatgcctt

SEQ ID NO: 242790 - DNA, 489 bp, Homo sapiens
taactctgcgtgggtggtgagcctttcagggaaaatattccctctcttccagtgtccctcatctggttgacaccaccctgtctctccctctcactcaacatcactttgtttcgggctgtatcttagtgcaatctcccatggaatggccccaaagactaatctgctacaaggcatgaaccaagcacaagtatagctctgttccatgactttcttttatagcctccctccagccctgttgaacacacaagtagatgaagtttagaagaattctttcactatttaaatcagctcttctgtctcactacggcatgatagagggtaaaatgaagagaaatgaaagactaactacattttacttagaccactacatcatctgctcagtctatagctttcctattttgttccacactcctggaattctcacaatgggattcaaagctcacctagaagccactcttagacaacaaaggacacagtcccctttggagt

SEQ ID NO: 242791 - DNA, 468 bp, Homo sapiens
tgcagtgagccaagatcatgccactgcactccagctgcaacaggatgagaccctgtctcaaaaaataaaaacaaaaagcaagagatcaaaagcactgtaacaaatgaagaatgcctttcaagggctcactaggaggctaaatgtatccaaggaaagaatgtccaagcttgagtatatgtaaatagaaacctacaaaaccgaaaagcaaagagagaagactgaaaaacaatatccaagaactgagggacaactacaaaacgtttaaatgcaattaatgggaacagcagaaggtgaagagagaaaggaacagaagaaatacttgagacaataatgactgataattttcctcaaattaatgtcagacaccaaaccaaacaaaaacagatccagaaagctaagagaacatcaagcaggataaatgccaaaataaattaattgaaaatacacctagacatatattaaaactac

SEQ ID NO: 242792 - DNA, 810 bp, Homo sapiens
acaagaggactgtggggtggagacacattcaaaatgtctttccaaaaggagatactccaacactcatacaaactccttcaggcattccaacagcattcccatttataatggaagccaactttttaaaaaaagaaaacaaaacaaaacaaaaaaactgcagatcacaaatatcaagacattttcctgaagaaaagaaaatgtaaaatttcagcaaagtcagtttcgttagattacagacagaagatagaaaaaaaaaaaaagaaaacattgcattttttgtttgtctgtttcctggtagaatctgagcgaggcaaaataacagcactaatgtgtagaaagaattccacatctggaaaacctttgcttcgtctatggtagcttttcagcctcttgctctgtctctattatttcccatgacttcagcttaccttgcttttgttttctttagtgaaattatttaacccttaggggtttcaggcttggtctggtttggttggtttggtttctagggaaagagaatactacataatatttttgtgattttctagaatttaccttatttatatttattactgtctatgtcacttacatttactttatttatatttattactgtccatgtcactatagtatgtacttactatactatataagtgacatggacataatgcatataaatatctgatcacttctatgaatttatattttagaaatactttaagtggacagggtttgattttcattttaatagctctgatattggtctttctcttcccattcaagagttttattttgttcatctcaaataat

SEQ ID NO: 242793 - DNA, 425 bp, Homo sapiens
cgataaaaatagcaataaaatctttgcaaaaggcatgcatgcatgtgtatttatatgcatatgtgtgtgcacatacatacgcacatctgtttcctagttctgttggtagtagagggggagggtgcctgggaacagcagtattccaatagcagtgagtgtatcaggtttctagatcttggcttctatatcccattttccactaaaaggaaccccagctgcttggagaaatggctgattataggattggagcaggaatgtttaacatgagcctggaacatcttgggttagaaagcaaagaagtcttcaaagagtgatgaaaacatgccaaaaggacccagagtcagtttgaagcggttcccactggccaaatctgagtttatttcaaaatttaagaagtgatagtcatggattagaacctgctgagt

SEQ ID NO: 242794 - DNA, 919 bp, Homo sapiens
ctattgtttgtttgttttttattacctgaaatttttctcttacatttattatttcatcttctttctttgagaataacttcctgaaatatatccttggtttatccatttttaacaagtgttcttttaaaatgtatgcatttaatgctatagatttttcactaaatactgtcctagctatacccacaacattttatatgtaatatttttactatttaagtagtctcttcgttatccagagattggctttctgtggtttccattatccataattaatcgcaacctaaaaatattaaatgaaaaattccagaggtaaactattcataagttttaaactgcgtgccattctgagtgatgcgatgaaatctcacaatgtcctgattcttcccactgggaatgtgaattgtccctttgtccagggtatccacactgtatacactgcccatctgttagtcacttagaagctgtctgggttatccaatggactgtcatggttttgcagtgcttgtgttaggtaacccttactttacttcataatggccccaaagtacaaaagttgtgatgttggcatattgttataattgttctattttttttattattgttactaatctcctagtgtgactaatttatcaattaaactttatcataggtgtgtacatgtaggaaaaaccatcatgtacatagggtttgacactatgcatggtttcaggcatctactggggttcttgaaatgtaacccccatggataaggggggattaccgtcatcagttatttttcttatgaaatggtaggagttctttacattctggatacaagccatttactagttatttcataaatatttcctcttactttgggtcattctcataatgatattttgataaacaaattttaaattttagtatgattcaatttgtg

SEQ ID NO: 242795 - DNA, 519 bp, Homo sapiens
aattgatttcctcacatacattttttttcctacttttccaaagtaagtttttcttcccaaaaaggtttaaatgtcttaaaattaattttgcaccaacctaatattatagccaagcaaccacaacctattataaaaaagttctcgtccttggccacagaattctattattaaaataaacatttctgtgacgcaaaaggacttacttttagaaaacacatctatcttgcataaattccatatgtttcacattttaaaagatttatctaagtctaatgtcaagcttatttttaggtaggattgtgcggctgactttcctgttcaaaagtaaagttggagctgtttcaaagagtaactttattctgcttgcctgtggctgtttgtaccacagaaggcagatttgtcaggtgcggtggctcatgcctgtaatcctagcactttgggaggccaaggcaggaggatcgcttacagccaagagttttaagaccacccagggctacaaagcaaggcccccatctctac

SEQ ID NO: 242796 - DNA, 417 bp, Homo sapiens
tatactaaccttcttattcatcatttctgcttcaattcatttgtttgtgtggattcagagttaccatctagtgtaatttccttactctggcacagatttgttcctctgtcttttttttttttcccctgggagtctcactttgttgcccaggctggagtgcagtggcaccatctgggctcactgtaacctcctgcctcctgggttcaagcgattctcctgtctctactaaaaatacaaaaaaatagccaggcatggtggagtgtctgtaatcccagctactggggaggctgaggtgggagaatcgcttgagcctgggggtcggaggttgcagtgagccaagatcaagccattgcactccagcctgagtgacacagtgagatcctgtctcaaacaaacaaaacaaaacaaaaaagacga

SEQ ID NO: 242797 - DNA, 345 bp, Homo sapiens
attccaagtgctggtgaagatgtagggtaaccagaacttacactcatggctggggacagtggaaaatggtacagttactcgagaaaaccatttggtagttgattagattttacatatatgtgtgtgtgtttgtgtgtgtctactcctataaccagctcccaagggaacccaagagaaaggaaggcacaccacaacaagacaggtacaagaacgttcaaagcttctgcacagcaaaggaaacaatctacagagtgaaaagaataagacaaaatatttgtaaactactcatctgatggggggattaatacccagaatatacaaagaactgaaatatctcaacggcca

SEQ ID NO: 242798 - DNA, 379 bp, Homo sapiens
gagagcggaaaatcaagtactcgaagctgctgtccatggaggtgagtgacaccagtgactctgagcaggggacagaacaggactggcttgtgaaggccatgagggaggaacactcagactgaaagggctgagaaatccagagtgtgctgatccagcaaggaacgaatggactgaacaaaactcagcctgctgaggacagaaacctgccctggactgctgggagccggggaagagaggatgggtctgtgctgaaggcccaacaggatcatctcattgcatgattttctttacttttgaagtaaaaggagatttaactttttgccaatcttttttagataatggaggaagaatacatttgctttttaaaaagttccctcta

SEQ ID NO: 242799 - DNA, 367 bp, Homo sapiens
ggaaattctagagctgaaaagtataataaatgaaatgaaaatcatttaaatgtactcaacaattctgagatgaaaacagaacatttgaacagaaaatgcagtgaatttgaagatagatcaagagagaatagttaatcaaaagaacaggagccaaaaagattgaaaaataatattagatgtaatgaaaaaaagaacatgacagaaaaaatattgaagaaatgttggccaaaaatttctcatttgataaaagctactaactgagagatctgctaagctcaacaaatccaactgggtgaagcccaaagaaaaccaaagcaaggaacattatagtcaaaacggtaaaatcaaagattaagagaaaatcttg

SEQ ID NO: 242800 - DNA, 669 bp, Homo sapiens
tgtctgctgagtacctcctctgtgccaggagctgtacatgctgggattcagggtctctttgtaagggtggagctaaagaggttttgattgccatcttgcttctttggtttcctagtggagttagggtagggtgtcatgaagtgaccatatccttggagtaattgggtttctatctctttcacagcccttattcccatcacaacaacttgagctatagtcatgttgatttttaacaatttcagcttgggtaggaaaagagaaactagaaatagcaaaaagcaatgagcaaatgttgtattaggaaagtttaaaattaggaatactaatcttttggtggagagataaaaacacctcatttcctgaaagtcttaagattagagcagcagaattctggattgttatactactctaatcctagaatctaacacagagcttctgtagagttcagtaggtatttgtgaataataagtggcctctcatttctctccttactgggaattctgccacctgattggtgcaggccttggcaacctcctaggaaagcaatggagcactattggctgggggttctttgggattccttgtcttagataccttttccagcccaacactcccaacaggaaatgatggttcatgtctacagtgattcgacacgttatcaggatctct

SEQ ID NO: 242801 - DNA, 724 bp, Homo sapiens
tgtctgctgagtacctcctctgtgccaggagctgtacatgctgggattcagggtctctttgtaagggtggagctaaagaggttttgattgccatcttgcttctttggtttcctagtggagttagggtagggtgtcatgaagtgaccatatccttggagtaattgggtttctatctctttcacagcccttattcccatcacaacaacttgagctatagtcatgttgatttttaacaatttcagcttgggtaggaaaagagaaactagaaatagcaaaaagcaatgagcaaatgttgtattaggaaagtttaaaattaggaatactaatcttttggtggagagataaaaacacctcatttcctgaaagtcttaagattagagcagcagaattctaaaattaatagaatagaaagaaattgtttggttacagtaaactccatggcagtagggattgttatactactctaatcctagaatctaacacagagcttctgtagagttcagtaggtatttgtgaataataagtggcctctcatttctctccttactgggaattctgccacctgattggtgcaggccttggcaacctcctaggaaagcaatggagcactattggctgggggttctttgggattccttgtcttagataccttttccagcccaacactcccaacaggaaatgatggttcatgtctacagtgattcgacacgttatcaggatctct

SEQ ID NO: 242802 - DNA, 392 bp, Homo sapiens
actgtatgtctactgtggtaggctcttgtgattcatcggttaaccaaagatcccatcctcttagaacttatattctaacaggtgagcaatagatacaataaataaattgcagctgggcgccgtggttcacgcctataatctcagcactttgggaggccgagacgggtggatcacttgaggtcaggagtttgggaccagcctggccaacgtggtgaaaccctgtctctactaaaaatacaaaaattagccaggcatggtgttgcacgcttgtaatcccacctactcaggaggctgaggcactagaatcactacaacccaggaggcagaggttgtagtgagccgagattggaccactgcactccagcctgggcaaaagagcaagactcagactc

SEQ ID NO: 242803 - DNA, 1005 bp, Homo sapiens
atctggtaagattttcataacacagcaaggttatctctaatcctaggagatccagaaagaaaaatgaaatgacaaacccatcatgtattttaggctatggtttttaatttagtgaagttttctgatagcagaatttgttataactactggttcaagtatatgtcttgttcactaaaaacagccatactaaatttgtaactataactcagattgtttaaaagaaattcaattaagtttaaaatcaattttaaacctcttacctatcaggtagagaacaaaaaacactctaagaattgctagtagaactaaaaattaattagccagccatggtggtgggcacctataatcccagctacttggggagctgaggcaggagaatcgcttgaatctgggagacggaggttgcagtgagctgaaattgagcccctgcactccagtctgggccacagagtgtgtcaaaaaataaaaataaaaaactgaactaaaatttggcatgatgtttatggagggataatctggcaatttgtatcaatgtacatacctttaacctcaaaattcacttgtaggaatccatcctagagatatactccaggacataagctacatgaggacagggattgatttgttttgttcactgctgcattgccagtatatgcctgctacacagcaggtactcagtagccatgtgctgaatgaataagtgggagaatgattgtgagaggtcacatatgcgcagttattcagtacagcccttcttggattcttgtaaacagaaaaagaacagaaatacatagtgcttaggtgagtaaattatggcacatattacaattctatacaataataaaacaaagaacaaagatgttctgttaagatacataatgatttcagtaaactatcattaatgtttaaaaaaacatcatgaatgtatatatgtactttctaagaatttctctgggaaaatatgagattgataacactggctgcctcgagaggtgaattagaatg

SEQ ID NO: 242804 - DNA, 320 bp, Homo sapiens
gccgtgtaaatttatcagaagaaaaagaaatggaaatgaaactgaaggaactggtcaactcagataaatgtagtttttttctcactaaaaatcagtttctagaacatctaggaaatcaaagatgatgaaaaatattaagatgttttatatatatgtaaaagtctttacagctgattgatcatctcatgcaaaatttgtacagtcactgcaaataaagtcattgcaaaatctttactccttttgctttttgccaacactgacattggcctttacagtctcttgacttcattctgcccttgcatcccttctgttgtcttctc

SEQ ID NO: 242805 - DNA, 494 bp, Homo sapiens
ataatagtaaaacagtacaggatgccagaaggaagggaggagaggggataatactactatactgatgaagtagctagaagaaagaggagtgcttaaggaaactatccagcaggctattcagactgacctctcatttggaacagttctaatgagccttttcagctacaagtgatggtgactgacagttacactgattggagcctgtggcaataggcagtaagtgccatttagggttttgggcacagcatttgcctgacaccgctgcctggtatactccatttaagcagcaattgttggcttgttagtgagtgcttttggacacttagacactaacaaagaaagcatcagcaggtattgttatattctgacatgtccattcttggatggatcaaaaatgaaaacatcaacaaagaaggtaatgctcagcgagcatccattatttaatggaaatggtatatccaagaaagaagtaaactggacatattattattatt

SEQ ID NO: 242806 - DNA, 460 bp, Homo sapiens
gaccgagtctcaccttgttgtccaggttggtcttcaacttctggcctacaccaaccctcccaccttggcctcccaaagtgctggattacaggtgtaagccaccacgcccggctgaattgtacactttaaatgggtgaattgtgtgacatgtagataacatctcaataaagctattgccaaagaagccaaaaagttcttaccgcaaagccctgtgtgagtggctgttatacagcagagtctacgatggggtctgaaaccttctccctgcgttaggaggcctgcctctcccggcacttttcccatttcttggctactcagagatgcaccagccacttcacctgtggctcagctctataatcgacccctgcttccaatccccacgtcctccaagcagaaatacgcctgcccaggatcacaggtaccctagctgctaaggcctccgtggtaatgagcccttatg

SEQ ID NO: 242807 - DNA, 294 bp, Homo sapiens
cctctgtttttaaaaattaaattaaaaaaaaaaaaggcttcagtcagcctttaggcagacacatcatttttaagacctaggtaataattatatttaaaccaaggtgatatggaagattgccaaatcactcagctcagataacctggtgaatagtggtggctggcagtgcccatgatttttcaaggagtttgagcagcagactttcttagaccacagactgtggcccaggatgaattctccccagcccggaatacctgcaagtgctttgtagtaggggaaatgctgaaccgagta

SEQ ID NO: 242808 - DNA, 428 bp, Homo sapiens
ccaacttgctttctccttgtgatgcccagttccctctctctcagtagcgccgagccacagagcacggagggcgtgagaagagctggggccccacatgaggttgccatggcgcggggcacaggggagcctttaagcaggggagtgggatgggcgcggtgtgacgcctgtataatcccagcactttgggaggccgaggcgggtggatcacttgagctcaggagttcaagaccagcctggccaacgtgatgaaaccctgtctctactaaaaatacaaaaattaaccaggtggggtggcgcatgcctgtaatcccagctactcgggaggccgaagccggagaattgcttaaacccaggaggcggaggttgcagtgagccgagctgagattcattgcactccagcctgggtgacagagtgagactctgtctca

SEQ ID NO: 242809 - DNA, 640 bp, Homo sapiens
gtttgttagactttcccctattctgaatcaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggagaggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttggtgagaaagacatgaaaaacactgaagaaagtttgaatttgtggccagacctgcccctctcaggccttctaggcatgtgtctgagggaagtctcctgagtgttagaagtgttattggcaaagcaatccaataaaataagctacctatgatgcaaagcctt

SEQ ID NO: 242810 - DNA, 217 bp, Homo sapiens
tttacataaatcatgatgatgctgaaaggtaccaacccatttttgttttgctctgagccgttggaattgcatacaggaatttgttctggagtcaaaggtgtagtgttccctttgaagtcagtgagagctcctgcttagatcaggcctgtgaggaatggagcaaaaccacatacaggcaaattcccatcctttgcccattaaaaacaaaacaaaacaa

SEQ ID NO: 242811 - DNA, 488 bp, Homo sapiens
gatgatattcttcactcctcatggcccctgcatggattattttctttgtttctctaacctctacttctccaatagactgttccaaaaaggaaataaagagataagcaatatatttttcttagtaatttttttattaaccctattctaattctggttttcttctcttctataaactttgcatttgttgctgatattcatcatgctactatctgaagcctcaagaaacagtctggccaaaaagtctttagacaatggctcagggccttttgtcttataaaattcaacctgcagtgaaattccattgaaagatatattcttgttgtagtgcccaaccctcaaatgaatattcccgaaggatctatctttgtttgtttcatagtcttacactcatgacttcaagtgatatctcccagtctacgtctataccatgtgctcttcatctgacatacacacttgtttttctcttgattgattatctcagccctaat

SEQ ID NO: 242812 - DNA, 301 bp, Homo sapiens
ttcattagaggcaatctaaggccccggcgcaagcctgaagactctgcttctgctggctccccgccggggctcctgccgtccctcttggctctgccctgtgctccaggcccctgccctgccctctcctgcaatccctctctttcagaatgggaggcttaagcaatcaggaggggaagtatggggacaaggagactttcgggactgtggacatgagcaagaactatctgaaggctcgggcactgggacagggtcacagtgccaggctccctttctacaagcagcacctctagcagctggtggt

SEQ ID NO: 242813 - DNA, 459 bp, Homo sapiens
gagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaa

SEQ ID NO: 242814 - DNA, 367 bp, Homo sapiens
tctctgtgtgtctcatccagagagagacagagtctgccttgaatcagaggtcatgtggccgtccccgccgggccgaacaggttgcaggagcccttggctttccttcacagagagggcagacaggaatctgcacgcgctaagggaagtttgggagctgcgacgcgtctatctgagcaacgagttgagccttctgataattggcactccttataactcctacagtggcagaattgcctcctgtgagctccgcaattcctcagaacaaatcacctgaatgtctctgcaaatagcagaccatgaggagtgtgaggaggagtggagggggacacaagtgggaactaataaaactcttgttaaagggcctgct

SEQ ID NO: 242815 - DNA, 431 bp, Homo sapiens
ccggagccctaatcacttttccacatgcgcctccggcccggcgcgcgacggggaacgagctgggagcgcccgcgcagccaggaggggggctgggccgcgggaacgctgtccccctcccaggctggaaggcggggataattccccctgccgtgcagcccttctagacggcgtctacccctttaagaaaaatctaggcggaggtggggtgcgacagaaggggtggtgaggcgagggtttccctccctccgtctgctatacccgtctccctcgctccgtctcactctccgtctttcctctccttcttttcctctgtttttcttttctttcaacacaaaagttgggttgtgaattttccgaggtcgccgccgcctcgcccccaccccccgcctctgatctgcctaactataattaaagtgcgttttttgtggcat

SEQ ID NO: 242816 - DNA, 456 bp, Homo sapiens
cacaatgtgtgttaaataaacaaaagctttcttcaaacagaattcccctaagcatttccaggttgttccctgtccagacatagatacaccctgtgcagtcatagatactgttgaaagattcggaaataggaatcaggagccctggagtaacaggcccccagaaaatcagagtggaattgttagtccagaagcttgacaaacatccaccttcattgtcttccaactgtatctctgacttccctctccctagttcattacatcccagtcatattgatatcgttgctgttcttgaacacattaaggagaggcgaatagggtttttagctgctgaaagttagactcgtggctagagaccagactaagtccttttccttcatgtggaggttatgattaggattgtcagagagagttagggtttaattttttcattaaactaataatatgttttgagtatct

SEQ ID NO: 242817 - DNA, 403 bp, Homo sapiens
tcttctcaaatatatgtaataagactatgaatagaagggctgaagacggaaagggtaggatggacacaccacaggctgttgaacaactggcttggagaagcttctgagcctgagtggagaaggacaagaactagaggtgagctattcactctccacaccatgtgacagctaggttcatttgaaacagcaattaagcaatacagaggaccaaacaacattgactaagttggaaaataaagacatatgaaagaaagtctttcagaaaacaagtgcaaggtgttagaagtcatctagattgaagacagagaaaaagtgacaagaaatatttcaactgattcttaggaaggctgctctgcagaagcaaaacaaaataaacaaaaccaaaaaagtaaggaatgccaaa

SEQ ID NO: 242818 - DNA, 541 bp, Homo sapiens
ctaccaacaccttgattttggacatctaggctccagactgtgagacaataaatttctgttaagtcccccagttgatggtactttactacagcggatgtagcaaactcatacaaggactttcatctcctttgctcccagaggctgacgctctgctctgttcggagaatctgccatggtgcaaaccttgctgggaagcagagccaccccgcacctcactataaaagctgaaagccaagatttccctctcccccacccctggcagatgatgctctgttccagggcactggggctagagcactgggcagtttagaatggattctttcgttgcctgcagtggtggctcctaacctccagttgtaatgatgccaggatgccacccagcatttgccagaaacctgaccttggccgtacatctggccatttggtttcacttggttccttccccttttccaagcccaatcctgcagacttcccatggattctgtaagcacctcagcaaacgaggacatcagtgcagatcaataaaaagccgagcatccca

SEQ ID NO: 242819 - DNA, 614 bp, Homo sapiens
tcttttcggatacataaatgtctcaagactacccctcaggaagcaaccggaggttgtacttcactaaaataaaggagaaatagaaaagaagataacatgggacccagcacaacaggcagggagagcccctgagcataagggtgaatggggagctcaggaggacagctgggcagcagacctccagggtgccccatccagatggaatcagggagatggagggctcctgaggtatgtctccatgaaaatgatcatatggagaaatgacgtgatctgtctaaatgtactgcaaagagatttctatttttggcagaaaatttggatgaattaattatataatagatgcacaaaaaactaaagaaagagaagaagaaaaaaaaaaaaaaaaaaaaaaaaaaaaaaaaaaaaaaaaaaaaaaaaaaaaaaaaaaaaaaaatgaaaaaaaaaaaaagaaaaaaaaacttcagggggggccccggtccccatttcgccctatagggagccgaattccaattaattggccgtcgtttaccaacgtcgtaacgggaaaacccttggggtaccccaatttaatccctttgagtcaaatccccttttccccagttgccgtaatacca

SEQ ID NO: 242820 - DNA, 555 bp, Homo sapiens
aattcggcactaggcataaagcaaacagaatcatcacttctactgcagcctaaaggtgttgataattatccagaaaagcaaatctcctttctataaggttcagcggtttgagagttgtgatggggaaggcactccttcggaaatcatcctcactatctagagatatttcagggctggggtactctcctgtgaacaataggaaaatacatacttaattgaaagtaataaaccagggttctgacttttttttttttttttctttgagacggaatttcactctcttgcccaggctggagtgcagcagcgctatctccgctcactgcagcctctacctcccgggttcaagcaattctcctgcctcagctctccagaatagctgggattacaggcacccaccaccacgcccggctaatttttttgtgtttttaatagagacggggtttcaccatgttgaccaggctggtcttgaactcctgacctcaggtgatccgcagcctcagcctcccaaagtgctgggattacaggcatgagccaccgcgaccagccctgactctt

SEQ ID NO: 242821 - DNA, 323 bp, Homo sapiens
gcttgccggcccacccctaacatgtttgtggggacccagtcagaacaggcttatcaatacagggccatataccatctgtttaaaccagtggttctcagctgcagacaattttgcccacacaccgcccccacccgccgccggggacattcagaaataaccggagacatttttttggctgtcaccactggggagggtgctactggcatctggtggttggaggccagggctgctacactcctcacctcccaagcaaagaattatctgaccaaaaatgtcaataggctgagaaaacctgtatctaaactattaaaagctgtaaatcc

SEQ ID NO: 242822 - DNA, 455 bp, Homo sapiens
caaatgtaggctataatgacatatgagacattgtttagaccaactcagtaatcataggtataatcttggtctttttaaaaatttcaagccgaaagcatgagtttagagtacaagggaggaaaagttagcaaggtttaaattaaaatgtgtattctagatctcaacctagatggtttagcctctgtgattacatgagtttgccagtctgaattagagaatatgacacatgtttggggagggagaaggaggatgggtaaccttagagatattaatcaatgatttgtaagcggtaaatctgaagagccaactacaaaagggagatgagggtgatatttctgtctcctgttagaagtattacataaatgcagaattagtgataagaaaaataatttcaattttttatcctctgtcttgtcctgtttgctaagatccttctccaaaggggtactggctct

SEQ ID NO: 242823 - DNA, 394 bp, Homo sapiens
ctgtctcggtggccccactgacatcaggaaacgtttagtgcctgagaagtgtgacctctgacgagttacgactcctcctgaggcctccatttcacaaaccttccaggaccgctgtcagaatgaggtgggggagtagactcaggaccgtgcaagcccatgggatgagctcacagccatgagcggcatggtctaagggaagaaggaaagagaagagaagagaaaagttggctctgctggtctctccctctgggttgttccccttgtctctgtgctcttctctgtctctgattataaaggactcagaatctaaaggataatagatgcagatggatggaacaataaatcgtgtggactgttgataaaacctttgtgcttgaagaaaatacaactgtgt

SEQ ID NO: 242824 - DNA, 840 bp, Homo sapiens
tagtaaagttatttcctctgatgttgtaatggggcagtggggtaacgcacatttgcctgccagggtatgcaaagtaacttacatcatgctatcagcaaaatgagaataatatagtggctagagtaagaccataaaagccaaaatacagaaaatccaaagctgaaggttaaacagaggtaacttcagaacaaataagccacaacggactctagatgtcagtgttgtgccaaataacagcaccagggaagatgtgggcaacacatctactttacaagcacgtttgtaatactgattttttttcttttcttttttttttttttttgagacagagtctcgttctgttgcccagggtggagttgcagtgagctgagatcacgccactgcaccccagcctaggtgacagagcaagactgtctcaaaaataaataaataaataaataaataaataaaataaagtgtttcttttaaactggtattgcctaaggtgtattctttataaaacttagaattgttaaatattttaagattcctttgaaagtgtttttgcattgatggtttaaatcagtgatatcaaactttcctgatcctatgtgcccagaaaaatgggcaggggaaaggaggcagcatggaacctcatttttttgtgtgtatctgtgtgtacacgtgagtgcacatgtgtatatgtgtggggccacatgtgttttgtatacggtatatgcatgaaaatgtacctttgtaccttatacacaaaaacaaattaaacaatggcataagcagcaatataaataaaaaatgctaatactttcctgccatattccaaaataaactgtcttgtgtaca

SEQ ID NO: 242825 - DNA, 853 bp, Homo sapiens
tccttttgtatcatgcgcagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtacaatatcctgggtcccatgactcttatctcccaaatataaattacaagga

SEQ ID NO: 242826 - DNA, 1264 bp, Homo sapiens
tccttttgtatcatgcgcagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatgtatatatatctggttgaaatactatatatatatatatatataccagctattaattctaggaaatggagtattaagggtgcattttatttcattagttttacttttatgcattttcttcatatcatattttgcattcagaattttcataatttgaaaaaaaataaactttttttttcttaaaga

SEQ ID NO: 242827 - DNA, 1139 bp, Homo sapiens
tccttttgtatcatgcgcagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatgtatatatatctggttgaaatactatatatatatatatatataccagctattaattctaggaaatggagtattaagggtgcattttatttcattagttttacttttatgcattttcttcatatcatattttgcattcagaattttcataatttgaaaaaaaataaactttttttttcttaaaga

SEQ ID NO: 242828 - DNA, 460 bp, Homo sapiens
tggccttactcccctcttgatggtgtcctgtggaggcatcccctgccctaaaaagtacaagatccccaaatacacggcctctgacactggacagacgaggtggatggtgacctacgagccacgtgtgctccctgccagggagaagggtgccacctgccactcagggccacgtaggggtgcgctcaggcacagaggaagccagcagccctggggaaggcaggccttgtagtaacaagagggtgcggtgcccctggtttccaagggaggatgtggcttgtgtgagtaattcctgggcttgcagggaggggagaccattaggtggaagaccaggtgggtgctgctggtccagctgagaggggaacgcacccgtggggaacctgggtgggggcacatctggagaggacttctgagccgggtggagctcaaagaggtgaaggtggtgcgcgggatgctgccttat

SEQ ID NO: 242829 - DNA, 824 bp, Homo sapiens
ggcagcctggctcactgtggtggccccatacctgcgcacagtggcttctcaggaatggctggggaaggagcaaatgggagtggccgagagctggcaggtgcaggccaccagggccacatggccccttcctgtcagcagatcccaccaatgaggagcagagcacagggtccctctcgggtccaaagctcctgactctgagccaggctgagggtctcactggctgtgggaccttggctgtcacacctcagcctcccctctgtaaagtgggcttgatagcagtaccccagggtgaaatgcagccagggcacaggcccgggctctgtgaggctcaagagccttggggaactgtcattgtccctgtgtaagcatttccagaaggtgctccctggtgaggctgtgtgggcagagaagcagggaggcctggctccccagaagcaggtcagctgtcaggcaggtggccaggactcagccagaagcttctgcagcaaactggataccgcctcagaggccaggtcctccacggcaaagtactccagctcagggccagggcctccacagcagagtactgccggcaaggggctcggacagcgcgtctactccctcgcggtcccggaggctggagtccaagatctcggtgccacagggctggtttatcccgagacctctctcctgcctggcagacgccagcttctcgctgtgtctgtgtcttcatctcttcttcatataaggacaccagtcccatgggaccagggcccaccctaatggtctccatttaaataaatacctctttaaggaccccatctccaaatacagtcttatctaag

SEQ ID NO: 242830 - DNA, 360 bp, Homo sapiens
atttcatgaataattcattaaaatttcacatctgcaagattagtcatccaaataaaatgctaatgtcaaaaacatgcaccgtctataatattctcatcaagaaatctttttgcatataatgataaatgcttagattagaacaaatgattttataaaaatattctatcaaaagtatgctagataattgcattcattgaagaaaacagaacttcagtacctaaatattccagaaaaaccatcttaattttgagattttaaaaaaataattagatgcatttaggaaatgtgctgtttctttttaatattactctatagtatatattctagggattaatgaatttgagcatcacctttcaataa

SEQ ID NO: 242831 - DNA, 402 bp, Homo sapiens
ccctgggagccagtctcctacaggaagcacgcattctggttggtatccccgtgccgtaagtcctgcaggggccggtgaggggaggcctgggggctggctcgtgtttgggtctggggctcagcctcagaggcccatcgctgctgcttccccatcctctcccccagcctgctgcgtgtctgcctggctccccgttggttctggagctcctgcggaaggagaggtgctgattttcaggattcctaaagcagcctccgcccgtgccaggggattcccatgccctgtgccacgtgtcccagcctctggtgccatgcctcacaatcaaccacttgcaactcttttaggcttttttctttgtatttatctttatgttcctaataatatgctgttgtaattagcccttat

SEQ ID NO: 242832 - DNA, 935 bp, Homo sapiens
ctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaaaaaaaaaaaaaaaaaaaaaaaaaaaaacatcttttttgggccgcctcgggccccagaaaagagtttttaaaccccactcttttgggcccgcggccccacggggtaaggggaacctgggcccaaagggggctccgaggaaaaccccgggcaccgaacatatgggctggggtccccccccaaataaaaaccgccgggggaaccccggagcgttgcgaacaaccccaaatgggggctcgggaggcctagacgggggcctaaacacgggggcccaaggaggacagaaaattaatccgccgcgcgtgtgcagtgtagagagtacgagcacggtgaagcaagacagagaggacatagcagagagagcgacgacagaagagcgcacgacaggaagcagagcgacgcaagccaacacacaaagccgcaagaaacacggcagccatgaagtagagagaagacagaagctaaccgacgagtacgagcggacgcacctgaacgcagagtactaagcagctcgcaacagagcagacacag

SEQ ID NO: 242833 - DNA, 702 bp, Homo sapiens
ctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaatgtatttctttctgccagcagccaagtcccaaaccactttcccctctgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatac

SEQ ID NO: 242834 - DNA, 484 bp, Homo sapiens
atattcccagttttgctttgctttagctatggtgtactagaataagctcacattggctcacaaaaaataactgttaaattatcacaaattttgtgagctaagtgaaattatgttatagcttggaatcaaccaagatttacaccacagaaacaaatgctgttaatccgggttttttaaatgttttctggagacctagctaaacatttaccataccactatgttagcaattgtaataagtatgtaatagtacctcattatcacttcaatttgcattttctgaatgactgtattttcatgggcttatttgtcatatatttttgatgaaatgccttcttaaatcttttggctatttttaaatctagttgttaagttttgacagttttttatatattctagatggaagtcattattggatatgtattttgtgtaaatattttttgcacagtccatggcttgtcctttcattttaaacagtgtctttcaa

SEQ ID NO: 242835 - DNA, 566 bp, Homo sapiens
attctatatattcgggatttcaaccaccaacctatctggtttttcccgctgaaatgttgggtgatggaatcaggagagcagatttggagactctttatattttataattgagagagacaaagagaaaaccgtttgatttgaaaaagttttctaggttccctcaggtagatggaaattttcatcaaaaacagtttattcaaggtacatagcctactagtttcccatttgagagtaccgcagaatgatacgacgtgtactgcttctctacgcagaatgaagtataaaattagcaccaaatagtaactttaatttgtcaggtgctaaactttttacatgctttatctcatttaattcttagaagaaactaattttacaagtaagtgtctggaccaacatctgcaggtacaaagcctgaaaagcgtaagtttgactcctacatagttctcttttgtaagtagattataaatagaaccagccaaaggtaataagttgtctgtgcctaaaaagaaagaaaaaagttagcatcagtagttctcaccagaaggggtgattttgcttaccagggg

SEQ ID NO: 242836 - DNA, 451 bp, Homo sapiens
atctcatttgtgtcacaaaatggtactcctactgattttgtaatgtgaagcaagtactgtgggtcagtaggggtaggaccaggagtgacaagtcaggattttcaggcttcataggaatgacacagctctccaggtgaatctcctggagaattctccataggatctccaggtgagtgaccaggatttcatgtaagcatagggaattgaatgagcattagatggtctaatgctgcggttaagaacaccaacttagccaaactgcctagatagttgggtgacttgggttaagtgacttaacctctctgcttcagtttcctgtataattcttggtagtagaatggagtatatgctgggtgtttggattattaatttggagtcttacaaagctgctatgttacatgattaggcatggaaaacttcggtttttataatcagtgaagtactgcttttt

SEQ ID NO: 242837 - DNA, 188 bp, Homo sapiens
gaaacaccatgggaccacagcaaaggcagaaggaggagtgagagagggaggtggacagaacaacaaacaggagttggctctcattttttcacgcgtgccattttctttaggtttttctagtttatggagtctctttgttccagttgagcacacagataaactagagatctcacaaggcttttgctgag

SEQ ID NO: 242838 - DNA, 463 bp, Homo sapiens
acaaactgtaccctattggggagctaaaattgtaataggtaacaaatataattaactgtcccaaaatacagctaaccaaccaaacttttttttttcctcttctttgagacacaaaccttttttttggttttttcctcttctttgagactgggtctcggtctgccgcccaagctggagttcagtggctcaattatgacttactgcagccttaacctcctgaggcccaggtgatcctaccacctcagcttcccaaatagctggtactacagggacacgccattatacccagccaatttttgtattttttgtagagatggggttttaccatattgcccaagctggcatatgggtcagctggcatatgcctggcctaaccaaaccattttactagcacctttctgtcacttaatgatgagccatttgattcattgacttcactgaacaatagtaacctaaaaaaaga

SEQ ID NO: 242839 - DNA, 457 bp, Homo sapiens
acaaactgtaccctattggggagctaaaattgtaataggtaacaaatataattaactgtcccaaaatacagctaaccaaccaaacttttttttttcctcttctttgagacacaaaccttttttttggttttttcctcttctttgagactgggtctcggtctgccgcccaagctggagttcagtggctcaattatgacttactgcagccttaacctcctgaggccaaggcgggtggatcacttgaggtcaggagtttgagaccagcctggccaacatagtgaaaccccatctctactaaaaatacaaaaatttgccaggcacagtggtgggcgcctgtaatcccagctacttggagggctgaggcaggagaatcgcttgaacccacaaggtggaggttgcagtgagccaagattgcgccactgcactccagccgggcaacagagcgagactccatctc

SEQ ID NO: 242840 - DNA, 516 bp, Homo sapiens
gattcctgcccctcagcagctgggtggctgaagggagctcaggaagctcagggcaaatcagcctcactaatttggagacgccttaccgtagaagttggtcctcctctctccagagcccgccataaagctgggcttttgtggtgagaagaagaaaatgagccatcctcatcccatctcctccaacatctatgccatgtgaggctccagaacggctctactttccgacctggctgcactgcaactagcccttaaccaaggtgtccactgcgtcttcaccccctacctcttgccctccagagctggtaaggccccttttccacgtatcgctgggactcttctcaccctacgcagttctccttagaccaaggcactggaaggcttggcatcaaatggaaaactccattcagaagacactacagttgcattctcttgcaagaacttaaacctcccttttcatacatagaaaaagggaatcaaggtaaaaaataataaaaaagaaaaatatagataataaaa

SEQ ID NO: 242841 - DNA, 471 bp, Homo sapiens
ctacttgggaggctgacgcaagagaactgcttgaacccaggaggcagaggctgcagtgagtcgagatcacaccactgcactccagccttggtaacaaaagcaaaactccatctcaaacaaacaaacaaaaaaattcagaaaatattttagctgctaaaatgaagtataaattaactacgtagtattgatgccatgagatgaactttaaaaaacactttctaatcccagcactttgggaggctgaggcaggtggatcacttgagcccaggagttcaagaccagcctgggcaacgtggcaagccccatctctacaaaagaaaccaaaaaaattatccaagtgtggtggtgggcacctatagtcccagctactcgggaggctgaggtagaagcattgcttgaacccgggaggtcaaggctgcagtgagctgtgattgcaccactgcactccagcctgggcaagacccggtctca

SEQ ID NO: 242842 - DNA, 363 bp, Homo sapiens
tgagaactcatgcatttaatgatactggggtcaggggaaattacactttctgaggtttagctgtaaaacaatctgccatggtcatatttggtgtatttggattcattctacattgagaaaacaggtcatctttgatcacaaatacctgcaaactcagtttgcataatctatttactgacatatttatatcagtgttgaaattctttagccatcaaattaatttaaatgtgtttcagcaccttttcaccccaagatttaaaatattcaccatattgtgttactgaatgttttcacgttttccttgtgcttagcttacctagtttagactttgctaatgcaaccttttgattaactaatgactga

SEQ ID NO: 242843 - DNA, 319 bp, Homo sapiens
agtaacagatcatagccaaaatgtcctttttgaattgtctttgaaaacaaatcattctattttgtgtaagtaaatgacccttataactctgagaatcttattttcctctaggttagaatctgtattttttagatcagtttcattacattgtgctaaaacatgtatataacataaaatttaccattttatgtttacatatagttcactggcattaggtacattcatattgtgcagccatcatcatccattttcagacctttttcatcttccctccagcctggttacagagtgagactccatccaccccctgcaaaataaa

SEQ ID NO: 242844 - DNA, 449 bp, Homo sapiens
tgcacattttatcacattctaataactctaaaatctgagatcatgccactgcacactgggcaacaagagtgagactccatctcaaaaaaaaaaaaaaaatgaagagtatgttaatttataatgcctccagtactatgtaagtttgttatataatttggagtctcactcttgtcgcccagagtgcggtggcgtgatctcagctcactgcaacctaactttgaggttaggagttcaagaccagcctggccaacatggtgaaactgtatctccactaaaaatgcaaaaaaattagccaggcgtggtgacaggtgcctgtagtcccagctactgaggaggctgaggcaggaaaatcacttgaacccaggaggtggaggttgcaaagagccgagattgtgccactgcactccaggctgggtgacaaagtgagaccccaaaaaataaaaattaat

SEQ ID NO: 242845 - DNA, 434 bp, Homo sapiens
taggtattgtttaagttgatattgtataaaattgagaacttatattcatagaaaatgcaggtgattttataaaagtgctggttttactttccatttttccattataactctttcttttctaccattacgtgccctctcagccaccacatactctcatacaaatgctttatgtatgaagtatatagcctcagtggcaaaacacttcccaaatcaaataccattagaatgaatgctacgtaattccaaaaatacatgtatttagtagaactgtatatacatttcttgaaactatttcttttttgagacttaacaatattttaaagcttgtgatccttttgtagtttatgagcatgatgattgggtattcatccatgtttgtgagatgtgccacccttgaaccttgttacgacatcagcacattacccatctgacct

SEQ ID NO: 242846 - DNA, 221 bp, Homo sapiens
ttcatccaaagatgaagatgagctctatgggccatgcaccagtggcggattatttgtcatatcagaagcacaggcaaatttaggtaacatcactttgtccttctaactttagaatctttattgccatgtgtggtgagtagtagtcccaactactcaggaggttcactcgagcccaggaatttgagaccagcctgggcaatataacgagatcttatctctta

SEQ ID NO: 242847 - DNA, 270 bp, Homo sapiens
aggcccccactcaggacaccgaggccgcttgcacggggttccactgccggtgtgtcctgtccacaacctgtgtgattcaggcccccttggctgggctgctaggtccctcagaggcccctctgtccttagcacagatgcctgtcttcccaaggaattcgagggaggccagcagcatgtgaatgcccacaccatgctttaggacgcggaagatgcttagagccaaatgggaattctatgaatataatgttaataaaaattgatttttgaaaa

SEQ ID NO: 242848 - DNA, 450 bp, Homo sapiens
ggctgtagtgcagtggcatgatctcggctcactgcagcctctacctagtgggaggatcacttgagcccgggagttgctaaaaggttggtgtgaaagtgatgggggtttgggtaggtggtagattggtgcctgattgccttgtgctgcaagggtccagagagtctaactactcctcatagactttgaaccaatctctatttttttttctcagcctcaccttttacccccctgacttttgtggtaattggtaccatccatttctgagccttttggggctatggacagggtaaattcgtttgcttcttgtttgaatttctcagctgctaggttttaactttcttgggttggcttaggtcagtgaccactccagatacttaatgtgcaccagaaaaatttgactgtctcttaggttctcgtgtctctcttgtcctatttttgtctttgtgagtt

SEQ ID NO: 242849 - DNA, 473 bp, Homo sapiens
tcagcctcccaggtagctgggaccacaggtgcaaaccaccatgcccagataatttttgtatttttttgtagagacagggccttgccatgttgcccaggttggtctcaaatgcctggactcaagtgatcctctcgccttggcttcccagagtgctggaattacaggcgttgagccccacacccagctaaacacttttaaattgggcaatttttctttttattgttgagtggcaagagttcttttatatattctagatacaagtccctaatcagatctataatttgtaaatagtctctcttattcagcggattggttgtcttttcactttcttgatagtgtcctttgaagcacaaaagtttttaatttttataaagtccagtttattcatttttgttgttgttgttgtttgcacttttggtgtcatatgcaataaagcattgcctaatccaggatacaaatatttacccataatg

SEQ ID NO: 242850 - DNA, 488 bp, Homo sapiens
acacatcttgagtttctctccatgatggcgcagctctcagcgtaaagcagtctatggagtgagaagggaaaaggccccagtaataaaaggcaaaggaagccctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatat

SEQ ID NO: 242851 - DNA, 594 bp, Homo sapiens
atttattatacttgcttcctccttattagatatcatttacttatcaaacagatagttgacagaagactccagagacatactacgaggaagtgaccagtgttcatctgaaacggatgccttgtttctcagaaatgtcattctctttatttcatcttcgtagttctgtgccttctctcagcaatttctgatttctttatttactgccacacagatgacaaatgacatgcatgtccatgataccctttactcaattcacatgcgatttccaaggctggctataattcccaaaccctcccactcaagaaggtacatttcaggatacaaatgactcaaagtacaatggaatcagtctagctttataattatatcatccccaaactttggtatgtttaacaagcataatcaacaaatctcttgggatatacctcacaaatgaactcacgtactactgttacttctattgttgggataggtatattttgcctccagagcaagacttttaagacactagaggagagggacaaatcttaggcttcttctattctcctggtgtgcctggtatgctactgatattgagcatgtaataagtaaact

SEQ ID NO: 242852 - DNA, 250 bp, Homo sapiens
ccctgtctcaaaataataataaaatagggcccatgtaaatccttttaaacatttaaatattcaatttaatttagatttagatttagcaaatgtaactttatgaaataaaagccaaatgaaggtatatggtgttaattttattgtttctaaacttaaaatcagctttgagaggccgaggtgggaagaacacttaagcccaggagttcaagaccatcctaggcatacatagggagacctggtctctaccact

SEQ ID NO: 242853 - DNA, 553 bp, Homo sapiens
tgagcccagcatatctggttagacaagagattctcaccttgagctggcattggggagaataaaagtaggaagaagcttggcaacagaactcgaaatctacattagaagtggaaggatttggaagtgattttgaaatacttcacaggcagcagtcttcattaccagttgggctttgctagtgattgtgctgtgatttctagactgttaggaaggccagtgcaactgaattcattgagtcctttggccatgggcctgagtcattcctcttgctgctgtgctgtgataaaaggaagagcagacacattggagatagaagcttagacctgttcccggagagctattctggaccagggaataaggagtcggcttttcaatctcacctgcagttcccttgtgaacccagggtgaaaatagttatgaaatgcagagatctttatgctgttacctggtgctgaaaataggatgaaatactttttaatgaccaaagccatgtcaaaatggatagttgtctttgttagtccttttgtgtttcttttggtgctgatagtttttt

SEQ ID NO: 242854 - DNA, 601 bp, Homo sapiens
acaaatgaacaaacaaacatctgcactattacatacaactgtagcaattgagtgcccagattaggtcttcctgatacagcatttagatcgaggtgtcccttctatgtcatcagctttccaaaatcagtgtttatgtctctcatcttcgtggtggactatgggatgggactagctgtcaaagggaggaaatgaataatcaagggaaatcacaatttctccacaaataggttattttcttgtctgtgactggttttcagcatcataggaagtaccgggagccagactgtcaaaaacttggattaaaacatatacatttcttggctgggcacagtggctcacgcctgtaaacccatcactctgggaggccgaggcaggtggatcacctgaggtcaggagttcgagaccaacctggccaacatggtgaaaccctgtctctatacaaatagaaaaattatctgggcatgatggcgggtgcctgtaatcccaactacttgggaggctgaggcaggagaatcacttgaacctgggaggtagaggttgcaatgagccaagatcatgccattgcactccagcctggatgacagagcgaggctccatctca

SEQ ID NO: 242855 - DNA, 665 bp, Homo sapiens
cagccctgatggcaatcttcaaagagggattgcagcatacctggagtagccacagcaccgttgtcagcactgagcccacacaagtgactgttgacacagggaccgtattctgtgtatatctatgttctgagaatattttgttgttgtggtggtggttggaaaagcttttatatgacagtttatggctcacagtggtgtctggctggtggccttcaatgcaatgactcataagaacctctccttcagtcacccttgaagacccaacaaagctggggaaaggaggggaatttcccgataccattgacaatgaagatggacaagctaacggcagaacctcagaaggatctgacttcagatatgcacgcagcgtaccctggcttcatttcacaaaaacagtacccttttgcaaagggaggaagtgactttctcatgacccgaaccagaaaataggcagccacgggactctatgcactgattccaccttggggagcaggcagaacatgtcccctttgtgaccacgttcactggcatctttctggatccagatagagtgcaaaacttagaaacagctgagtggtacgcagagggggtacaggtacagatcataccgtgcaggcaggtatgaccctacaataaactgcccaagatatgtgttgtatatgtgt

SEQ ID NO: 242856 - DNA, 393 bp, Homo sapiens
ccaaactccttacagtccctagaaatgtcatgtcatttcccaccattgtatttttgcatatataactctctttggctgtgtgaatacccttttccagccaactttgaaataattattccttcaagacttaacaccataaagtctttcctgactctgtagggcccgagtgatcattatcttcttttgttaacacagtccttttattattatacttttgcacattctaccccaacactttaagtcatgcttcctgtactacacagtgacctccttggggaaataaattatgtatcattcaatttgaatcttcagtatttagaataatgcctgacatacagtaggtgctcaataaatactgatttagtaagtgcttattatggatgtgtttttttt

SEQ ID NO: 242857 - DNA, 333 bp, Homo sapiens
gacttgactgagtgatatagtaactataggtttcgtcatctcaaaattatataattttcatactagattatgtgatttcattttaagtaatgtctacactgttttgaatatagcattttgatatattcatattgcatattatataatccaaatgaattatttcttaattagaaacaaaccataaatcaatagtgctttgatactttaagagaaaaatgcctaaatgttctcataataaaaaccaagtgaagaaaaaaattaggaaatttaatgtagagacagtgcttatcataactgtatgaatataaagatgttctccttagaacctcaatg

SEQ ID NO: 242858 - DNA, 436 bp, Homo sapiens
cagattctacttttgaagaaacttctgtaaatgtttgggctccacctttttctctgttgccaccataatgcaggttaaataaaaagcaagtaaaagcaaaagggtaaataaatttaaataataaaaatacaagtataggccgggcatggtggctcacgcctgtaatcccagcactttgggagaccgaggcaggcagatcacgaggtcaagagatggagaccatcctggccaacatggtgaaaacctgtctctactaaaattacaaagattaggtgggcatggtggtaccagctgtagtcccagctacttgggaggctgaggcaggagaatggcttggacccggggggcagaggttgcagtgagccgagattgtgccactgcatgccagactggtgacagactgagactccatctcaaaaaaatgaaataaaataaa

SEQ ID NO: 242859 - DNA, 726 bp, Homo sapiens
atttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgattta

SEQ ID NO: 242860 - DNA, 496 bp, Homo sapiens
aagaccagcctgaccaatatggtgaaaccccgtctctactaaaaatacaaaaatagctgggcacagtggcgtgcacctgtagtcccagctacttgggaggctgaggcaggagaatcacttgaacccaggaggcggaggttgcagtgagccaagatcgcaccactgcactcaagcctgtgcgacggagtgagactctgtctcaaaacaaacaaacaaacaaaactatatgacactgtattggtggatatatgatatgcatttggcaaaaatatacagtaacacaaagcatgaaactataaaaccatggaccttagttaataatagttcctgaaaggaatgcagtcctgttgatacctagattttagcccagtgagagcttatcagacttctatcttacagtactgtaagatattaaatttatgttgtttaatgtttaaacagtacagtctggtaacttattatagcagcaataaaaaaatggatacattgaaaatgt

SEQ ID NO: 242861 - DNA, 334 bp, Homo sapiens
actggattatttttggggagagaactgtttaagtgcctatgcccagagtaggatagtggaggcaggcacaagtttcccagcatcaaaatcagatatgatcactccttgtgatatccttcctatgagatctcctggtctgcaccccaactctgttttggccttgataatggttaagattaacatgattttaataaggttaacatgtttcataagctctgaaattatcaaaggaatgaatctgtgatcctaagaccatattctacatagagcagagaagagcccattcaaatttaaaacaagtacatgaagaacttcttttgacatggatctgcat

SEQ ID NO: 242862 - DNA, 667 bp, Homo sapiens
ggaatgttttcttttatctgattagtcatatttatagtagattcactattcactatttagattcactatttatcaataacctgcactcaatagttttggtgcattcttctaattctgtttatttgtttcctgataatagaagtatcacatgcattctatagataatttgaaagtataaatgagtattaaaaagaaagcaaccacatatcatcccccaaactgagattatcattattaacattttagtttattttcaagcatttcctaagtatattttagttatttaatcatattatacagtattcaatatatcttttatttttatagaagtattttctgtattataaaacatgctacaaaatgttttgatggatatacagcatttcaatatatcaaagtcataattgccctaatcctttctgatatcatttgcatctgtgtccccagcaaatcttacactcaattgtaatcccccatgttggagggggacctggtaggaggggattggatcatgggggcagagttctagtgaatgacttagcaccatccctgcttggtactacatacaatatcattctatcacttttaaagtgtgctgtgagacctcacacttttaaaagttgtttaaaagtatgtagcacctcccacttctctctgttgctcctgc

SEQ ID NO: 242863 - DNA, 413 bp, Homo sapiens
atagaagagttcactcatgcttgcttctagtacttgaactgatgtattttttacatttagatctataatacatttggagtgtgttattgtgtgtggtttgaggagtgaatctaattattttttttcaaatgggtatcaagtgtcccaacaccatttattataaaggtcgtcactgtcccagtaacttgagataccagctttatcatgtactaaactttcatatgtggttcgggtatttctggaccttctattttcatccattgacccgtttattcatctgctttaaagaggctttgctgtatgttttaatgtcagggctagtcttcctagagagtgcttccttgtcactattttcctagctattcttgttgtttatttttccttatgaacttttctgatgtatgatcagttta

SEQ ID NO: 242864 - DNA, 321 bp, Homo sapiens
ctgcatgaataaaaaaaaaacacaaaaaaatgtttgggcacagaatgggcttattcttctaaattagatttctcactttgctgtttgtgattcttcaataaacgggtttttgatctatttacactttgtataaatggagaaaaacaaaattaccatggggagggagaaaaggaaatcctgagcagatttgtgctagcaaatgttttagtactctacaactagaattctcctctcccatctcacagcgccagatgctgccttgtctgtgatgccacaggctgcagtggatccccacggcactataaacaaaatcaaaagctg

SEQ ID NO: 242865 - DNA, 500 bp, Homo sapiens
gacacatattgttcttaaattaagaagtagataaactctatctaattcataatccttcctcttcaatattttgcacttctatatgattggatattcaacaaactagaaattaccaaggaaaagataaatatagcacaatatagcctcataacacgtaaatattgatccatgtctgaatgagcatcatacttctatctatttttgcttgaaattttctgagattagaaaattcctggttgatattcaaatctactttaatttttttttaagcaaggaaatgtctgtttttctttgtttctatctaaaggcacaacttgttaaataattggccttcagaatacatgctatttctaaaaattgaagtgactgtttagctaaattagaaagtaatttatcaatccaattggtttcagtcatgtaagataatttgccagtcaagataatcagtattattgataatactatcatttcatccctggaaagattagctcccaaactga

SEQ ID NO: 242866 - DNA, 805 bp, Homo sapiens
tgaggtttcaccactgcactgcattccagcctgggtgacagagcgagactctatctcaaaaaaaagtacttcatctactgaacaaaaaccatgggataccaatgctggaggaagaagcatcatcctcagtttccactaactcaaccacgcatgagatggggacttggtgtccgagagaaaagcctctttttaggtcttcaaccttgatcaaaccatttctgaattcctcatatgaaggggtggcctgcccctccatacctgtgggtatttctagtcaggtgggatgagagacggagaaaagaaataagacacagagacaaagtatagagaaacaacagtgggcccatgggaccggcgctcagcacaccaaggacctgcaccggcaccggcctctgagttccctcagtttttattgattattatttttcattatttcagcaaaaaggaatgtagtaggagagcagggtgataataaggagaatgtcagcaaattacatgtgagcaaaagaatctatatcatgattaagttcaagggaaagtactatgcctggatgtgcacgtaggccagatttatctttctctccacccaaacatctcagtggagtaaagagtaacaaggcagtattactgtaaacatgtctcgcctgccgccacagggcaacttttctcctatctcagagttgaacaaatgtacagtcgggttttacaccgagacattcagttcccaggggcaagaaggagatagtgaccttcctccatctcacctgcaagaggctttcctcttttactaatccacctcagcaca

SEQ ID NO: 242867 - DNA, 435 bp, Homo sapiens
tggttttagggatgcaaagttcacatgtctgagcacacataagggactctgtgaatatgtgtgtatttgttgtgtgcatgcccgcagaatgggatacagagactcactctattcatcagggatttgttttaatcaggaattggcaggcatgggaagagcacgctgtccagggtcggcaaggcctggaaatgtcagagcatcagaatactgaaaataaaagacatggtcagtactcatacatagacatgacacacacatatacacacatatgcagactcacacatgtcaacagctgaatgaaaaatgtctttcattcctggaagcaggagtcatatcactttctccaaagcatgtctttttctatgcaatggtgtgctttaggtgcaagaacactcgagaagcggcaaagataaagttaaacaaatccaagtgtta

SEQ ID NO: 242868 - DNA, 346 bp, Homo sapiens
tggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaata

SEQ ID NO: 242869 - DNA, 324 bp, Homo sapiens
tattctcctgccctctgtgttctcaagctaagtaggtggggtcagcattctccttgccccccggttgttgcctgcctttacacgtccctggctcctttgagacttccatgcctggctttaccatgcttcctcctctctcctgacattcagtagccttctggcactcactgtcattcgctgaagattcagctcatggccaccttctccagttcacctcctgctgtgggtctccaggtgacttcagtatctacctagacagcccatccaggctctggtagggcagtcccttggctttctcatcttgcatttcctttagacattata

SEQ ID NO: 242870 - DNA, 474 bp, Homo sapiens
aaggaagagaatagtagactcagttgatagatgccctccaaagctgtctgtttcaaccccatccagtacttaaattccttctccaaccttacattgtgctagaaaaatccctttcattttgcatgttctctttgtcactttcacccctacgtccttacctcttggtgctatgatccaaggagctaatcactctaccccaaagaatctactcagataatttgacggtagttattgtggctgccttttccccagagctttcacttctccaagccaaacagtttcttataatacagtttactagaggattgttagaaaagttactcagcctcatctgtaagagacagataattgttgtgcctacctcacagggctgttgtggggaccaagtaagataatgtatgaaaaggtgcttagcacagtgcctggcatttaaaaagtagtcaataaatgttcattattgttgacaaagaaaca

SEQ ID NO: 242871 - DNA, 271 bp, Homo sapiens
cagcacagagtgtggcctggcagggacctggagaagaaggcctggccctgccccaccctcacaaggattcccgtctggcaggcaggggagacagaaactggcacccgaaccaccgaaaggatgactcactggctcagcaggcacgaagatctgcacaggcaagagaaacccacggtcagggcacagccccacacgggggcttcagctacctcaggagcattttttttttattgagcgatttcaatgtttaaatataattagtaaatatttt

SEQ ID NO: 242872 - DNA, 420 bp, Homo sapiens
  misc_feature (61)..(61): n is a, c, g, or t
gcaatgggaagatcctgatgctaacttcggctctcctgttagcccactgtgtgtacatgangggaacctctttaaatctccacacctcagaacttctgcagtgatggatgtgttccacggttgtcaaagtgtggtccccaaaccagcagcatcaacttcacctgaaaatgtgttagaatagtcaattatcaggccccacctcacaaccattgaatcaaacatcttgggtgggacccagcaatttgtatttaaccaagcccataaggtgattctgatgtgtgtaagggttaaagaagccctggggttggttcctttcagccgactttctgtgattctaactacagaagcaccctttcatgccacatgaccagaactaatagccaattaattgaaaaaattaattaaaattaagaaatgcta

SEQ ID NO: 242873 - DNA, 517 bp, Homo sapiens
ctaatccatctctgcccttagatctcctctctcactataacaacagcaccttccttataacacattttaggaattaaatagtgctgtgttagtccacttgtgctacggtaacaaccacagactgagtgactgaaatagcatgcatttattttgtcacagttctggaggctgaaagcccaaggtcaagatgctggtagggttggcttctggtgcgatctttcttcctggctcgcagacggccaccctctcgccgtgtcctcacatggcctttcctccgtgtgtgcacactcctcatgtcccttcttcttactggtcctattgaatcaaggccttaccattaagacctcattcaacctcgatgacctctttaaagcccgtgtccaaacagtcacgttaggggttagggctttcacatatgaatttagggggacacaagtcagcccctaacaagtatatatacagtgcccggtacacagtaacttcacaataaatgctacctcttattatgtgatggact

SEQ ID NO: 242874 - DNA, 661 bp, Homo sapiens
aaaatgtagtctccggataacaggtaccaaaactactacactattaatataactattaatcctgcatattccctccagttttgtctcctggttttattacaacatggaaagtagataagcagccattatcagaaggcaatgttaaagaaattacgagcaaattacaagcctgggatttacaatgactggtagggttaccctgggtttgtaaagtttggagaggtaagccttccaagagttaaatgctacctgggccttgacaaccacctggattcatgcttcgggtcatgtgcggaaacttgcccttgctacggttcagcttgtttcactaactcctctaagagtatagtctaattaaaacttaaaaataaaccttagatttatacaggattttgaggagtgaggtgtagcaatatgataaatatatccctataaggtgaaaatatatggataggtaaaaggacagaaacagcacatcttatatccccaataagtgtacttttgtatcttccaaattacctaaaactgcagcaacatggatggaggtggaggccattatctaagtgaactaactcaaaaatagaaaatcaaatattgcgtgttctcacgtataagtgggagctaaccaatgaatacacatggacataaagacagacataac

SEQ ID NO: 242875 - DNA, 155 bp, Homo sapiens
cactaatcataacatcaaagactcttaaaaacttgctagaaacaattacaacttgttctataatcattacaatttgtacacttataagaggattgtctcttaactaccataagcctttgaaagttgaaacaccagaaagagggaatttgcaagct

SEQ ID NO: 242876 - DNA, 359 bp, Homo sapiens
gctgttttggatgagcccctgcacaaggccccagcatctcagaacaaaccaggatggcctcactcatgttccacataatccaactgaactttgaaacaggccagttttcaaaaatccccaagaggttctagtttatctgagttaatgtaacaatgaagtcccctgtgttttaacgctatgaggaaagtaactgaaatgaccagtccactctttgctccctgtttctgctttcttcagcccttttgtgcctaggaagccaacctcatcagctcatttcatctgaacacttactctgttttacagaatgaggagcttctcaattctagaattgcaaataaaagccaattaatctttaaact

SEQ ID NO: 242877 - DNA, 467 bp, Homo sapiens
gcggccgcctactactactattaaattcgcggccggtcgacataaaagaggggattttagagaaggtctcagaagaaagagatgtgggggtttggtgaaactcaccagaggctgatccctttccagcataacacagggattgagaggagcggggtggcattaggccaggtgcataacccagtgctgctctctctggactttctgctctctctggacttgtttgctagctgagctcatccatttacataatttccagtgccatttctcagctgatgagtcctgaacttttgtcttgaggctagacttctccttcaaacagcagtcttaaacactcaacttctttcttgttttttccacttgtcaactcatgaacacctcaaccttgttacatccaaagccaaactcatggcttggagtggtaggtgatggctgtaatcccagtgctatgggaggctgaggtgggagga

SEQ ID NO: 242878 - DNA, 557 bp, Homo sapiens
gattctcactgaagtgcccctgaacccagtaaaggtggtggaatctgtgagtgagaatgctccccagtgtttccccaggtgtcagaccctcagcaaccaactctcacagaaccttcttgtgtgtggacactgatgaggaaactctcaggcagaggtagaactgggcgtggaatctccagcctgtccttcctctcatccttgtcaccagtggactgtgcctgggcaaggcaaccctgctctggatttcccttggctgtttcacaaaacaaccctctagcttcctcatccattaaatgggtaagctcatacttcctgagttacccaacaggactggtgtggacccacaaagagaatttagtagacgtatctcgtaacctgcccagcatttgatatgcacaaggtgaatttagtagatgtatctcataaccttcccagcatttaatatgtatacggtgaaaccttgggggcctaagaccctcacggtgaaggccacccttctgtcctcttcttcctcacacctgctttcctccatcatgtgctctccacagggccacaca

SEQ ID NO: 242879 - DNA, 498 bp, Homo sapiens
aagcggcagagctctagtccccaactccagagcctcctgaggggccggcggggcgggaggttcggcacgggagggtctcctcttcccgtcccctcctccccacgcgctcactctcccggaccttcccgccgcctcgcgcagtcctgggagcaaccgaggggggcggggggccaggaaaggcgcggagggggaagggcagcgtggaatttggccatcttttgacagaaacgaattgaagagccggtctttccctcactcttccctgctgcccaggtcccggcctagccctcaaccttcaaggccacctcctcacaccttcgggacgcagttccaccccgctttcctgtcccttctctccacctctgagtctgcaccgcctgggccatggccggctttctcccctcgcaggagagcagcccccacccaggactgcgctctcctccgccctctgcgaagtgcaggagtcccgctgatgcgccgggggtgcaggggtctcct

SEQ ID NO: 242880 - DNA, 453 bp, Homo sapiens
caccaaaaaaaaaaaaaaaaaaaaaaaaaaggttccccgatagaacttatagttgactgtccagccaaatacttaaaaaaaaagtttatagggagaaaaataccctcccccatccaatggtcataggaaaaaaagtagacaccctttattgccaaggaggaattaaaccctagtgacttgtgaaatgtgagtcacgaaaggtggcacttagagggtccctcagccctgagcgtcactttcccctccatctacctttgttatttcctttctcttttgccggtttccccaacctccttccttttctgattcattccttttatcctgatcttttcacttaatctcgtccaacatttccttctatctcccttttttctttctctaattggctacatatggaataaagtattttgaattactgggttatatctattaaataaagctttatgatcttta

SEQ ID NO: 242881 - DNA, 455 bp, Homo sapiens
cagatgcacgtggttaatgactgtggcaccagggagcccagaactgagattcagagatgagggagacgtcacctccctgcccctgggttttccttccagcgtagccatcaatggcctagtgttatctttcatccagtacgtacttcctgggcacaggcataagtatccagtgctctgtgagaccctaggggtgctgaacactgagtcacatccaggtcctagaggggttcacagctgggggcgatgtgtaaacagagtgaagggcatggccagcaaatcctgtgctggaaaatcagggcagctggagtgaggggaggggacaccccactgtccccaggagcccacacacccagccaagtttggcttttaattcgcctttcttgtgatgtcttttgctgaatttgctgtcatgattgtcccgattaaaagagagagcattgtgtgttccctctata

SEQ ID NO: 242882 - DNA, 503 bp, Homo sapiens
gagccaggctacaatcctttaaatgaagacagacaaggccaaggcaatcccagggcattactacaaagctaaggggtccccaaagaactaaagagtcagctccacaaaaatcccgattcctagcatgaaactgaaatatgaaaccaaacgggcatagaaaaggtatgtgcattcgaatcacatagcagtgactggagtcctgagctgtgtctgaagactgtgagatcacgtttggagctgctgattggttttcagtgatggccctgttgcacagtgccgtgagacttagctccatggccaaagacgatggtatcccctaggagccctgtgaggttgctgctgttctcttaagacaccaggtagccatctgatcctccctgagcaaactaactgggcagacaggtttattaaacctctgttggtccgacttacatgaaacaagagagttattttgttgttgttgttttgttttgttttaaattaaacctgtctttggagcctcc

SEQ ID NO: 242883 - DNA, 362 bp, Homo sapiens
ggaagttgaataggaatttaccaaaggtagaagaaggaaggggaaatggtaaatgcaagggcatagaggcaagagaaagaatgagaaattctgagaaaggtaaaaaactcagcatggctggcacagagggtaatttgtagagggagcaaggacatgaggcaagaaaggggggttgggcttaggttttgaagagctggagtggctgtaaaggcattcagattcatatgcagttgcagggagccagcaggggactgaaataactaggttcaaaattagatagataattctggaaacattgtggaaggtggacaattccaagctaagatctcttgagagagtagacataggtcattaaaaatatc

SEQ ID NO: 242884 - DNA, 484 bp, Homo sapiens
agaaaacacgtgcatttatttcctcgcgtctctcagttacttctccacactattacatcaatgtttctttaaggggtgaggaggtatgcctgcggtttgggtgagcctttttaagtgacgacttgcattccaactcggctagtgggtgggggcagtgggagttgatcgtttcccctacccctgcccaggacccccgttgtcccacttcctcctctttcttccggctggcgagcctggagtggagttgcgggcggtgggcgcagcctccttcgggatgcagggcttcagctcccctcatcttgcgcgcgccaccctcgccccctttgctggtgcggctggtgcttgccccttctcgtccttttctccttcccactccctgcgcgccaaggcctgggccccgcagccgcagccaggggacgagtggccgccttgccttccgcaggaacccaagttgggatcggcgaagcgtggtgaccgcggccgc

SEQ ID NO: 242885 - DNA, 282 bp, Homo sapiens
tggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagac

SEQ ID NO: 242886 - DNA, 403 bp, Homo sapiens
caagtcatccgtctcctttacacctgttggaaccggagtggtgagcagggagctagagcacaaagccaagcctgcgtgcctctaagcctccacgtgccacatgccccatcactgctgtccagatgtgaggtgtctcatttattaatcccaaagcagggcatttttggtgaagtgatcgtatttatttatcattatggtctaacagggcttactttttaacttttggagtcagacctgaaattcatcttttaaactagtctattcaaatacgtcagaaatgtcctgatctttttgcttgggagcttgtctttggaaagcttttaaagaaatatttgtgtttgtaggctaaagtttttcacaaatgacacaattgaaataatgaaatgaactcatgaggtaacca

SEQ ID NO: 242887 - DNA, 450 bp, Homo sapiens
tacccccataccccaatacctccctcacagcttttctccctcttgagccattcctgcttgtctccttcacccatgaggctgcatgcctctccagggcaaggagtagacttagttctatgtctctagtgcccacttagggcttcacacagagaggttgcctggatgtgtagctggggctggtgatgaaagggaggtgcaggccaggcgtggttgctcaccactgtaatcccagcactttgggaagccaaggtgggcagattatataaggtcaggagttcgagactagcctggccaaaatggcaaaacccagtctctactaaaaatataaaaattagccaggcatggtggcatgcctataatcccagctacttgggtggctgaggcacaggaatcacttgagcccaggcgctcacgtcactgccctccagtctgggactctgtctcaaaaaa

SEQ ID NO: 242888 - DNA, 290 bp, Homo sapiens
tttgttgactaggagatcattggtagccttttgaagctttgatgtcaggtacacatctggcctgctctaataagatgaaccactcaaagatcacttaataattgtagaatttcaggaaccacatataggtcaattttgacaagtgttgagtctgtttttgaagacccagattcttaagactcctctttcccctcatccttttatgtggactcagtgaattttaccatgccttgacaactcacaccccacccatggcaattaacccacccatggcaaacccacccatggca

SEQ ID NO: 242889 - DNA, 592 bp, Homo sapiens
agtgttgctttgcttactgtgagaacgcagatatcaaataaaaaaaccaaaggtaaactacaatcactagggccttttgttgggttttttaatgggaagtcaattagattagattcaggtatttcatatactaacatcaccttttgccctattaggatctgatggagcattaggaaagaaaggcaagtcatatttgcatttattattagggctaacactttttaattaaattggcttttactaagtatttggctaacttcagaattcagatactacaaatacgtaatcttcagcctgattcaaagttttctttttggggaatatcctttaagttagcagtgatccttatatatagaatcattgagagactaagctaagctattgtccttatcctctagtctagtaaaaggttgtgagcaggacagccatgtaattttcagggcctggtgcaaagtgaccaattctgggacccttcaagcaccaaaccctgcacaggtcacaagtccacccctgactaggatgtgaagttaaatagatagtggattcggttcgaactctgctacttatttatgtcgtttctgaacccctgttt

SEQ ID NO: 242890 - DNA, 286 bp, Homo sapiens
caaagaagattctaaaagaattcataaggttgtctgaagggaaaagtagatgaccccatggcctttttctgcaattttttcatctataaaacaaagtggtaaagactcagtttgttatgaagcacattcataacaaacttcctggggaaatctctggcaaaagagagacacgttattgggatggtggtcctgtattctccaaccttccacatccttgtgccagagctaatagtcgtgtgttagactgttacaaagcaaataaaattaacttgacttttcaccatct

SEQ ID NO: 242891 - DNA, 429 bp, Homo sapiens
aactgagaatgtgtattgcatttcaattagcctctgctaccccttgtcaccctgagaactggtcttgctgaattgtcatgcaatcagcatgacaatgtgatgtcatcagtctgtgctgtcaacagcctgggctgagagacagggagggaaacagcacaaatgacactcattgtcatctgtcttttaggaatgttgtcaaggatgtgttttttttatatcatggtttctatttatgaggatactcagagaactgcctaactgcttttcgatgtaagaacaattgtattactcctgagaaactgttctctttttaactttacaaatctctttgtaagtgtctagttttcccttctccttgtttttgtaggtagacttacatctattctggtatgaagcagagaataaataaataaattaagttaaattaaa

SEQ ID NO: 242892 - DNA, 430 bp, Homo sapiens
tgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattact

SEQ ID NO: 242893 - DNA, 602 bp, Homo sapiens
tggctcacacctgtaatcccagcactttgggaggctgaggtgggctgatcacgatgtcaagagactgagaccatcctgaccaacatggtgaaaccccatttctactgaaaatataaaaattagccaggggtggtggtgattgcctgcagtcctaggtactggggagtttgaggcaggagaattgcttgaacccgggtggcagaggttgcagtgagccgagatcgtgccactgcactacagcctggagacggagtgagactctgtctcaaaaaaaaaaaaaaaaaaaaagaacttgcctttcattacactttcttcccagaccctggcaaacacaaatttactttctgtctctatgtatttgttcgttctgcatatttcatatgcgttgaattctacattatagggtcttttgtgcctttcttcttttacttgcatttttataaaggttcatccatgttgtcaggtgtatcaataatttagtcctctttatggctgaatattattctatctattgatttactacaattgtttcattcatcagttaatgaacatgagtttttttctactttttggctattgagaataaaactgcttcaaacaca

SEQ ID NO: 242894 - DNA, 351 bp, Homo sapiens
caatttatttgctctgttggtcaaaagtcagtgagatgctttgtaaagatgaattggggaagaaggaaaattactctattgtcaggatgctgctgcttaagaactgggagacagcctggagcatcccaggacagttggcattaaacctagctcttatgaacttttaaaaaaatgccatagtttttttgtttgtttgttttttgttttttattgagacagagtttcactcgagttgcccaggctggagtaggagaatcacttgaacccgggaagtggaggttgctgtgagccaagatcatgccattgcactccagcctgggcaacaagagcaaaactccgtctcaaaaaaaa

SEQ ID NO: 242895 - DNA, 332 bp, Homo sapiens
gcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgc

SEQ ID NO: 242896 - DNA, 310 bp, Homo sapiens
ctctatgttcctgtaatgctcccagaatggtaagtctaatcctcttgagtgccagcttgcagtgattgcctgaggctctgttgtgagaaggaacttgagacctcctgcaaagcaacattatatgtaaaaataatttccgatttgtacatttcactttagagtcaaacaaatagactaacactaataaacatcagctactcaggaagctgaggcaggagaattgcttgggcctgggaggtggaggttgcggtgagccgagatggtgccactgcactcagcctgggcaataaagggagactccatctcaaaa

SEQ ID NO: 242897 - DNA, 314 bp, Homo sapiens
tttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcct

SEQ ID NO: 242898 - DNA, 361 bp, Homo sapiens
attaaaaacaaacaaacaaacaacaaaactgtgctccaaatgtatataaccctgtagattaatgaaacatttgggccaaagttctgtattctcataggcaaagactctcatagtattaatatattcactgattttaaattatttttaacttaaaggttttgttttaatctgctgtgatgaaatcttggatcactatagctgtaaatgagtagatttatctagatatgttaaatgaacaaatgtaaaatgttcgatacagcacaggtgcttaataagttggcttcagagccgtgtttttccaacatgttctgatgatccaagtttgatacttaagacaattaaaaacaagaaatttaactta

SEQ ID NO: 242899 - DNA, 2922 bp, Homo sapiens
tatctttcactcagacatcacttcctccaagaagcattccagggtccttctcaggtccaattaatctctcaccctctctgcatccgtgacagcccttcctgggaatgccctccttgccacgccaccaactcctttagggcaattactcatctctgggcaccgtcctcccctcccccacccagtgtctcatcatgcctgggacatttcaggtttttttgtttttttttttttaacttgagttgaagaaaagcatgtagaatagggagaattctaagaggaaaggttaagccctggggaacgggatgggacaatttcaccctgtcatcaggaagtgctcctaatagaagggcagggacagggtgtgtaaataaaccagttcaaattctcagagctcactgggcctgtggacctctccaagcacaatccatccagtttacaaagagggaaaggtcctcgcctgaggactcagagccacctggtcattgaagcacagaaggtagagccaggaagggcccctggggattgcctggttccatggttcttgctctttcctcagcctccacttcagttgcatgtccgacacaaacccatcaggaatgcctgtctttacatatggcatctccagctggagggtggagagtgggggagagagagagagagagagatggaggaggtgaggctagcctcctcccaggacaggtaaggaatgtgaggctctgagaggtggtagagacacagggtcacacaaggctggggaaccccatttggtcctactgcctcacagctggggagatgagaagaaccttaaggagggaatggctggcagagctagagtttaaggagcacctctggtcagtagtggactcacatttgaaaaaattctcagagccaccgcacccgccccagtccccacaactcttgctgggtctgacatcttaaatggattttgaggttctgtggaagaagctgcactggagctcaaccttcaagaataggcaaggtttgcacacatggagaccgggggaagggcattctgggcagagggaactgtgggcaaaggcaggtcacatcccaatgtggattagaagataaaagctcagaggagacagaatggggaatgtggagcctgactgatctgagagctgtggctgatgggacggggaacagaacgggtcaagcaaggagggggccttggccctgtgcagacatcttctctgggcctctagatggaaagtagagccagacagactggctccacgttgggccctgtgggctaaagatcgaccctatcagaccctggggacaggggtgggagggtatgaagggccctccaaggtgttcaggattctcgagtccctctcccctccctactccctctcaggcctgacctgaggccaagagaaatgtcacaggtcctccaaggttacgcggctagggcctgactgaagcaggaagcagtttccaaggccaccatccagccggggtcagcaggcatgcccgggcctggaccaggccgcagctgctctgggctttgtctcttcgtgtcttgaaacctcgagaggtcacttgatcttgcctgtgactctgagcaagaggccttacgtcagggcccagccagtcctgccctgactcttctgggcacaagttcttccccacactctctgaggccatcctccctctgatcctatctcttgccactcctgcagccatgtttaggccaggccttgttctgagccctcatttcctgaaaatgtaatctctccacgaccataccgactcacccttcttctttcttatcttcccacgtcccagagcagggccacggaactggagggtggtggctgggagcctgcctgtggacacagataggcctctatgcacaacccagttccatcccttaccagctaggtgacctggtgagtcatgtcacctgatgagtcacgtcacctctctgcatctcttgtgagaattaaatgagattacacgtgaagcccttggccaggtccctggtacacagtgagcacgtagtcagcggctggtgatgggtaggtaaatacccgacagaggctgaactccggggcctctgaccagcctgtgtgagtcacacacctccaaccctcgcctcttgtaccttcatgcaggaccatagagccggccctccctcgcctgtgctcctcctaggaaggaggttgtattctagtgtggatttggggccttgggggaggctttgtgatagcacctagttctttgcgttagcaattgggccgagtcctccctggaggacccaaggacaaaatgacccggctcagctagaaatgctgtcatcacagttatgcacaccagtcctctcccccactgcaaatatgaaaaatattttcttgtgactgtaatatgtcatgatttttcccctggcagttgtgccatctttgtcagcataacctttgctgccatagtgcactgcgtttgtgctggaaggctgggggaagtagataaattctgtgttcacacacatgagctagtgacctgcttggggccaggcattgtatccagtgctgcaggtatcactgagcaagacacacagtgccctgcccccacagggcttgcagccttttacaggtgtttgtttaaaacctccttgccaggcgcggtggctcacgcctgtaatcccagcactttgggaggccgagggaagaggatcacctgaggttgggagttcgagaccagcctggctaacgtggtgaaaccctgtctctactaaaaatacgaaaattagccgggcatgatggcaggtgcctgtagtgccagctactcgggaagctgaggcaggagaactgcttgatcccgggaggcggaggttgcagtgagccaagatcacaccactgcactccagcctgggtgacaagagcaaaaactctgtctcaa

SEQ ID NO: 242900 - DNA, 385 bp, Homo sapiens
taagattattcatatcttatacaattttcctactagtatctcatgcaaaataatgcaaaccaaatgaatttatattaaataaggcggcccagggagaaaatcttgccctaaaaaactaaccgttccaagttattctaaattggcaatgtgtctggagttctgaaataaataactggtgtgaaaaacctaagtttccagattcttcagatcttaactgtaatatttggttgtgtaatcaatccttagttaatctaagtgaaatgcaggttcatttttattagctaataatttcatttgtgttttttatcagacatataattgaacattttctagaaatagcccttaaaatccaggttaattgtcttacctcttttttcctcctttc

SEQ ID NO: 242901 - DNA, 574 bp, Homo sapiens
aatgagatgcagaggtccccaagaaggaaagtgaattgctcagggtcacagagctgtgtgattaattagaaacgcgtattaatctatcctgcagatgcaggcggtcactgtggctccctcagagagagaggactgagcctcaggggcagccagtaaattttcgcctctagggtaattaggagttcagtgattttttttttctttttcttttttttttaaagcacgaaatggggttaaattttttaaattaatttttaaaaattgatttttaaaaggagtttagtgatttttaatgaaaagagcccataagaggcctttgtgatggggccctgggcttacctctcacttattctgaggcagaaattaaagaaaaataaatactgcgtttcttcactctaagaaaagtaaaagctaagtcctagaatgtggcaaggcaagggctaaaaagaaaagaacaagtgtttttctatttagcagctcacttcaaggagttataagataatgctgtctgaaaagccaaggctaaaggaatgggctttagacaactcttccttctccagagcaaggttgaggg

SEQ ID NO: 242902 - DNA, 400 bp, Homo sapiens
taatcaaatgcaatgagaaaaacacaacatcacttctctaaaatttataacctggttataatcaagaggaaacattggacaacagaaatttggagaacttctattgaataactgaccttggaaaatgtcaaggccatgaaagtcaagtagagattgcagaactcattcagactaaaaggagatagagagacatggcagacaatggagtgtaacgtcttctcctgaactggacctttttactataaagacatgagaacaactggcaaaacttgaatcgggtctctgggagaagtatattcaggagtccaccatactgttcatgcaaatttattaaattcattcatgtaaattttctgtaagtttgaaaatgaaaaaataaaacccactttattcttattaa

SEQ ID NO: 242903 - DNA, 482 bp, Homo sapiens
tggtagcgatgaggtctcactatgtgtcccaggatggtctccaactccttggctcaagcaatcctcctgcctgaaagtgtctttattttaccttcattttgtaagtatatgttggctggatatagaattttaggttgaaatttttatttcttacagtactttaaagatatcttctggcctcccttgttcgtgataagaaattaaccatcattcatatcatcattcccctatgtgaaatgtgaccttagttctgactgctttcaaaattttctctttatcttttatttcagcagtttgactatgaaactgttggtggttttctatctccttgcccatgaacaaagtatgaacactgttataaagtctttgctaatgccagcttctggatcatctaagtgctgtttctattaactactttttctctggactatgggtcacactgtcctggttttttgtatgtacaataaactttaattttaaac

SEQ ID NO: 242904 - DNA, 558 bp, Homo sapiens
aattagctacatagagttgccatagagctcagatgccaacatttcagattatctgtctctttgcctttagaactggggactcgtgtttgaacattacagcttgtttttactttcttctataacttaaaatgcatggtacatttttccagatatataggcacacagattttttaatgaagctcaagaaggctcattgggaacctggcctgccctggtttgagcactctgagaagagtcatcttgtcattttcatggtcccctctgagtggtgccctaattttagctttcccattgtctagaacgtttcactctagaagttcttaataaaaattgtttgagactgtgggcctagctaagtgaactttacaggtgtagttcaatacatgatttttttgcctaagctagtttgagtaggatctttatcacttagagaaaccagaagaaagaaagtatatatatatattgtttcatcaaaacaagatttcaggaaccagacaaggatgtcgactctgccagttctgttcaacagtctttaccggagcaacgaggcaaaaaaaa

SEQ ID NO: 242905 - DNA, 192 bp, Homo sapiens
ccttcctccccctccttcattttaaaattgtgaatatatggtgatgaagaccacaatgaatactagtgaagtttggtgctactactttgatttgtgctacactggaagcagctttatccaccattgctttgctttgtccttgtaaatgtcaacatgtgaaaaagtcaaaaaatatcttagtattagtgtaaa

SEQ ID NO: 242906 - DNA, 380 bp, Homo sapiens
cttattcacctatttctccttcaaatcagctcatagaaacaagaattcctcttccccaaagaaagccataaaacctggaaatgttactctctgaccttctgtcttcttccctgaaaaccctcatgtgacaggtgttctgtcctacaccgggaggaagaaatgctacacagagaggctgagaagaatctgaacaaacaggccttgctggatttccccttcagtttattgccatttgcttgcactttttgtcgaatcacatttctacatggtgttaaccaaacataaaatacagttttccctgggtctttgcatcttcatttctgaaggttcccctgtcacataaaatgttgattaaataaatttgttacatttttcccttg

SEQ ID NO: 242907 - DNA, 487 bp, Homo sapiens
aatatttcaatttaatatgcttcagatctgaatttggtggcctcagtagtttagaccataataaactaaaggttttagaaatgaaaatttttaccaagaacaatttaaacttctttatgttagatcaactaacttaaatatatttattttagggtattcaaaattatctaagaagcttagaaagaaattcgtttcagctgggcgcggtggctcacgcctgtaatcccagcactttgggaggctgaggtgggcggatcacctgaggtggggccagcttggccaacatggataaaccccgtctctactaaaaatacaaaattagccaggcatggtggcgtatgcctgtaatcccagctactcgggaggctgaggtaggagaatcgcttgaacccaggaagcagaggttgtggtgagcccagatagcgccactgcattccagcctgggcaacaagagcaaaactccatctcaaaaaaagaagaaaaaaca

SEQ ID NO: 242908 - DNA, 417 bp, Homo sapiens
ctattggtataaatttagggaggaaaaaaaaacaccttgaaaccaaaatatgcaatatggttttgtatgccttatagccagagatgaaacagaacccaacttaatattgccacacaatattcagctgtcacagacgtcgtgctttctctgaacagttctaacctaggccctcattaccaatatcaactttctatgcagttctgtgtgaacactcaggatagactttcatccagcctagttataccagcgtgtgatttgtctaacacagcttcagcatcaactgataggaccttaatgcttgcaagtggcatatggtcatctgctcatcttttacatataagaaaactaaagcacaaaaatgttgaagtattaggcccaagctccatgtttggttagtcaaaattttaaaccctcctg

SEQ ID NO: 242909 - DNA, 512 bp, Homo sapiens
tttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaa

SEQ ID NO: 242910 - DNA, 316 bp, Homo sapiens
cagtaggacagtgctcattgtggatgaaaagtatcatctcttattccgccaatctcacttctcacagcctttttagcgtcttctgttctgagttcttctggttggtcacctcctgcttgctgaatgtgggcactgcattaatagtacacatgctgaggacaaggggaatcagccaggagccactggagatgttatcatggcccccagagacggaagatgaggatgggacctgttttcaccacccacctccttccctttttcctcttgttaacttcccaaataattttataactttaaatgattttatcaaactttg

SEQ ID NO: 242911 - DNA, 395 bp, Homo sapiens
gagtctcactttatcactcaggctagagtgcagtggcatcatgatctcagctcactgcaacctccggcccccaggttcaagcgattctcctgcctcagcctccacagtagttgctattacaggcgcgcaccacacgcccagctaatttttgtatttttagtagaaactgggtttcaccatgttggtcagtctggtctcgaactcctggccttaggtgatccgcccaccttggcctcccaaagtgcagggattacaggtataagccactgcgcccagcctgcatgagcttaatttcaaaagcagtaagaaaactatgctctcataaaactctgtctctaccccagttcagttactgatgtcacaatgttacatttaggcactatgtgtccaaaaac

SEQ ID NO: 242912 - DNA, 363 bp, Homo sapiens
cagtctctgggcctaaattggaagtatgaaccaaatcactgactcctggtgttagatttgttagagtcctcagaaataatctagttcaacctcaagcctaaagccagactgtcctcaatcacattaggaagaagttttcccacccctgtctgtggctgggaactttccagacaggcaggtcactacttcacagtgcagcccaaccatttgttttccaacattaagaatgcggggccaggcatggtggctcacgcctataattccagcactttgcgaggtccaggcgggcagatcgtttgagcccaggagctcaagacaagcctgggcaacatgacaaaaccttgtctctaccaaaaaaaaaaa

SEQ ID NO: 242913 - DNA, 505 bp, Homo sapiens
taaactttttatgtttaagtgaagtactatttatcatgtgtttatggaattttctgcaataaattcatgtgtatggatggatttatgatatgttgaattcatcaccagaggttgaactgtagagaagtcctttaagaggaggcattttatcttcctattatattttatcaattttaagatggactcaacccttctacacacacgcttctttccatatggatattcagtttttcttgtaccatttgtttaaaagattttattttccctcgttgaattgctttggtgtctttgttgaaaatgactggaaaaatatggatctgtttctgagttttattgagaactggtcttagatgtatcagcatgtttaaaatgatgttctatagattgtgatcctcaatcaatttgttcacttaaggcagttctgtagttattgtttgagaatgtataaacatcaaaagcgccatcgtatacctgtagagaattactagtgcctctaaaaggaaga

SEQ ID NO: 242914 - DNA, 447 bp, Homo sapiens
tgatgctaaaccattagaaaccacccctatgatccaatcacctcccaccaggccccacctccagcagtagggactacatttcaacttgagatttgggtgggaacacagatccaaaccatatgagtggcactaaagaagacactgaagaacatcacctaagagccaggcatggtgggtcactctcacaatcccagcacttcgggaggccgaggcggatggatcacttgagatcagaagttcaagaccagcctggccaacatggcgaaaccccatctctactaaaaataagaaaattatatgggcttggtagtgggcacctgtaatcccagctacttagggggctgaggtggaagaatcacttaaactcaggaggcagaggttgcagtgagcagagattgcaccacttcactccagcctgggctacagagcaagactccttctcaaaaa

SEQ ID NO: 242915 - DNA, 371 bp, Homo sapiens
tagttcattatccatactgtgatgtcttttgaggacgtagcatccagtggactaaggtacaactttcaagggcattttgtcttaggttctttcttccttccctacacattttgacttgtagaatgggtagctgctgggaagttttccctacaagaacttgacgtggaaaaattctgattacatcatttccaaatcatcctttttcttggctataaatttcaaaaattgttaaacatcttaatgttctttgacatcacaccattattattttcactgaaatgatgactatcttgtttagccattaatacctttgaagccagagatgtcccactggagaaactaatataattcaaatttaaacatttgctaaa

SEQ ID NO: 242916 - DNA, 554 bp, Homo sapiens
agtgcttaataagattactttgaggattaaatgaggtgatacacattaagtgattaacacagtctaaactggagcaaactctcactaaatgctagccattagtattcatccacttcatcttagtagaactctttaaagctagcctggggatattttgatttcacagcatttgtgaaagtgttgcttttttaaaaacgcctgaactttttctgtcttccctgaaacatacaaatcaatgatcaagggtcttttgaaccgagatagaagctggaatgaagctaaataaaaatatagactattaagattcctggaattgcgagtaagagaagtgttggagagagagctcctctgtcttaggagaaagggaatagggccactgcacagaccctgtttgtgaaaggcatagagggcacgagaatcttagtctcaagtggccccagatgagcaaacaaggacataccccttaaagagacctagctatctttatgtagagttatggacttgagagagaagaaatatatatatatcatttagagaatgggaacatcatgttt

SEQ ID NO: 242917 - DNA, 106 bp, Homo sapiens
tggccctcccaaagtgctaggattacaggcgtgagctaccgtgcccagccttgtctcctgtttatagaatcacttgaacccaggagtttttgagacttcatctcaa

SEQ ID NO: 242918 - DNA, 410 bp, Homo sapiens
cccgggatgggtgatttgagggcttcttttggctcctacccatgtgtctaatttccctttcttttccctcttccttctctttccctgggctgagacaatcatagaatggtgattaaacatgtagaacaaatcatggttctgccacatcagctgtgtgaccttgtacaaggtggtttacgtttccttgccttagtgccctaatcatacattggttatggtgataatatacccacctcgtggggctgctgcataaagcatttagaacaatgtctggcacacagcaatcactgtgacaccagccaacacaatttcctcttctcctccctctcacattccctgcttgacagcatcctgaaggactcaggggtaatgcctttgttaagcaaaataaatatctgaacacctgcatc

SEQ ID NO: 242919 - DNA, 142 bp, Homo sapiens
tgcacagaatgaaataatttactgaagacaaagatgggcttaaataaaaggcacagtttatataggaaaggccagataaattctagagtatttttctttatagttaccaattttcataactggttgcttttctaatatccac

SEQ ID NO: 242920 - DNA, 817 bp, Homo sapiens
tcagagttatgctttcagtattttatctcatcaaaaggaagaggaaagacgctgtacaggcaggcaacataaagtgctttaaaaaacactggtttatcaaagccgggatctaagttcaaatcacatctataccacctaaaaactatgactttgggcaaggggtgtgggtgggtgggtgtgtgggtgtgtctgttttaatggggagaaagggggtctcactatgttgcctgggctggtctcctcaggtattctggtgaatactgatcaacccacacgtgtgaagaaatgacaggaagccaggaaaagaaccaaatgaaagttctgtgataacaaaggcctgatgcacaaaagggccagcacccacgcctgttccctcagccagactgaaaaagctgcatgatacatagagcagtggatacactgcataaaagggccttgccttagaagtcaaaagtaaatcagttctaggctgagcactgctccaaacccatctaccatatcttaaaaagataaaattgtttccgactagcttaattgtgtgacagaacaaagtgtaacacttacaggaatacaaaaatatacagcacccaacaaggtaaaaattcacaatgtctgacataaaatgtaaaattataacacaggtaatatattaggaaatacccataatgaagagatttattaatcaaccaaccagaattggcacatatgttagaattagcaaagacatgaatgcagttattatattacgcatgttcattaaaaacatatataaatggaagacatgaaacacacacccaaatccaacttttagagatga

SEQ ID NO: 242921 - DNA, 630 bp, Homo sapiens
gagttaataaaggatgaaactatacttttgtgtttctgttgtcttgtagaaagctcataggtaggaagaacatacgctttggagcagaaagaactgtgttcaaatccattcttctactcaacctctgtgaccatgagtgggttgtttagcccgcctaaacctcagtgttctcatatgcaaacctggagaatgtctcgtagggtcattgtgaaatccaactggtaggttgccttatattactactaatttgcgctattaaaggcaagctgatataaattagaactcttctgaatgggccttctatatttaaatgggctttttctaggaagtgtatatttgtaaacttgtcttgaatggaaaaaaagaaaatacttgtagatttgaatgaaccacctgagaagatctcattgtagtctgtcataaatcaatttctctgaatcatctgctatatattagcaagataagatctgctttcttagtgttcgaatacagtactatgctccagagaaaaagaaattgctggctggggaataagtaattaaagccagtgacaaaactttctaaaactcagtggattaatttcattctaaaacttctgaggttgttaccagcacggcactctctcattcc

SEQ ID NO: 242922 - DNA, 524 bp, Homo sapiens
gcagccaaatgggcgcagttgtactccagatctctgactttcacattctgggtgcaaaaaaagtgaatgggatcaatttctccatgaactgaaacaggactttgggcaagaaaatggatgcctagaatgggcaatgtgctctgggacagaagattgtataatacaatataagacaataatacaatagcaggagaagatggaggagagggacccacaggtctacatcccttctcaagtgcaaggagaaaagcaatattcctcacagcctcaagaagcctgtggccccgcgagcagggctaggcacagcaacttccactgctgcatgcagttaagccacatattgaaaatggaaacactttttctttgccacagagcaacacagggtgcctggctcagggcataaagaaagaggtgaggaaagtcaacagctagtccctcccagccagggtcacccgttgctgctcagcctggcaaggctgaagttcaccagaggctttattaaacacagtctttactagaataaa

SEQ ID NO: 242923 - DNA, 462 bp, Homo sapiens
ggatgctgcggggttgggagtgacgcccagcaagaactgcagagtcggcagccccaaggacctgtcctccacagaaacacgcacacaaagataagcaaaagccgtcagaatcaactttgtggaactctgggaaataatcaaagatttacagcaagcaagcaaaaaaaagtgcactaatgacttaaatacagcatttgtggaaatctcagtcaaacctctagctgaccatgagctacaggaccagggacttcagagaacacacattgatgaagaatatagtcttcaactagagtgcctcctaatgttggctttgttggaagctgggccaacagtatttgctagtttgctttgtggtcagctatgccttttcattggcttaatgagaagccaggactcctgaacctaagtctcaagttcatttttcaagtctaagtgttagacattaaatgaatccctatgata

SEQ ID NO: 242924 - DNA, 432 bp, Homo sapiens
acctgtggtcccagctactcaagaggctgatgtggaaagatcacttgagactgggagatcgagggttcagtaagcagagatcactgcactacagcctcggtgacagagtgagaccctatctcaaaaagatattttagagataaggaagtaattctggaatgtttaggtaggtcaaagacatattggtgaataaattaatgaatgaacgaacgaatgaaaggtgtctctgaggtatatgtgcttggaagggaccataattcctgaatcttggaattatgaaattttcaccattagatgtgtgatatttttgtgtcaagcagtgcctgtctcaggagccctcttaaagaggtgaaatactttgagaagggagaggcacagaagtggctgctaaactggcaaatggctattttatgagcaacactggtaaaaaaa

SEQ ID NO: 242925 - DNA, 507 bp, Homo sapiens
gttttatctttttgttattgagtagcaggagttctttattctgcataccagatccttattagagatatgatttgaaaatattttctctcattctataggttgtctttttactctcttgataatatcctttgatgcacagaaggttttaattttgatgaagtccaaattatttatgtttttcttttgttgcttatgctttaggtattcatatctaagaatcctttgtgaaattcaacttcatgaagattttacccttatgttttcttgtaagagttttatagttttagctcttatatttaggttgctgccccattttgtatatggtgtgaagtatgtgcaatttcgtctttttgcatgtggatatttagttatctcagcaccatttgttgaaaagactattcttgccaggcacaatggcatgtgcctgtgattccaactaataaggaggctgaggcaggaaaattgcttgagcccacaagcaagtttgagcaagacccccatctcaat

SEQ ID NO: 242926 - DNA, 638 bp, Homo sapiens
tgcaaatcatatctaatacttgtatctagaatactcttacaactcagttataatctgcttaatatgaaatcaacagcattactatgctgagctgataaaatttcagcctaaagcaaagatcttgtttagtttgccagtgctatcttagaatcagcaaacttaggggttttgtaataataaactaccttgtgcactggttcatatttggttcaataaatgcttgttgaatgaattcaaggctctagtaggcttctaaaaggaatgaaggcacagatcctgtccttggggaaataagatgtgcccaggaatttctaatacagggaagacagtaagtgatactatgggaaaggcatttagagtgctcttggagtttggaggaaagaaggaattgattccagtttggggaatactgccttggaagagatgggtttaagattgattttaaagaatttggccaggcctggtagctcatgcctgtaatcccagcacttcgggaggccaaggtgggaggatcgcttgaagccaggagttcaaaaccagcctgggcaacatagtgagatcttatctcaaaaaaagatttttttggagtaattatgcatacttcttgcatttttatttccctcttgtgaaaaaaaaaa

SEQ ID NO: 242927 - DNA, 433 bp, Homo sapiens
cctttccatataaaattgtactcatagatcattttaaagtaacacatttttttttcttaaagagatgaaattggaaaataaagtggtaatagtgtgtttaatttgtaagtaaaccctaggaacacaattcattttactttgttattatcacaaaacagtaaaaatttatcttgtttttaacagattccgattattaacaaatccgatttgtatcctatttatgtatttgtcacatacgtgaaagtcgtctttttcttcttgctagagacctaaactgtgatgatcaaattgaacagtataaacaagcaattagatgattaatttgctacaacctactccgaaatatgagacattttatccacttatgtatattcaaggccaaggttatcaataaaatacaggcagaagttatgccgaatgaaaaataagacat

SEQ ID NO: 242928 - DNA, 377 bp, Homo sapiens
aaaccaagaaagcagcagctcacagcatgtttgcacaacttcatgcacatcttatcaaccttactttgcaaggacttcagccttccattcttacatcaagctttcccagaagtttcctacccagagatgacaaagtggtaggaaaagtctccacagctcatagactgctatgaacttcaggcgccttaaagcaacagatgcatgtttcaaagtgatgagaggcaagaccccaacaagcagcacaaacagaaatccaggactaaacacaggaagttatggtataaaacttcacgagtcttagaaattaggatccttacccccacctccacgcccttgctgacagatatgaaaataaactttacactccctaattcatg

SEQ ID NO: 242929 - DNA, 365 bp, Homo sapiens
ataatgtaggcttctcacaagcaagtgacacttctactcccactgcctttggagaaagaaaatttttctcttgacctacttttaaataaaaagaaaaaaaataaaatctgccatactacatatatactactcccaacttatgaagagaaggtaagtgcccaatataaatattacagctaaagaaaaccagaaagaatgaaaattattatagaattaaagttaaaatgcccacaaaagccaggagagcagaaccgatctaaaaatgtaattctgggtgcaaagaagcagattaaagggtctcatttctttactagataaagactacaagatccatgctcttctgtcctcaaatgtttcccaaattc

SEQ ID NO: 242930 - DNA, 605 bp, Homo sapiens
gattatcaatccaaactcagatcatgtcagttctctattcaaatttacttagggtaaaagccaaaatccttacaagacccaacaaaatatggcccctttacacctctttgatttctctcactaagcttctcttgcccttcctgccacatcaacctcacctattccactcacagtcaccaaatgcactggaatcttctgtagttccgacatatcaatcagactcccaactcaagacttttgccattgcccttttttcacctagaacatccagccataaacccctatatttgcatggcactttctcaccttcttcagctctttccttaaaatgaggccttctctggccaccatatatgaaatagatccaacctgctaaaatttccatccccagtactccttatccctcttactacactgtattttcttctacagcaattatcatcaaacatacttcattatgtacttgtttatctgttcgttctctgcacaaccatctctacaccctgcctcacaatactatgtaagctccatgaggataataactttggtcactggaatatccccagccttgtatattgtagatgcctaataatatctattgaatg

SEQ ID NO: 242931 - DNA, 461 bp, Homo sapiens
taggaggactggcagtttctgctatggcctctgggagccatgagctgccatgaaaaaggtcaaactactctgctggagacacccacctggagaagccctgggattccatggagaggcagacggacccagctgagctcagtgttccagccatccccacgaaagcaccaggaacctgagtgaaaccatctcgatcctccagcatagcacaatcagcagctgaagatcactgagtgactctagtcggcgctccatggatcactgaaggatcacccagctgagccctgcgcaaatttctgactcacaaaactgtagacgatacaatggttgttgtttgggggcagtttgttatgctgtagcaataaatagccagaagagaccaagaggcagaagttgtttgctgaaaataatgcaaaaattataccagcccttgcccagctacctccggatttcttgctacatga

SEQ ID NO: 242932 - DNA, 404 bp, Homo sapiens
tcgaggagaagaaagggctatggtgagagcagacagcactgccagagtttatgggacaaaagagccaaatggttccttttagtcagaatggatgccagggaaagtagcagaactcgagttgccatcaaagggccatgcccgagtggccatccttcagagtatgatgactccaacagaaagaatcaggtcctcggatcagccagagggtgcatctcctctgccagggaacgagactataataggggtctccaaggagcccccaaagtatctcatttgccacccagaaggctatgatatcatatgaatgactactactaattaagactattactcctccttccccttctctccctcacctcatcctgagcttgaaaagtacgcaaaacagtaaacacagaaagcaa

SEQ ID NO: 242933 - DNA, 317 bp, Homo sapiens
ggtcattatttttattggataatatttcccatcctttcactttcaacctatatgtgtctttggatctaaacaagtcttgtttagacagcatatcattgggtcttggttttcatctattatgccaatatccacatgtttattggagagtttaattcatttacattttaagtaattactgataaggtagaacttcaaccattttatttgttttctgtatatcttatgccttttttattcttttcctccactactgccttttttgtgtttaactgatatttcataataaatgtttttgattccctctttatgaccttatg

SEQ ID NO: 242934 - DNA, 423 bp, Homo sapiens
gggtcccggtcccggctcgtcaagccccagctttatggtggctcctcagcctcccactacgtgggtagaaagtttccagccacgaaagtgaaagtgaaatgcaaatcaagcctaccgggaggaaaagcctccttgcagcctgaagagagtacagctgctgcaaatatgcactttatttttcaattacagaattgatgcgctcgtaggtgtcacaagataaagaggtgaattgttctgttaaacttagctccctatcatcctcttaacattcccccgccagctcttataatcactcaatcgttcattgtataaagcttttaaagcttttttaaaagttcgaatacactttttttttttcaaaaatgcactcattccgtaaacacttggaaaagtacttaataaagtacatttaattttatgcca

SEQ ID NO: 242935 - DNA, 645 bp, Homo sapiens
atcttcattcagtgaggtgacgtgatgacctttagattaacgaaggagttaatagttctaacatccttcaacttccagcctgaggtttttaccagtaactgctgtgttgtaggtatacaagggagctctttacaactacatttctccccctcccagccatggtgcccctaagttgagaaaaactatcgcagctgtcagtgccgtatagttacttttcagaactgctgcagcagtacatatccagtgtaggtttgtgctaaacattattctagtggctaggatggaacaaaccaacaaaataccattgtttcaatgaccaggtacatacagaaaataaacaagtatggaatttaatttagatggcaataagtgctgttaagaaacataaaacatggtaggaggacagggactggcataatcataggggatatgttgattttaaatagtggggagggtctcctatttaaatggagtcctaaggtgaaggggcattaaacatttgagtatctgcagggaagagcattgcaggtggagggagcattcttggcctaataaatggcaagcaggtgaatgtgaactgttcaagaaccttgtattatcttgcaagttaaaagggttggtaaaaattggtaataggccaaggca

SEQ ID NO: 242936 - DNA, 417 bp, Homo sapiens
tagaagtcaatgcaaagacaaattacaactcaaaatcataaagaaggataagcataagatccagactgatctgattcatagctcaaaatgtaagcattgaaacatttctgttttaatcagtagtttgttaaaggggccaggcgtggtggctcacacctgtaatctcagcactttgggaggccgaggtgggtggatcaccttaggtcaggagtttgagaccagcctggccaacatggtgaaatcccatttgtactaacaatacaaaaaattagccaggcgtggtgcatgcctgtctgtaatcccagctactggggaggctgaggcaggagaatcatttgaacccgggaggcggaggttgcagggagccgagattgtgccattgcactccagcctgggtgacgagcgaaactccatctc

SEQ ID NO: 242937 - DNA, 460 bp, Homo sapiens
gatgtttccaaaacaactgccctctaaggtacaggctgaaggaggggcagaccaagccggccccagctgcaaccccaatgtaggctggagcagcgcagtgggacaggagggttcacagctgccagagctgggcagatgccctcagggaacaagcccctggggacgtcatcctccaagaggaagggccgggacgtcagtgttaggcggccctgggcaagattcttgtcttcctgggcatcctgggaaaacactgtctaaacgtttcaatcaactgtcattcactcccgtaaatcaatcagagaacaaactccagtgagagtacccggtttctaaatccttcaagagtatacggcatgtgaataggtgtttcctgtcttcctcaaacctcctaccccatcactcagataatgacataataaaattaacaaacctaagttggcattaggaagacggatgtgaa

SEQ ID NO: 242938 - DNA, 324 bp, Homo sapiens
aaaacaagctggggaagtgaatttcaatatcgcattaactaagatcaaagtgcaattcatcaaccttttttccccatcccgcaccctgtgctttctctactcagttactcactacaccctgctggactaaaagggtcctccagcattttctttcttacacagtgaaagacattctcttggcattaataaatgttcacttaataaataaaaagggccgggctctgtggttcctgcctgcaatcccagcagtttgggaggccaaggcaagaggatcgcttgagcctaggagttccagcctaggcaacgtggcgaaacccagtctca

SEQ ID NO: 242939 - DNA, 696 bp, Homo sapiens
ggaaataagagcagatgggctaaagaaggaatgggagatggagagtccagaccagatgctgaaatcataaggacagggcatagataataccaggacaattttctaccatgaacaaaaacatgtcagcatagccagagaagcagaggcctgaggccataacttcccaaaagggactctggagaaatccatccaggaccttcagtgaatcctccctactcttaaagatcccttattacctctcactatgaaagccatgggcactttggtgtctccactaatgcaacaatacagtgctggggtcatagtgattcttagtaagtgcttgcagtacgctcattgagcccaattcctgtatttgataactagatttttcccaattcagtgcagagggggggctcccactaaaatccaaaccagctaaacccaccacctttcacctactaggctgcaagtgccaaaggaatggaagaagattcaaaaccagacatggacaaaggtccagtagctccagggtggatgtctaagtccttgaagaatataaggaacagctcccgggctgtgttgaaagctccaattttattttaaaatgtgattaggagctggggaagctgatgctttttgaaacactcttgactccagcatctgtagcagctctgaattatttggcggcttaaattgcagcaggcaagttgaaca

SEQ ID NO: 242940 - DNA, 420 bp, Homo sapiens
tgactgaacacttggatatttgtttgggcctcacagtttttaaaggattctgataaaacagaaagtccagaaaagagcaatcagtatagttgaaagacctggttatgttttccagaaaaatgagaagacttgggattccaggtctgcacctgcttctcctctgattcttctttaccagctatccatatttactccatcctgatgagcttcagctaccactctcgaagtgtgattcttaaatctctatctgcagttcagaactcttctgaataccagaaaccataggtccaattgattgttgaccattgccatctggcattaaacaggacttcaagcataaatccaaaactgaactcatcagatttatcccaaagctctttttccccttgacaattagtcaaataaaaatataaaccacaa

SEQ ID NO: 242941 - DNA, 377 bp, Homo sapiens
atgtttctgttttccacactgtccagcaaataccatttatatgtggcattgaatgagatatgaaatgttttcagaagcatgctgaaaaagggcattcaaagttatcctttggataatgatgatctaaaactttcttttattatcccatgtgctcagagtaaggggcaaatgaatcagttgtgaaatatgtgttccttgtaggacacaggcactcttgagatctatagcttcaataaaaaggtaatttatttaaattactgcctctttaatttataatgttttggggatttttaataggcatgctctgtaagggcactggtaatcagctgtttctgattttgcatgctcttctatctctggtaacaaaataaaatctt

SEQ ID NO: 242942 - DNA, 725 bp, Homo sapiens
ctttatagcatgagaagaagctatgcaaagacattgtggtgaatggcagaactagtactagaatctcctcgaacagactattactctgcattaaatggggaaagcattatccattgtagaaatggccagctaactcattgccttttattcttatatgattcttcagtgcttcatgttgcaatccttgagtcaagctggagaaaaatgattgcaaattgtactggtgctgtaattaaaagggatttgtcctttgcaaaaccttaaatgataaatgataatgcatgaaggcattctaactagccaacattaaagaaaccatatttccagcaaaggtaaaatctgttagtaagtaggatagcatgaattcagaccttagcgtttgtgcaatttgtgtgtgatggcaaagttaatgccctattccaaagtgatggattttaatcatgaaatctgtaataattcaaatgtcttaattactttggttcttaaattgtccatatatggtttagaccagagttgaacaaactagcccatggatcaaatctgtttttgtatgcatgagctaagaattgtttttacatttttaaatggttaagaggctgggtgcagtggctcacgcctgtaatcccagcactttgggaggctgaggtgggctgattacttgaaccaaggagatcgagaccagcctgggcaacttggcgaaacctcatctctacaaaaaaaaaaaa

SEQ ID NO: 242943 - DNA, 528 bp, Homo sapiens
tatgaaatagatggtgatagtttatggtattcatactttaaaaaaattcttacttggcaatataaaaagctagcaattcaactctatgcaggcctcctacaattacaaaaaaatatacatttttttttcaccagttcgtgacattctgaagtcttataacctgttggtgaatcatactaaatcatcatcatcattactgccatcaccataatcaccattactattacctatatggtcctgtgctgagtgttcacaggtaacaaaatgtaaagatattgctctcctagtgcctatttaaaaaacaaaaaaaggctgggcacagtggctcacgcctgtaatcccagcactttgggaggccgaggtgggcggatcacctgaggtcaggagttcaagaacatgctgaccaacatggcgaaaccccttctctactaaaaatacagaattagctgggcatagtggcacatgcctgtaatctcagcttctcaggaggctgaggcaggagaatcgcttgaacctgggaggcggagg

SEQ ID NO: 242944 - DNA, 449 bp, Homo sapiens
tttaaaatgttttatatgttaaaagaaaattagttcataattctaagaaaaactagtaattagaagtaaattgttatgtttcgttttttaaaaagctgcatggccaaaaagtaattctaactgggcataattagtcccaggtttgatctttgcagaaaaaaagaaaaaagaaaggtaataaatttgctgtggatatgctactcagtttctttttggaaacaatataaaactatgaccataatctcaaatgtcctagtttaaaagttttgtttgtaatgtcatagaaattaatatgatgggccaggagcggtggctcacgcctgtaatcccagcacttttagaggctgaggtgggtggatcacctgaggtcaggagttcgagaccagtctggccaacctggtgaaaccctgtctctactaaaaataccctagaacttaaagtataattta

SEQ ID NO: 242945 - DNA, 435 bp, Homo sapiens
ccccgtgcccagtccccttcctgcccttgcttccagggaatgggccctattagccatgccctgagcaggacacacgtgcagccctagatctgtagacgcaagactcactccaaagatgggattctcagctcagggagggagggaggcagcccccagggcccaccggtggaaggaatgtgggggccttcgaatgacctgcaaaggtggctcctggccccatcctcacctgagccagatgtgtgaatacagacgcccgcccctggcagcagacagtgggaaggagacacagggggctgattcttgcaaagttgagtgtcatttcttggcttgctctgctcctgcgtatcaaagctgaccacagcctggtgctcattgagacctgtgtctcaagggtttcctagtttaccgaagagctggctccggtgggctgtaggg

SEQ ID NO: 242946 - DNA, 358 bp, Homo sapiens
atgacaggaatgtgaatggctttgcaactttacttcatcttctctacttacatagggtgcataccaagtaaatgactttataacttgactttattctcttcatttacatagggcatacaccaagtaaccaattgaaaacctccagagggtattgagacccagcaaattctgtaactgaggcccttgagctgcttgctcaggcccactcccatcctgtggagtgtgctttcattttcaataaatctctgcttttgttgcttcgttctttccttgctttatttgtgtgttttgtccaattctttgttcaaaatgccaaaaacctggacatcctcaactagtaacaccaccccagaggtta

SEQ ID NO: 242947 - DNA, 1170 bp, Homo sapiens
aggcccacccatggagcacatggacagatcagcatggacttcatcccctctgaagcccataaaaatcctggagtcagccgcaacttggggatacgacctgcctgtgggaaggagctacccactctggctctcgtcttggctgtgagctgcacacttgtacggatgacctgcctgtggaaaggagctgtcctttgtatgtctcctgggaactgttcaactgctcaatgaagctcctctctaccttgctcaccctccagttgtccgtgtactttgttcttcctggatacaggacaaaaactcaggacctgccaaatggcaggactaaaagagctgtaacagaaacagggctgaaacatgctccccaccacatcccgctcaccacatcgtaggcaatggggacagacgagttgtagcctttcatggagcacagacctaggggatccctgagccagggctgtgacaccctctgtggagttctatggttcttggcatctccaagcttccgaatgctactgcatttcccttgtccagatatggatgcctgcagcagaagctgtatgtagcacatctggtccagctgcagccttgcacagagccatcacctgtgttggcatctggagctgcctgccctctgcagcagctagcctgtctggctgtgcgcaatggctgggccccattctcactcatttacacacctctcaccactctgtgcctggctcgcccttggcaggtgtgggatctgggctggtaacaagacctgagcacagcctgctgggccgagtgggtggaacaagcccagtgggcatgagcaatacttaggcagaaggcgccaccagccacagaggtttccagctggtgaagtgacacctcaaggatcctgtgacacagagaaacagcagtcgaatctcactgggaacataaggaatgcttcagtgagtgactcctgccagagttagatttcgagaagcataggagatggttagacggagaggggttaatttcctagcaaagagtgctagcagtatatgaaaagtaggagaataggaaacaattctagaaacagtaggatgtgttgagaggtggaaaacaaggaccaatattgggagccacctaaaaatgggatgaattccctattaaccaagtgtgaaataaattcactttgaaatgaca

SEQ ID NO: 242948 - DNA, 440 bp, Homo sapiens
aaaaagagcaggacttcagcaactggagatgaccgtctggatagaccccatcttgcccacactctgcccacatcaaagactcttccttgcaagacactgaggactgtttggatcaggccaggagactccccttgtccaagtcactctccttggactatattgttaaccgctccttccctatccccttttctcttgatgttaaatgtactttgatgtggaatgtgtaatctataacatttatatattgattaagtatactaccatgtatggttggcagtattgactgacttgtggagtgacttgagcctgtatgcccacagctcttattaccaagtgaatggggaaaactaaggagaatttgcctccttgagaaccccatgtggcttgtggcttttatgactgaaatagcatcaataaaagcctgacgttgtagaaagaca

SEQ ID NO: 242949 - DNA, 465 bp, Homo sapiens
ctcttttgagatgtcttcttcctcatccctttagaacatggagctagatattccagggaaatcattaggcatagagactagagatagactactgattaagaaaagttttagagtcgatatttagtaaattatagataagtgacagatgttcattgagtattcagctatcaaggaacaaccagcatgccaggtattgtggctcactcctgtaatcccagcactttgggaggccgaggcaggaggatcacttgaagtcaggagttcgagaccaacctggccaacatggtgaaaccccgtctctactaaaaatagaaaaattacctgggcgtggtggtgcgcacctgtagtcccagctacttgggaagctgaggcaggagaatcacttgaacccgggaagtagaggttgcagtgagctgagattgtaccactgcactccagcctggtgacagagcatgactccatctc

SEQ ID NO: 242950 - DNA, 518 bp, Homo sapiens
gattaagatactttatgaatgaattggtttcactgttcccatgtgatgcagaattatagttgtggtttccagcgagatgactatgccgcagttattttcttgtgcttgtataatgagagggttttggtgtttctgctgtgttctagacagttacactatacagctcattttcatatcatatttcatacgcaacaccatattgtggtgagttttctgtaaaagtaggatcaagggacgaggaagtgggaggacaagacagtggaaggccagagttgatccaagccatggaattttggatggagtggatataggttagatttagagaaaaaagcgggtgtctgttggtttcttctatccttggaggagtaagtaatttgtacaggagttattacagaattgcagggagatttgtctactgggcaacacagaagttaagttgctttccttatttcccattttctagagactctgatactgcattatgagttggtaaaacagactaataaaacaagaaaatc

SEQ ID NO: 242951 - DNA, 314 bp, Homo sapiens
ttgtaaggtgcttggattaggttagggagaggtgtaaggtagtaagtgggtggaacttttccagttccaagtttgtaattcattccattccttttctaagttctttttcatttttaaaagctcagttaaagataatagccttctttcccattctaggctgtgtgtgagaaaaggtgttaatgtgtatgtatgtattttatatacctaacaatgcaatggatcatctttaaaatcaacttatactttataataaggacatttaaatagaccaagagtctacataattatgacacttaaaagtttagaatttttta

SEQ ID NO: 242952 - DNA, 421 bp, Homo sapiens
atttgctaatgtttaggattttaaaaatgttcattaattgtattagtctataatttttaaattttgtattgtctttgtcagatttgggtatcaacgttacgtttgttttataaaataaacttggctatttccttggttttctatgctttagaatatgtagtatcattgggattaactggtcattgagggttttatggaattcctctatgaaaccatctgggcctgatgtgtgtgtgttgtttttgataactttctctattttttctaatgaaaatttctctctcttatggggtcatttttggaaaactattattttccttagaaattatctatttcatctagatttttcaaatttatttgtatttaaaagtttgtaaagtagttgcttaccgtgattaaaattttgttgttgttttatgat

SEQ ID NO: 242953 - DNA, 400 bp, Homo sapiens
gaaagtgctttccatacttaaagaatgttctctttttgttttaaaaccacatacgaaattatgccacaatcactttgggattctagggcagaaagagttaattaaattgtaatcctaggctaggcgcagtggctcacgcctgtaatcccagcactttgggaggccgaggcaggcagatcacaaggtcaagagatcgagaccatcctggccaacatggtgaaaccccgtctctactgaaaatacaaaaattagctgggtgtggtggtgcccacctgtagtcccagctactcgggaggctgaggcaggagaatcgcttgaacccaggaggcagaggttgcagtgagccaagatcatgccactgcactccagcctggtgacagagcaagactctgtctcaaga

SEQ ID NO: 242954 - DNA, 356 bp, Homo sapiens
gtggctgtgcctatctcttgccaggcactgctgaaagaatgaaacagcaaaactcttgccttcagggaatttgcatctccactgtctctacccaaattctggttctcatcgtgtacattttcccagcagcctgctaacaaccacccgtctcttccctcctcatcctgcagccacagtgacctttccaaagcataaatctgatcatgtcactgcctgattgaggccctgaaacagctccctctggcccatgccagccgatctcaaatgacgctcagcagaaaacaggtgctctaagttgaaccaagctgggcatcactaatattaactaatgatggacttttcttggttgtcagaaa

SEQ ID NO: 242955 - DNA, 386 bp, Homo sapiens
aagatattttcactggttatagaattcagggttggcaatttcttacttttaccattgattgattgactgactgattgactgactgactgagacggagtctcactctgtcacccaggctggaagtgaaacgccatcataaaaaaaaaaaaaagaaagaaagaaagaaagaaagaaagaaaagaaaaagaaaaaaagatattttactctcttctggctctctaccatgttctgataagaagtgagcaattaatcatatcattgttcccctatatatggtgtgtaattttttcttgctgctttcatgattggttctttataatcttcggcttttcacagttttaccctctgatgtaactcagtgtagtcttccttgtgttcattctact

SEQ ID NO: 242956 - DNA, 360 bp, Homo sapiens
aatgggttcacttgttgtattaaaagtccccacctttcagtaaatggaatttgcattatgattcagagatgtgtgtctagaaaacatcttaaaggcttcggatgagtagctggcagagtgggtgagaagccaataaaaaacaaaggccccacagcctggtccatgcccatcggcctagctaactctcttaattcagttcttgtggatttctgctgttaggaatcaatagctaagtatcattgaattgcttttctagagaaagtgttatcatcatactatgcatctgtgtgggtcttcaagttaggttttggtcataaaagttttatggctttccggcaatgcacagtaaaccagtgataa

SEQ ID NO: 242957 - DNA, 247 bp, Homo sapiens
aaaagagagagagacagagaataacttgtgaactcttaattcttaatacaaattacatttggttgagagatcagtatatccgtatttccccatctaaagttcccatagccatcagtcaagggagggaggagaagaagcactttccagttcatcctggagggggtggagttcagacactgcttctaagagcagtcccccatctcttcactcaccctgctttattccccagccaccctcaccctcattt

SEQ ID NO: 242958 - DNA, 364 bp, Homo sapiens
attacaacagactgcatggccctcaaagtagaaaatactatctggctctttaaggcaaattgaggctgggcacggtggctcacgcctgtaatcccagcactttgggaggccaacgcaggcggatcacttgaggtcagggatttgagaccaggttgaccaacggggtgaagccctgtctctactaaaaatacaaaaaaaaaaaaaaaagctgggtgtggtggcagatgcctgtaatcccagctattcaggaggctgaggccggagaatggcttgaacccagtgggtggaggttgcagtgagcggagatcacaccacttcactccagcctgggtgaaagagtgagacttcatctcaaaaaaaaaaa

SEQ ID NO: 242959 - DNA, 594 bp, Homo sapiens
catagtaagcctttttcagcttcaaattgggtccgaaattagattggtgtgtagaatccaaagggtctcatcttaagcttccctaacatttaagggactcagaatggagattcatcccaaaccaaatggggtgtaaatatgagaagaccacatgtttataaaaacagaacatccaacaattcattcaaacacctgcagcctttatttttctgatacttaaggtgctgtgttatagagtgccctataatcctctaagttatgaaacaggtagaacaagtattgatccatccttgtagtcaatgatatatctatgttgttgctctgttgattagtgtccatgaaatcactttaaaacgtgatatctgaatgtttcaccaaatatcaatattttaaaggaagggttctttgtactaaaacttatagaagcaattaggtacacctcactacttacttctcctcttcccctaaatcttccatttgtagaatcatctagatggacactgcaccacagaactttctgcagtggtgggaatgttccatactgtcctaatacttgcaagggatggctactgagcactcaaaatgtgactagtg

SEQ ID NO: 242960 - DNA, 473 bp, Homo sapiens
cgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagccaaagc

SEQ ID NO: 242961 - DNA, 472 bp, Homo sapiens
tttccaggcgtcaggtggtgtgtggtccatggcagacttctctcggcagacacaaagggttgggtacgcctgcagtttcatgcaggtcaggcctgggtgcctaccactcacaggaggatgatttctctcttcttgttacctgcctgcattttcccatccccaggcatagaagataatatgttatgccccgactgtgctaagaggaataagaagatgatgaaaagattaatgacagtagagaagtagcagcaacctgtttgaatacaatgtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgc

SEQ ID NO: 242962 - DNA, 270 bp, Homo sapiens
atacgccgcccgccggctggcggctggggggggggccagccccccctctccttctgtgcggcgctggtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgc

SEQ ID NO: 242963 - DNA, 259 bp, Homo sapiens
  misc_feature (16)..(16): n is a, c, g, or t
atttacaatattattnatataatgaaatatattaataatattctctgtgtctttagtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgc

SEQ ID NO: 242964 - DNA, 250 bp, Homo sapiens
cgagagttcgtgtcccagatcgttatttatataattccttcctctagtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgc

SEQ ID NO: 242965 - DNA, 428 bp, Homo sapiens
taattactgccactgggtttgtcgtgagccatcgcacctggcgaacctacctatatctttctttgaatgtgctcagaccaagggtcttatcttaaaggaatatcagaccagagcaccagacctatggctgagaaacaccttttttaccccagcacacattttcccatccatccattcatccatctccaacaaataaccttacacagcttccccactctgaaaggtagataccatatctgtctactttatctccaaatcatagtccatagccagcagagcgtaaccaccaaaggaatatttgttcaataaataagtgaacagttataaaatgcccactatattggcatagtcatacatatatgatgaagcacagtccctgccttcttgatactcacagttgtttttcaggatagctttgtaccccatca

SEQ ID NO: 242966 - DNA, 470 bp, Homo sapiens
tcacatccaacaaagtgcagcctaagaataaagaacaggtctttaaaccgcatacctttaattaaggtgttcttattttttctgatttggctggaaacaggcagagaccaccccagataaccagttctcagccttgcgtgggacaccacgagtcccacgtgtttacgtgtttaaggcactggcaagcaggggaatttggtttctgggaatgtgctgtctttgtgaaaactgtgaaaagtcttccctgctacattgaaataatcataaaataataatagctaatgttgaacacttactatgtatcagacacatgctaagcattcaatatttctcatccagtttctgaatgaaaccttcgcaaaccacataatgtactggtactattagctacgaattacatataagaacacccgaaagttgttgtcatttgcccaaggtcacccagctaataaatattgaagagattcgaa

SEQ ID NO: 242967 - DNA, 188 bp, Homo sapiens
cattaatgtaatatgtccctaaccattttaactttttttttgtaaattttaaaaaaataaatagccaaattggtggcacacaccctgtaatcctagcactttgggaggccaagacaggtgtatcacctgagatcaggggttcaagaccagcctgattaacatagtaaaaccgcatctctactaaaaaa

SEQ ID NO: 242968 - DNA, 628 bp, Homo sapiens
agatgaatatccacaattatctttaaaagctattaaaatactctttgctttccaactacttatctgcatatcatcagattttctttatatatttcaaccaaaacaatatattgcaatcaattaaatatagcagataagtaagcttcttccatgaaagagatttacaaaatgtaaacaatattattattctaactaaactgatctttatctgaaaaatatttttcatagaaaatatgctatttaacacataggtttattattttaaaataaattaatgcataaatattaaattttttctcagttttaatttctggttcagtatatactgatagataaaatccatataaacaaaacctctttggggtctttgttaattactaagagtttaaaggggtccttagactaaaatgtttcagcacctctaatctactatactcccatctcatctctacccacatggataatttttagcatctagtcatattccttattttctaccctttacaacaacctttgtgaactcaatatccatattcatgatccatatgagactaagaccttggagttcttcctcctcctaaacttcattccttgacaattgcctaccaggaaagccatttctttcttt

SEQ ID NO: 242969 - DNA, 412 bp, Homo sapiens
gaagtacttttatgtggcttcagcaatggtggctcaacagatgagatggtttcaagagagattacagactggcaaccacccttgggtctgtctgttccttcctttttttccttttttatgaacatgggctgttacaatcaagtcaaacacatctcagcagctttgagtctttgggccctacctcccgaagggaggaccaaaggtcaccttctttgttcatctaacagatgagtaaaagatacactgcagcccccagatgatctctgcctcattccagaatcaggatcaactttgaaacaattaacaagttgtcgtctcttagtcctagaggacttggagtctaattcagttctactttagctttttccaaggtcgtgccctaactttatgcctgcagttcttcatcttaacc

SEQ ID NO: 242970 - DNA, 687 bp, Homo sapiens
aacaactaagaatcaaatatataaaaataaccagaaaaagaaaacaccaaaatggttattctcttagttcatgattttgaaatattttgaaattttcagattgaattttatcctcttaaggttcaagttgtatttacagccaacaaatctagatatccagatatcctggttctatcaaaaggggaaagcctcaaattcttttgaacatccaggatgtcttaataaactccatgtgacaatttaagagtaagggaataaaaatcaggcagatagaatttttaaaaaaatacacatgggttagaaaataaaggtagagagaggcttggcacagattgctttccattttgccaaggcctgaaacatttaggcaaaaaataaaataaaaatagttgaaactatatgccaagttccaaatatgatttgtcttttcaatatgtaaaaatactggagttaactttttctggaatgaactcgagcagttaacaatttcttaaatgagggaaaaaataaatataagaattacaatatgtttgtgctgactaatctttgactgggtctgacttaaagatcttgtattcttgaacttatgaacttaggtttgaggcagaacattagcagaggattcctcttactatttagtacactgtttacgtgtggagttaataaacagcaaacttacaaaaagag

SEQ ID NO: 242971 - DNA, 945 bp, Homo sapiens
tttaaagaaaaggccttctaggatgctgaatgcaccaaatgtaaaagaactataagtgtccctgggaatgaatgactcatgtacagcagtcttgaatggtctaactacttattcatagagcaatacagaaacaggactcacttgctcaatcatttctttggctataggccaaatgcctgtacaaccatttaaaaaaatcaatttcacaggctaacgggcatggtgggagccagagctatgcacactggactcagaacagaactgggcagcatcagctttataagctgatcagttcctactatcttgaagcaagaggtagctattgttgagtcactagacagctcatttaggtcagagttaaaatccatattcataaaactgcctaaattatacagagtctacagtattttcgggtttaattatctttgggctaataaaaagtaagatataaataaaatggggacatattaaaatagttttgtttttaaataaatcatgagattctctattcactttgtctcagcaactggagactaccaatacccttgatggaaatgctatgagctaaaggaaaacccaacagtcttagattatgtatcagatgtgcatcttgtggccccagtgtgttcatgccaagtcacatggtccgcctcgctcccccatccaccactggggtgggcacctgagtaaggggaacaactctatgagtaaccagaaacctacaccagtgttcctcaaactctaatgtgcaaacaaatcaccagggggttctgttaaaaggtaggctgggattcagtaggtctgcagtgtgacctgagaagctgcatttccaagaagatctcaggtgatgtccttgatactggtccccagtgtgcacttgaagtaacaaggatccagacatttagcctgacaggcatgaactgagagagaatgtaagaaggcgaa

SEQ ID NO: 242972 - DNA, 401 bp, Homo sapiens
tttaagatttgtgtttgagtgctgagtctttccctttttggggggatgactttggtcaaaaggtttggtcacttaagatttctgaagtttagttttctgatctgtaaaatgaaataataattcacagtcttataggaatgaaaagggaatgtatgaatagacaggagtttaattttgggataaattttactggttgtttcatcttcatcttgttaggctcttttaatttaggcagatgttagatgatcagatcaacttggaaaaacaatatttgagggaacatagaaaatgtcaagattcttaaaatgacttgtactatctattaagatgaagagtttccaaggcgaataaaaaaggctcatgaaacaacgagcagttatctttgaaccagagaggaaaac

SEQ ID NO: 242973 - DNA, 395 bp, Homo sapiens
catcagagctgtccactttgggctaaaatcatccaaccttatcccctcaatggatgtaggctgccacaggatgggcatgaccttgattgaagcagccctcagctgctaaagtgtggacagctatcttctgaccgcagtccccacagctagtgagcacactctcactgaaagggtatctaggccgtgtacttccatgcttactacacactcttttgccctggaacattgtaccattgtgccttatcttatttgctttttgattgttggacttatttgcattctataagtttcataagcaacttaataatttttgtcttattccatattgtgtgctcagtatacagcacaggcttgacacacagtgtgtactcaataaataataggttgaatacatg

SEQ ID NO: 242974 - DNA, 354 bp, Homo sapiens
gctttttattgtaaaatgggaaaaattaatacatttagtttccctaattaataataatttaatttccctttgctactcttcagttaaatcttcttttcttaagaattaattttcaggataaactttaaatgttctttataattttttcatttgttaacattagaatggtgtgatttcttctgatttttcattcggaaattcaatattctatgtagaggttaaataggattttgtaagtcagctctcctgagacttcatgtttgtaaaactgtctgtgtatcccacaaaactgatacaaacaaactcgcagcacaactcctgagatgtttgatgaataaaaaattaaaactgtat

SEQ ID NO: 242975 - DNA, 522 bp, Homo sapiens
gtgtgtctctgcctggtgtgccaggcatgtggccctgggtctgcgtgcatgcatatgtctgtcctccaatggacagggcgctaggatgcctctgagggcaagcagtgtcctcagtggaggatggacgcaacacagtagagatgccactcaaggccgtgctaggatggaagggtgctgcttattatcccactctttccccaagggtagtctcagctcctaatgcgcaatgtcatctggttttcagaagaaattgggattgattgtggcttttcctggggtatccccatgataacaagtcaccagtggctgtagacatcccaccctggctggtgaggaaatgggctgggcttctgcctctggctctgcccttggctgtgacctaggcaggtcatctggcctctctgagtacctcctctatcactaagattaactgaggtatgcagcagcccttaggactgtcaggggatcaaaggaaacccagtcacataacagtgggaatcataggacagaaaagaaagaaaa

SEQ ID NO: 242976 - DNA, 579 bp, Homo sapiens
ggaatctcaaaaaacgaacaaaaatttgtcaaactggcatattcttgggtcagtctagaatcctattgcaaggctttttctttctttaaatgggtagtttggaacaaaagcagaggcttggaggaaattgctgctatttggctctagttggttttattcagctgagttttagcttaaatttaccttacttggaataaaatatagaaatgttcagaaaacgttccccttatagattttatgaaatgtaaattcttcctttatattctctttgaattacatcctttggaaactcaagaatgtgctatggatctttgttaatctctttctcatttagtcatttttggctgagctctaccaaactttccaatgtgttactcagtttggggaattattctgattcttttggttaagaaatttaaggttaaaattgtcaatgtttgcctatttttttttttaaaaaaagaagttggcagcaaaagtcactaaactcccagattttgagtgaactgattaacatgtaatttcagtttttatggaaagaaatttggaatgttgtctacttcctcctaatttaggtgc

SEQ ID NO: 242977 - DNA, 304 bp, Homo sapiens
atctcctctgttttttttccctcttgccatcagaaaatattttgaaaagttaagggctttttatctttatgaaatgtgagcacagaagaagcaattctagtcaaaatatagtcctgactcgactgtttttatttttaaatattttcttatgcttttaattgtattcaaagaattactaggtttctagtttcttggtgctgagaagagatttgctaattcaatattgtcctcaaaaaaacaaagtgaatagaattttactacagaaagggatgccaattatatatacacaatttaaaattttttc

SEQ ID NO: 242978 - DNA, 631 bp, Homo sapiens
atataagatcatttttttgaatgttgtgtttgtcatatccttaagaacatcactgaaaatataactttataggcaatcagctaggtatgctctgccagtgtctccttaggcttctttctctagaggggtgagggtaatccttccctggggtagtggccagggaagacagtgtcagtctcttgtgggagtgaactggaaaccgtttgacctaggcgaggagctgaccctgggggcaagcctgtaccaattcccccatctccatccttgaatcaacctttgatcccggaacttgggatgaaataaacagataattgtctattttttttccttctcttacaccaaagttgaaaggaagtaagaatccagggtgagagcaagccatttgttttctcctatttttatacttcagcagtgggcaccctccctgaagactatgggaatagaccttactttaaggaaggtccctggaagttgttcatttcctgcataatagtccgttgattcttgcatttgctgcacttacgttctagttcattaaaagaatctaggctgttccttgggggactcatcaaaaacccacatttttatgttatttcagttttaattcagtttttaaaaatttatgcagaaa

SEQ ID NO: 242979 - DNA, 375 bp, Homo sapiens
ctgaggtggagggattgcatgaacccaggattttgagaccagcctgggcaacatgatgaaaccctgtctctaaaaaaaaaaaaataaatacaaaaattgggcgggcatggtggtctgctcgtttagtcccagcagctacatgggaggctgaagtgggaggatcgcttgaacccagaaggtgaaggttgcaatgaggtgcactccagcttggttgatagaatgagagaccctgtctcagaaaaaaaagacactgtctgatttacaggctgtattttgaggcaggaattaaatgcagtagtttttattataaatgtgtcagatatggtggctcacgcctgtaatcccagcactttgcgaggctgaggtgggcagatc

SEQ ID NO: 242980 - DNA, 751 bp, Homo sapiens
accctgacttctggagagggagagggatggagattgaattcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagttcgtgcctctcaacatccagcagaatgtgggaatatctatgccttgataggtcttcagttactcatggtgaaacatattgctgagttgagtaaatatttccttccataaaggtaaataagcatctcaagagcaagtttctacattttgtatttccctgttttatttctgtaaaattgtgcaaccaagaattatgacctactgatattagaataaaatttgcagaagtttgaaaaaaaaaaaacaacagaaaacagtaaaaaaaaaaaaagaaaaccagagataataaaagacaaaatttcctccgcaggaggatggacgcagcggaaaaagagggcgcagaagccacatagaaagggggggccacacgacaacacgtttttttgcacgccgttaagagggggaggggaacaccgcaaggtgggggagaccacgcggggaagaagactgcatggagaagtaatatcgcgcaaaattcccag

SEQ ID NO: 242981 - DNA, 453 bp, Homo sapiens
accctgacttctggagagggagagggatggagattgaattcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagttcgtgcctctcaacatccagcagaatgtgggaattctctgagttcctgttttggtgctaatcttcagtgtgtgtttctgaaagtaaccatgatgacaggaagcatatttttctgtatgcctatgactggtgtctgactaccctactggtactagagattaaaagacactttcctgtaattaa

SEQ ID NO: 242982 - DNA, 709 bp, Homo sapiens
accctgacttctggagagggagagggatggagattgaattcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagttcgtgcctctcaacatccagcagaatgtgggaatattgctgagttgagtaaatatttccttccataaaggtaaataagcatctcaagagcaagtttctacattttgtatttccctgttttatttctgtaaaattgtgcaaccaagaattatgacctactgatattagaataaaatttgcagaagtttgaaaaaaaaaaaacaacagaaaacagtaaaaaaaaaaaaagaaaaccagagataataaaagacaaaatttcctccgcaggaggatggacgcagcggaaaaagagggcgcagaagccacatagaaagggggggccacacgacaacacgtttttttgcacgccgttaagagggggaggggaacaccgcaaggtgggggagaccacgcggggaagaagactgcatggagaagtaatatcgcgcaaaattcccag

SEQ ID NO: 242983 - DNA, 1034 bp, Homo sapiens
accctgacttctggagagggagagggatggagattgaattcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagttcgtgcctctcaacatccagcagaatgtgggaatatctatgccttgataggtcttcagttactcatggtgaaacatgtaagccttgaaaaactttttgtatggagttgtgctgggaagcagttttcccaccagggacaacatcttctagtccttttacatctaagtagtaccatgagactggatcatgccaaagaaatgttttggaagtgagatgtttcactttggaaccaaggaactgaaaaaacagatagagggagcccaagccaagaagagaggtctggtatcaaagatttgctgaattcacaattgaagaggcttatgtcagtcccttagaaagaatttgaggactcctcggaaaattgctgagttgagtaaatatttccttccataaaggtaaataagcatctcaagagcaagtttctacattttgtatttccctgttttatttctgtaaaattgtgcaaccaagaattatgacctactgatattagaataaaatttgcagaagtttgaaaaaaaaaaaacaacagaaaacagtaaaaaaaaaaaaagaaaaccagagataataaaagacaaaatttcctccgcaggaggatggacgcagcggaaaaagagggcgcagaagccacatagaaagggggggccacacgacaacacgtttttttgcacgccgttaagagggggaggggaacaccgcaaggtgggggagaccacgcggggaagaagactgcatggagaagtaatatcgcgcaaaattcccag

SEQ ID NO: 242984 - DNA, 487 bp, Homo sapiens
tataaatgctttaatttctctttattaaaataaaagcaaatataaaaatatcacctagaagataatatagtacaataataattatgtggtaatctgaatctatacctccagctagcatcatcaaaatctaagatggaagctctgggaatgggtagggtgaaggaatgggtggaaacagtatgagtggaaatgagggctgggatggatttcaaggcatctgacttggactactaatcatttgaaactggggtttgtttatgccctgaaaatgaaatgttattagtcaagtgaggatgattattattttaggtaatgctattccttaaaatatttagctaagtgacttcatggcttttaggcaattacataatttctgcattttgtttgtttttgagcctggttgtctctgagttcctgttttggtgctaatcttcagtgtgtgtttctgaaagtaaccatgatgacaggaagcatatttttctgtatg

SEQ ID NO: 242985 - DNA, 441 bp, Homo sapiens
acctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttttgctacctctgaattcattatgttgcctgtacaagtagaacacatagcaggaactgtgttttaatactaattacaattattttttggttacatagataaatgtaaataacattaaagatgtgatttgttcctggacgccatttttattttttttgtcaaaaggagggaaaaagaatggcatcaaaataccaaggttttgtttttttttttcctta

SEQ ID NO: 242986 - DNA, 434 bp, Homo sapiens
ttaacaggggttcttgctctgtcacgcaggctggagtgcagtggcatgatcgtagcttgctgtagcctagaactcttggcttcaagtgatcctcccacctcaacctcctgggtagctgggattatagatgggagccacatttttttctattattctgcttccctgtcctgccttacagaaaagtagctgtggaatgactaatatcctctttgctctcttcgtttctgctttcttcagccgtcctctgcctacaaagctaactccttctgctcagctcatcagaacacttattatattttatggaatgaagtgttgcccaattctagaactacaatacagccaactgagctatttaaactgtttgttgtaattttgtctgttgacaacataaaatagatcctttacacaatatgttcatgttgacttgaaaatct

SEQ ID NO: 242987 - DNA, 1734 bp, Homo sapiens
aaaaagaaagtgagctaccaagaaaatatgaggcaaagtgaaggaaaagctcgagtcaaaggaatcccaagtctcaccaggtgatcctttaaaaattggcactacttataaaaaacacaaagtgttgccattctcaccccacgcttaagatcaaggagggtggcacattctctctctccctcaagtcaaaaagaacaggcacattctgtctttcccaatctttttctttctgtcatcatcttggaacttatcaaaggtggccaaagtgcatccactctttagaaatagccaaagagctataccaaagacatctttatgtcaggtctgcttgaagtttcaagtctttaagagttgggaagagtaagaattcctttggaccatggtgtctgtcctacagccaggtgaaaactctccagactcataccatgaaggtatgcatccaaataataacaatgtaatgaaattcacttttaaaaaggttagacatagaaaaagaaaatcttaaattatcagtatctttaccagattacaaaggtcatgttttttggttcaatagtttgtattaatgcagactaatatcagttagtaaattttgactagttttcttataagcatgataaaatgtccttacaggctttgtacatcagagcagaaataaaaagtaccattttgagattagacactttcctccaaagaatgtgggaatgcctgtttgtaaatcattttaatgtaaatgaattccaccaaaatacagcaaatgttaacataattacagtgtctacaaaggaaaatcaccctatcagaattatttaagtgtaaaggcattttaaagtcttgtagttcaagaatgagatataatcaatttatactacatagaacgtcttcagtctgaccaaatgaatcctgaaacctcacctgcagtagtaacactcacctagttgccttaactgaattccagaaagtcccttatggcttaatacaatttgatcaattactacatttaaaagactcaagcatcagtaaaagtaaccatgagttgattatattaagtctcttccaaataagaatatattcttctttgttttttttaaagagtgatatgatagaacatagttccaaggcattctaaaaggaatgtcttttggggaagcaacaaacaaaaaatatgctttttgtttcttgcaatgtataaaacaagcactgacttttatgcatgaagacaactgctttcctttggaaaaaaaaaaaaggaaaaccacaacaacaacaataactataatctttggtaaaaattcatctctttggggaaaaaatttgggaaagaatgggtaatccatatgtaatagatgcaaatcacttacctttacaaaacagctgatcttctggaatcagccttatgaagacatctgcactgtttttatttgttctgaccataaacttgctttctaaatgtcagtaaaagccttctaacttaatgaggatttggaaggcaatttccattttatggcctcaatctcagaagagatgtaaatttcatacctgaaccctaagtaaatatcttttctccatttggcacacaaaaatgtgagagctcaatatgtagtatttgttcctgtattaacagaatgcaattcaaaacagcatattcagtaatgaacccttaatgctaagtaaaaagaaaaaaataatatagtgatctggggtcaattatgggaatccgtattgggagttgtt

SEQ ID NO: 242988 - DNA, 492 bp, Homo sapiens
agtcttttcttttgcttttctttggggttgttgtgtatgcaagagttcatgtttcctaattcacatttagcaaccagtgtgtttcttgtagtccttagaaataagttcacagaaatcaccatgacattcttggctcttgaaaattcttcagttttctaatgcattcacacttataaaacttttttactgaaaagaaaaaacagaataaaaaacaaaaaaacctaacacacatgcttattattttgttttcagtttttgcatgtgcaaagttctatttttaaatgtaacttatttcaatatggtcttgtcctgtccttggatttaatttagtagactttgtctttgaatgaattttcttatgaaaatgtggcaattttattgtatgtatgtacaaaatctgttctttaaaatgggaatagttttatatagaaatgaaatatcaagaaatctaattcttgactatgatgaaggatttttgtataaaaaaaaaaa

SEQ ID NO: 242989 - DNA, 374 bp, Homo sapiens
cattgtgttacaattgcctacagtgttcagcacagtacctgctgtacaggtctgtagcctgggagcaataggctattccgtacagcctcagtgtgtagtaggctctgccatctaggtttgtgtaagttcagtctacgatgttcacacaaagaggaaattgcctaatgacgcctttctcagaacgcgtccgtattaagtgacgtatgactgtatatagatatacacatctatccgcatatgtgtgactgctatgtgtgtgatgatttgtgagtctgtgtgcatccatatgtctgaacataggcacacgtgtgtagatatgtctttgtccatgtttctctacttcagtgtttgcatgccacgcggatgctgagttc

SEQ ID NO: 242990 - DNA, 704 bp, Homo sapiens
ccaggtggaatggcacgtccattaaatctctttttctttgcaatttacccagtctctgatacatctttatcagcagcatgaaaatggtctaacacaggtctctccccaaaaatatagagagctggaggtttttcttagagatatgaataaagggtgtgagtgtgagtgtatgtgcaaaaatatggataaaaccttgaaagtgctgaatggcctgtagcaagaagtgatgtcttctcatagatgggtggcaggggctggtggccgggagagagagcagtgggacttgggagcactttttgtgggtatgtaatggagattccaccagcaacaagctaaaccactcacaagcgggcccagaggaagtaaatagaacactgtggttgaaccatccttggccttctgcagcaaggatctgcaacctggaaggggcacagaaacaaccaaagatgaaggctctcagagctgaggagaggccaggtcagaatatcagaagtcaagaaactgcagcacctctaacacaggggaggctatgaagttcatggttctggatgtctgctccctgggttcaaaccttggtcctgccacattagttgtgcaacttggaaagttacttggcttttttgtatctcagttttctcttctgttaaatggcactaataataaatgtctcacatgtccattgtgagaattaaatgaaaaaatat

SEQ ID NO: 242991 - DNA, 505 bp, Homo sapiens
gtatccacaatagcatatgataaacaaataaattgttttgggagtggttatatgattgagttgagatttttttttttattccatgtttgacttagggggagaaagtagacattcccaaagtatatcctgcattagaggtagaaaacaacccagaagtatgcagggtgagtagaaggatatgtaaacatttccttccaataatcaaaaaaatagataatatacatgagattaagagactattacaaaatctttgaacctggaatgagtagaagtagtaagaggtacaggtgggggaggtaggattggtagattaagacattgggattccagtaaatatgtatgaaattgctgttcctggagatttgggaatgaatgagctatgtagctgtgtacatctaggaagggacagacacttttcttttgctgttatttttgagagaccatctggtggaaggtacaactaagggaccccctttagggtattttcttgaaggcttgagttgaa

SEQ ID NO: 242992 - DNA, 159 bp, Homo sapiens
aggaggtgagctcaggaggcaatgcttgctcgccactcacctcctgccacggactggtactggtccatggcctgggggttggggacccctgtagcaggtactatgacaggaatctaaaaagaaaaagacctaaaattttggagccaaacagctctgtgg

SEQ ID NO: 242993 - DNA, 430 bp, Homo sapiens
ctctctccataattctttcttttctgctcataatcaccactctgttttccatctctataattttgtcattttgtgaagctacatgaatcgaataatatagtatgtgaaattttgaggttttttttatattacttaacataatacccttgagatccatccaagttattgtatatagcaataatttttccttgattgctgtgattaccttttgttgcattgtagctgaagagttttacatttaaattgttgcaatatccactcaataatggactgaaatgaaaaccgattgaactgtgcacatgcattgtgaaaacagtagataagaaaacacaattggaataactacactttcttcaaatctaatgacaaaatctagaaggaatgaatagcttccctaatgctataatctgagtctgaaaacttccttcct

SEQ ID NO: 242994 - DNA, 477 bp, Homo sapiens
cagccaggtgtggtggttcacactgaaatcccagcattatgggaggcagaggcaggcggatcacgaggtcaggagatcgagaccatcctggccaacgtggtgaaaccccatctctactaaaaatacaaaattagccagacatggtggtgcacacctgtaatcccagctactcgggaggctgaggcaggagaatcacttgaacctgggaagcggaggttgcagtgagctgagatcgcgccactgcactccagcctggtgacagagagagactccatctcaaaaaaaaaaaaaaataaaacaacaacaacaaaacacacacaaaaccaaagaaacgtcaaaggggaaatgctacctgaatgagcaaggtcaaagcacagagtgtggcagaaacacacagggacactcaaccctattcactcatttgacagacaacgtctgatcaaatttaagggattttcctattaagaaaaaagcatc

SEQ ID NO: 242995 - DNA, 412 bp, Homo sapiens
gaggaaagacagagagcaacaatgatttttttttttctgattaaagaaaggctcagtagatttcaaatacacaaacagcacattttcgtataacttttccccttaaaaaccaatatctatgctatctgaggagagacagatcaaaagtaaggaacttggaagggcatttgcctgctaatttgctccctgacagacttctcttgacagagatcaaaagctgaaaggaaaccgcctgctaaagcttttgatagataacggtccagagactctgtaggattctcattttttctctacatataaggcttccacctgtctgaagtggaagttttcttctcaagtgtgaagatatgatcaagcttatattaattgccaatagacaaatctaatgtccaataaaaagttacctgtaagt

SEQ ID NO: 242996 - DNA, 846 bp, Homo sapiens
actagagtaatgcttgcaaggaccttgtctgtttcacatgctggttgttccatggtggcagaagtgggatctgatgttctacatcttgcataactaaaaaggtagcatgcactaaacttggaaagatcttaaatctgtaccctgaaaattatcccacattcgtggaaaaattagtatgcctattagtattgtcaccatgcaagaactgcactggcaatgaagacagtgatgtaagaagacagaagtgagtccagacacaggatccattgtctaagcaactgatgggagaaatggcttcgtgactgtcctgaggcaatggtggtgaggcaggaattaaacacctcccagggatgaaatggtgtcaccttgtattgtgtttcaccttaattatctccatgagaacttcacacatgtattaaaaaaacccaacatgacacattcgtaaggtagttactatctgttgcagaatttcatgtattatatttgtgccctaagttagccattattatcccaattttatagttaagggaatggaaactcaaaaaacatatggcttgcttacagagctacacaacttgtgggagaggagctgggattgggactccaattttgggactctgtgttcatcatgttttttggtcccccatgttccccttctttaaatgactgagtacatgtcatttcaaaaacttgtggccttgggcaatggcaggcagaataggaagtaaatatgtctcattttccctttgtgatttctctatggttccataaagaaataaacacatttaaaaggttagccatttgcctttgcctgagtaaagtataaagttttttaaaaaagcattt

SEQ ID NO: 242997 - DNA, 316 bp, Homo sapiens
ttattaaacaaagctacatgtttggcattttggagggatgggttcaaagacatggcccttacccttatagaattaaaatttagtgagagagactgactgttactgtgtataaaaggcatgcagtagttaagtgcccaaggtgagatgtaagtaaagagagtaccataggcatcactaaacatcactggagattcactgttaaatcccagtaatagcgagataattgttcctttttcctttaataataacttgcttttttcttgaattgattttagtaatctgtatttttaattttatatctctggatattagctga

SEQ ID NO: 242998 - DNA, 961 bp, Homo sapiens
tagagtgtacagggagatgtgggtagataacatgcaaatatgtaattttataaaagaaacttggcatgtgtggatttaggtatgatcagggactgctggaattaatcccctgcatatgtcaggggaaaactgtatttgaaataaactgaaatcacttaagccttcaccacatggtttacattcatagagtttatttctttttctttttttttattttttttgagatggagtctcactctgttgccaggctggagtgcagtggcgccatctcagctcactgcaatctccgtctcctgtgttcgagccattcccctgcctcagcctccagagtagctgggactacaggtgcgcaccaccatgcctggctaagtttttgtattttagtagagacagggtttcaccatgttggccaggatggtcttgatctcctgacctcgtgatccgcccacctcggcctcccaaagtgttagggattataggcatgagccaccgtgcccaagccatagagtttatttccaatgtgatttgtttaattttctcaggtaaaataaaattaatgaatgctttcccacattccacacatttatagagtatctttccaatgagtccttttgtgtctgtgcaaggagctgagagaactcaatgcttttccacattccttacattcacatagcttctttgcggtatgagttctttcatgtccttgaaggaaacgggaatgagtgaaggctttaccacattgtttaccttcataaggtttctctcgagtgtgaattctttcatgttgtagaaggcaagtgagccaagagaatgctttcctgcattccttacattcatacggcttctctccagtgtgaatcctttcatgttgctttaagtgaccaaaatgactgaaggcttttctacatgtttgacactcataaggtttttctgctgtatgatttttttatgaagagaaagg

SEQ ID NO: 242999 - DNA, 450 bp, Homo sapiens
gtgcagtgggcagaataataattcccccaaagatatccatgtcctagtacccagaacctgtgatatgttacattacaaaaggaaattaaagttgcagatgaaattaaggtagctagtcagcaagccttaaaataagaatattatccaggattatctggatgggcccagtataatcatgtgggtgtttaaaagcaaacaggaaagcagaagagtgggtcagagagagaggcaacaagagaaagagggcgagagatttgaagcatgagaagaactcaacctaccattgctggctgaagacaaaagaaggggccatgagccaaaaaatgtgggtagcctctagaagaagggtgtccagtcttttggctttccggggccacattggaagaattgtcttgggtcacacataaactacatgaacactaacaatagctgatgagcttaaatttaaaa

SEQ ID NO: 243000 - DNA, 394 bp, Homo sapiens
aagtggggaacatcctgtaagggaggtctaagtatggaacccattttacaggtgaggaaattggggctcagagatactgagaacttacccaaagtcacagtgaatatgcggcagagctgggttggagcctgggctccctctgccagtgaccctgcttctgtgaggagagaagagcactctcaagacctcagaagactcctgggcagaggagacaaatcccatcagcttctaaaggaatgaaggcagggtgcagtggctcacatctgcaatcccagcactttgggagctgggagtctgaggcaagaggatcgcttgagcccaggagttcaagaccagcctgagcaacatagtgagacttcatctttacaaaaaaacaaaaaccaaacaaacaaac

SEQ ID NO: 243001 - DNA, 414 bp, Homo sapiens
actacagctcatttagaaccaaagggagtggcacaaatcacctgttttcctaattctcccatttccagttataaagtaagacattctcataacctggagttttttcttcaggaagcatgtaatattggtggcgtctctttgtcatactttgaatttactagctcctagtttcagttggttcttcaacaagggaattaaaagggtcagatagggtagcattttccaggcaaaaagacacagtataggcaccatagcagtttgctacatactgtcctaagtcctcttagggtgtcggccttttgttctcatctaaagaagtttgcgcttgaacctaggaggcggaggttgcagtgaaccaagatctcaccactgcattccagcctgggggatagagccagactctgtctcaaacaa

SEQ ID NO: 243002 - DNA, 403 bp, Homo sapiens
tctttttctatggtctagaatgatttgattttaaaaacattgaaccaggtgtagtggcttagtctgtaatcccagctatttgggaagctgaggcagaaggatcaattgagtccaaaagttaaagaccagactgggcaacacagcacaaccccatctctaaaaaatatttttgttggatttatttctagatattttacattttgtgttattgtatccccttaaaattaggttttgtatctgtcttgtgttaatagaaatgcaatcgacttttgcctgttgattttatgtctagcaatcctgcaaaatttttaattttcttataatttgtagcagactctttgagttacccatgtagagaattattgaatttataaagtatgacaattttattttttcctgagta

SEQ ID NO: 243003 - DNA, 689 bp, Homo sapiens
ctaaataaatgaaaatcttaacattttcccaaaaataagtaatttttaatactcatgtaaactaaaaataatacacactccttcccaaatgaaatttaaatatgtaattttctggagttactgtagtaatagtttatgatatgaataatctccccttccattaatactttttttattatatgagttagtttcttacatggttttccatagtcacatttgttaaagagtccagttgatgggcaaattagcaatcttatcctgggatgcatgaagactttccaaggaaaacgcagacaaggaacattctatccacaaatagcagaatacagtgttttcaaatgttcatggaaaatacaccaagacagaccatagtctgaaccactaagaaatctgaaaattttttttaaatttgaaacatatagagtatgttctctcaccaccatggaatcaaactagatatccataatggaaagaaaataggaaaatctctggacacttgaaaagtgaacagtatgtttctaaatagtggttcaaagaaataaaaatacattgaatggaagtacaacatatcaaaattctgagattcagctaaagtattactcagatggaaacttacagtactacatgcttatactggagaagaggaaaagtctaaaattgatcatctaaaatcctgtctcaaaaaaaaa

SEQ ID NO: 243004 - DNA, 591 bp, Homo sapiens
ctactactactaaattcgcggcccgtcgacatagtttatgatatgaataatctccccttccattaatactttttttattatatgagttagtttcttacatggttttccatagtcacatttgttaaagagtccagttgatgggcaaattagcaatcttatcctgggatgcatgaagactttccaaggaaaacgcagacaaggaacattctatccacaaatagcagaatacagtgttttcaaatgttcatggaaaatacaccaagacagaccatagtctgaaccactaagaaatctgaaaattttttttaaatttgaaacatatagagtatgttctctcaccaccatggaatcaaactagatatccataatggaaagaaaataggaaaatctctggacacttgaaaagtgaacagtatgtttctaaatagtggttcaaagaaataaaaatacattgaatggaagtacaacatatcaaaattctgagattcagctaaagtattactcagatggaaacttacagtactacatgcttatactggagaagaggaaaagtctaaaattgatcatctaaaatcctgtctcaaaaaaaaa

SEQ ID NO: 243005 - DNA, 249 bp, Homo sapiens
cccctttgggggtgggtgcaggtcttttcagggtcttgggctttctaactgtggtgtgtagttggcgggtttccttattctgcgggcacaaaggtgggcgtagggccgtggcttatgagcttttctccctgcagaaatgggtgaaatctgaaaaaaaattatagatatgtttacgtgttagctccaaagaagaaaataaatatgagaattgatattagtacatgtttaataaaaagtcctctgaccctc

SEQ ID NO: 243006 - DNA, 127 bp, Homo sapiens
gaagtggtctgccatctaacatgtctcaattgacattgaaattgataaaaagaaaataatccaggccaattggttcgtatttggatatattctagaaacaacagtgtgacaccttctcccactttct

SEQ ID NO: 243007 - DNA, 398 bp, Homo sapiens
tgccatttaacgtgatccttggaaaggtatttttataataactttagtttttaaatcaaatatttagaatgtcatggagaaagaacaatgatattacaaatgccatcataaaggaaccttagggagactattttaaagaaattttgaatctaaatatttaaagcttttcttattttataagtattttatgtatttgattggtaaggtaaagcacatacgtattgttaggtaaactcgacttaaaggaaataatacttttaaatggctacttaagatttcaaattttataaaaatatttaggaaaagtatttttccactttctaataagcagaaatagtttgcattacattttttcatttcagaactaaacagtgctattattcactacattaagccta

SEQ ID NO: 243008 - DNA, 489 bp, Homo sapiens
tgcagatggaataagtttgctaattagctgaactcaagataagaaaattatttggttgggcccaatataaccacaaatatcctaaaaaataaaaagaggaggtcagaaggatgtgatgtgagaaagactcagtctattgttgctgggtttgaagatggaagaaaggggccaggagccgaggaatgtaggtggcctctagaagtgagaaaaagcgaaggaacagcttatttcctggaggtcccagaaaggaatacagccctgctgataccttgattttagccaactaagacaagtattaggcttctaactgccaggaaatgctccgggcttagctcacacacccttttctttcataaagttcacaccattccaaccagctggaaatgaccaaccctctttgggacttaccacattgtagctaactcatggcccttatcactttccttttggtcacttgtgttctttgcttgattgtgtaaagtggaattt

SEQ ID NO: 243009 - DNA, 437 bp, Homo sapiens
gcgacactaaccaacccagtacagctgttaaagttctcaagaagtagacaaacgaagagttgacaaataaatgtagtacaagtggattcaaatttagttcagttttatctgagtgttcatagacattcggagtatccctttaaaggatgggtaggggccgggcgtggtggctcacgcctgtagtcccagccccttgggaggccgaggtgggcggatcagctgaggtcaggagtttgagcccagcctggccaacatggcgagactccgcctctactaaaaatacaaaaattagccgggcgtggtgacaggtgcctgtagttccagctacttgggaggctgaggcaggagaatcgcttgatcacaggaggtggaggttgcagtgagctgagatggcaccgttgcactccaacctgggtgacgagcgaaaatccatctca

SEQ ID NO: 243010 - DNA, 335 bp, Homo sapiens
aaatattccagtattgatgatttctaggatttctacatcatttaccaaattttttctctcctggtggttttccagctcagtcagttctaaataatttatcaacagattttgcaaaggctccactccacttcttatcagttctaggacctgagggtattcttacctatcagtggagatatattattccctttaaagataagggatatgttgtgcagaaagaatggtgaataataagtaaaaatattcctatggattataggagcctataatatatattattttgaaagaatgcctaaatgctgaaaattacgacttactgcactaatcatcatgcc

SEQ ID NO: 243011 - DNA, 455 bp, Homo sapiens
acttttataaatatcttttcattgtactctttgttaacattctccagagattgcaattctaggtctttttgtttgaagggacagtttaactttcaaggactcccatgaacttgtgcgttcctcagatttagtgtactcaagtatccctaatctgaacatccaaaattcaaaatgctctaaaagctttttgagcaccaacatgatgctcaaatgaaatgtccatcggagcattttggatttccaaattagcggtgctcaactggtatatattctgcaaatattccaaaatccaaacaaatctaaaatctgaaacatttctggtcccatatgttttggataagggatattcaaactgtttttgtgttgtaatgaaacaaacattggtgctatactttgattttttttcaatctttttaaaacatggatttataataaaaatatttttacttggctgt

SEQ ID NO: 243012 - DNA, 1147 bp, Homo sapiens
cgaggcaggtagatcacttgaggtcaggagttcgagactagcctggctaacatggggaaaccccatctctactaaaaatacaaaaattagctgggtgtggtggcacacgcttgtaatcccagctactcgggaggctgaggcagaagaattgcttgaacccaggaggcagaggttgcagtgagccaagatcccgccactgcactccagcctgggtgacagagagagactccatctcaagaaaagaaaaaaagaattcttatagctcttctatcctaagcattattcaagatacagagtacatactgaacaaatccaagttgacctatggaaagggatttaggttaagtatgaaggagaactatgtaactacaaattttcacaaacagtggaacaaattattttaagtttttttctcttattaagcagtggttcttaacctttgtgagagttgcataagccctttgagtatctgatacaagacaatggttttgttcttctcctgcagaataatgtgtatgtttgcatgtacatatggttctccatatacataaaagggcttgatgaaccccctaaaaactggttaagaaccttgcagtggaatttgcaggctagtatctgcaagagtgccaggcataaaaccacctgcagtctcagggctaaaaggatgagattttctcaaatcttgattattttgaatgtttaggcttaaataactaatcatctagagttccacagatgcctaaactatgaagtttttataaaactagagtttgactgaatcttcaactagacagactcaactttcccagaataattttattataatcaaaccatgttgaaggttctaaattttatttaacattagatatcttaaaacttgtagaatcctaaatggcctataaactataatccaaatgaaaggcatattacaaatattgctagctaaaaattaataattttttagtggcagttattttgtgctttttttcccccacatttaaacagtagactttatcttaagtggcctggtatcttctgttttgaaagtcttctaattaaaattctttggtccttgatgtctgtcagcattttttaactaaaggtcacaacccattaacaaccatgaaattggtgttgggaagaaaaa

SEQ ID NO: 243013 - DNA, 387 bp, Homo sapiens
taatttttgtattttgagtagaggcagggtttcgccatgttgtccaggctggtctcgaacttctgacctcaaatgatccgcccacctcggcctcccaaagtgctgggattacaggcatgagccatcatgcccggcctcaactgattttaaaatagagagagtatgctggattatccagatggattcaatgtaatcacagggtccttaaaagtggaagaaggaggcagaaaagaattaatagtagcagccacaagagaaggacttggctcgactttgacgaccttgaagacagaggaaggggccaggagccgagtaatgtaggtggcctcgaggaactggaaatggtatagaaatgaattctcctctagagcctccgcaaaaaactag

SEQ ID NO: 243014 - DNA, 512 bp, Homo sapiens
agcaaacagtggattccttccttagctagtataccactttttgcattcttttattttcaacagatagtaattttgcagctttttacttcttcaaccaaaccttctaagtaactttgctttccattaacaacaaagccgctcattaaggtggaagttctgtgcttgatcttaacaccggaaggagaggagtctatttaccagctaatgtaagtacttcttattagacagtcctagattttctaggagatttgaagagtctgctgacagtggccagcaaatcagaggaaaatcatttctgtagctaggttcttttttcatggatgtcctttaagaggaagctctgccgtggcgatgtgcgttccttcctggcgggtggcctccagtagctggccttctgttggtccggttccagcgtattttattaagtgaaaaatcctgtagaacagatggcacttacaagtttctgcccatgtagcactctgtttaatgaaatactatagttttgcttcatt

SEQ ID NO: 243015 - DNA, 401 bp, Homo sapiens
atgactaagagtttctgttgtgctgcatcctcaaatatcagcatttgatgtcagatgtttggattttagccattttaataggtttgtgctatctcattgttgtactaatttgcaattttaaaatacaaaaggttttaaacatttttttaatatccttatctgtacatctcctttggtgaagtgtctgttcagatattttgcctgtttttaaattgggttgtttgttttattattgtggaaaattcaccgttctttgtatattttgaaaataaggcccctatcaaatatgcattttaccataattttatcccagtctatggcttgtcttttcattctctttacattgatatttacagagaagaatgtttaaatttttaataataaagttcaacttatcaatt

SEQ ID NO: 243016 - DNA, 474 bp, Homo sapiens
tgtatagcccttgcttttgttaaacccacagaaactacagggggcaactaggaagtgcagggtggtatcttgaacaaatgagattctgagtcgatggacccaaatctagtcccatatctgctttggtttctgtgacattggggaagctatataaccttactgaactttacagatttcctcatttgtaaaatagggctaataataattttctcaaaggcattttggtttgtttaaatgaggtaatccaggtacgcaacagtttcttttgagagaaaatatttttctttaaaaaattttttttttactttaagtaccaggatacatgtacagaatgtgtaggtttgttacatggcacgtttatacctatataacaaacctgcaagttctgcacatgtatctcagaacttaaagtataataatttaaaaaaagaaaaaatgtaaaaaaaaagaaattaaaaagagttggagcataga

SEQ ID NO: 243017 - DNA, 477 bp, Homo sapiens
tgtatagcccttgcttttgttaaacccacagaaactacagggggcaactaggaagtgcagggtggtatcttgaacaaatgagattctgagtcgatggacccaaatctagtcccatatctgctttggtttctgtgacattggggaagctatataaccttactgaactttacagatttcctcatttgtaaaatagggctaataataattttctcaaaggcattttggtttgtttaaatgaggtaatccaggtacgcaacagtttcttttgagagaaaatatttttctttaaaaaattttttttttactttaagtaccaggatacatgtacagaatgtgtaggtttgttacataggtatacgtgtgccatggtggtttcctgcacctatcaacctgtcatctaggttttaagccccacatgcattagctgtttgtcctgatgctctctctccccttgcccctgcccagtgtgtgttgttc

SEQ ID NO: 243018 - DNA, 806 bp, Homo sapiens
ggggccttctttcgccagtaatgtcagaaaggacaaaggaaacactctcaagttcaaacctaaggcttgggccagagttttaaaactgggttggaaaaaaaacactgctgttgtttcttctatttttcctgatttgctgctgttcagtctcttattctagagaacttgcattgtcaaaatgaagccttggctccaagcaggaggtagagtgataaaagcacatcttctagaaagagatttgtagatgctgaacagataaatccttcctcaaaatgggcctttttgactatagttctcatttctgcacttatattctcatcgcttcttcaaaggattgtaaatcctctttttttcccaaagggatgtttcacattctttaaagtgtgtgtaaatgtttctcttaaggacttgttttttaatttttattattattggctttctaaatatattgcaatatcttacagatattgtattaatcacagctaagtaactggcaagttacttgcaagccggtaggcaatagctaagtttttcaccttaatttagttagtcataatcatgttattgatgtgccccacagtgatcactgagccaacagtcgattgctgagataccatttctgtttctaagtgcagttatccttcgctctgatttatccactgtaagtctgtcccctgtgtctgatgggcaatgaaataatatagaataatcatatcatatttcacttactgagagtttactatatgccagacattgcactaagcccttcacatatattttcatttgttcctcatttaaaaaaaaaa

SEQ ID NO: 243019 - DNA, 336 bp, Homo sapiens
tcccctgcatagcttggcctacatttcttgtttcttgcttaaatttcctgacaaagtgatgttaaaaatagagacaaattactaaataaatacatgcatatgcgtcatctaaggatacacagcaattttcagatatagcccatattaggatttcaaaagcagttgattataaaattgacttgcaacaataaaagctcaactataggatacgtcaataacacagacttgtcttgtcaatgtttaagatgactacttccaatttaacctccttcccattattgaactgtagcagtcaccatcccatagtcccatttttcaatcactgacttttatatg

SEQ ID NO: 243020 - DNA, 593 bp, Homo sapiens
actctttttataaggattccagtcgtattggattaagggcctgccctactccaatgtgacctcatcttaacttgattacattggcaaagaccctatttccaaataaggtcacatttatagttaccttaccagggtttaggacttgcatgcatcttttggggggatgtaattcaacccccattagatcatattatacctttacctataaaccttcagtggcccctgtggtctgctgaattaactgtagatgcttcatcttggtattccagaacttctgcactaataacaaatataataataataatagaaatagtcataactgacatattgagcactttccttgacattattcttagcattttacatgtatcaacttactgaatcttcacaacaactctgtgggttaggcactattattattcccattttatagatgtgtattaaacaaactgagtaaccaactcagggctctacaactattatagtctgagatgagattcaatcctagccagcctaactgcagtcaccactatattatactgcccatcttaactttttagcttcatactttctcccctacttatacagaaaaa

SEQ ID NO: 243021 - DNA, 375 bp, Homo sapiens
ataaccttatgttaaaagagtttcatgttttcttgagagcctttcatgctaaaatttctaaaagcccactggttgcacacagtggcaaaatgctacagtgatttaacaaccccaggcaaaattaaataacaaagctaagatatgatggagtacatttcttatccagtcgtaaagtaatctgcaatttcacaagttagaatttggtcaggacccagatgttaatttcagtaccaggcagagtgtactcaaggtttaacttatatcaaacagagacgaggtttccaggaccagccattgaaccccatgttggaatgcagtagcttttcctaaagcaaaatagcacactaccaacatcattgttcagcagcaccatag

SEQ ID NO: 243022 - DNA, 481 bp, Homo sapiens
tcaggtgagtttgagtgctgttcactggctcacccatcgatatttcatgcagtcattaatcgttcacagattatttatcctctgcacatgccctctaatattcctttatcttagttggttggcttgagttataagttccaatgcctacgagaagcagacccgtaatatagaaattaagagtccccaccatccccatttaacatagcactggaagtcctagccagagaaatcaggcaagagaaataaataaaaggcattcaaataggaaaagaagaagtcaagctatctttgctgatgatatgattctatgcctagaaaaccctaaagactgtgccaaaaggccctagagctcataaatgactttggtaaagtttcaggatgcaaaatcaatgtacaaaaatcagtagcatttctatacaccaataacattcaagctgagagccaaatcaagaacacattcccacttacaaagagccacaaa

SEQ ID NO: 243023 - DNA, 473 bp, Homo sapiens
gcacaagaccagaaaaatgaggcccagattggtcaggacttgactatgtcactcagtaaaactagagatgagtcttacttctccagtaagatcagagctgcaggctggtggtctggggtccatccaacctgagtcacacatttttcctaggacttcctattggactcagcagagactcactaaattttgaggtgtgacagagaaaggagccttcccttctaaggttctcctctgtttccccctagtctaacctctcacacggacaccaagatgtctggcctgatattaaggaagtcagctcacacaacccttcaaaattcagaagaaaatatatgggggttgctgcagaatgagctgccctgtctttcaactccatttcaggccttctgaagagccatctgaccttgcagcctctgccagttcttttcctcctccttccttcactcttacaggtgccttctgccctgaactgg

SEQ ID NO: 243024 - DNA, 585 bp, Homo sapiens
accagggttgactgtagtccaaggttagccttgctgccctctcagctctctgctcaggcttcattttctattgctttcggtagccactgtttctaccaggacattcacagtctggaagcagcatatggggaagaccccaagcctggaggcagaaggcagtgatttggatcccagctgaattgctgacaagcttctggctcaagagggccactgaatctctggcctgttattttctacctccttccacctcctttttaaaatgaaggtgccatgatcaaataagatataaaaacatattgtaaatattcccctttgccaatcagtccttcacttagacctccttagtcagttccctggtaaattattcctctcaaatcaaaattcttaactttatcttccttatatgaggttgcactattgtagagaactctcacagatgaactaattcatgctaatatattaatggaaacgatactcttccttcctccaaaaaactgtgtaatcacttatatattaaaggaagacattatgaaagtaagtgatttaaataaaggaatagtctttgatcaattaaaccttgaccaa

SEQ ID NO: 243025 - DNA, 361 bp, Homo sapiens
aagattttatgagataatgtataaaataagttcttaccaagtatcagctatgatatttatgatattttagagttattaattatactgtgaggattaaggaacttggcagaggaatacagtaggtgcttaaatggtatcctaaaatattatttaaaaataaatgacagtaatgggaataccgcaattacttttgcaccaacgtaataatagtaggatatttaaagttgagatcacaggaatcagtgcagatatgtctcattttaaccagcaggtggcgctcatgtcgtgtttaaattctgaacaaccttaaaaagtacatacatattcatattttctatttttaccagaaaaagtaaggaaa

SEQ ID NO: 243026 - DNA, 315 bp, Homo sapiens
cagcattccactggaggctatatgatcaaacagcaaactgtttatcatgaatgcaggatgtgagcaaactcaccattgctcctgccgacagaaggttttctggaggcaatcactccctggtgctgaggttatctactgcaacatttagagaatgtagtcttgcaagcctcctctggactgagcagctgacccctacttccactgcacccccccaactatctcttttgcctaataaatgcagagggctgtgtaaagctcagggcccttgtccactagaggcaaggtaccccctgaccccttcctccgaatatactt

SEQ ID NO: 243027 - DNA, 375 bp, Homo sapiens
gagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggctgacagagtgagactctgtctcc

SEQ ID NO: 243028 - DNA, 474 bp, Homo sapiens
ggaatattatttatatgtaaaattgattgacagagaggcatgtaaggatgactaaaatgaaaagcatgagcctttttagggttagaatatcgggaaaactgaggcctgagctaagatgtgccataaaagctaaggacagtagcctagtccagtgatgtatgcctgaagttccagctatttaggagaccagggcgggaggatcacttgggcctaggagttcaagttcagcctgggcaacatagcgagacccttctgtactaaatacatacatacatacagctaaggataataaaagccctttgctcaagatacaaagacatttacaaagaaacatttgggccaggcatgatggcctacacctgtaatcccagcactttgtaaggctgaggctgcaggattgcttgaagttcaaaacagcctggagttcacaacagcctgggcaacaaagtgagactctgtctctacaaaaaattt

SEQ ID NO: 243029 - DNA, 450 bp, Homo sapiens
ttactcaagtttcatcagagaagtgggcatttgaggtaaggatgatgaacataccgatgaagcaaagaccagggtggaaagcgtctcaatctggcccccgagtgcccctcctgccttgatatttcgctgctagcatccaggcagaatcagaagctcaggggaggtgagcccagagaaggcacaaccctctttgtatttagggctttaagagaaacatgagcaaaatggaacacatttggggacagaggtgtctggaagagagaagtcttgcctgaaatttcaagagaagtggactgtaaggggtaaactatgtgacaaatttttaaaaacatcaataccaatactttttaccaatgtgaaaagacaacgtgacttgttctgtgagcgacagaagatttcagggttcagcaaatggcagatacagaaaagtgaatccttaggtaaattaaa

SEQ ID NO: 243030 - DNA, 916 bp, Homo sapiens
tataattgcaattacttttgcaccaacctaataattcagtatccctaaaaactgtcaaaaattgccaatgctgcctctatctcaagtcgtcacggcggggtattggggaaaattttcaactagtaataaacctcattggctatgatactgccactgtgcaaagcttggaaaggttctcttttaacagctgctacagggatccaggggaggccaaacaggcatggaagccctatactgcttctcaatgagcaaccaaggggcaaagatgcacagccctcctaacagtctcgtgggacatgccctggtgccggctccaggattttgctggggctgccagtgtgccttggagcaggtcagctgcatggtccctaggagctggggatggagacttctctccccagtctggcagaaggaagtccatgtactctgagaaaggcaccaaaggagggaatgggaaggaaaagggcccattctggagcaggtctttgcgatgaccagagaaggggccccctccctcgtgggaaacacgaggttcaaagcaacgtacaagctaggggaaccaactggccccacattcaggtgacctcagccctgggaggtcagcacagggtggggatcccagaacaggcccatctcacacaagctcaggggtggggatgctggtgggctgggggactcggaaaagcatgattagaaaccacaacaaattcctaaggttaaacatggattttttcagaaggcatttgtggagttttacaaatgttgatgtaccctcagtaaagggcaaaaatgctctagacttaaaatcatgttgatgtggccatccctagggagattttgtttccattttgtttgtttcaattgatttgtttccattttatttcaagcagcctttctttcaaactcaagccaaaaa

SEQ ID NO: 243031 - DNA, 641 bp, Homo sapiens
ctacaaggtatttcttttaactttctccacccccagctcccagcagtcaagagtcaagccctaagtcttgtcctttctgtcagaaatagatacaagaaggatacagcaaacactgctataacacctctctcataggattcaaatcagtgtggagattattataggctccagatgagttaggatatctttaagtctcaatttaataaaactaattgttttcctgtgctttaaatatctctccattctatataaatataatatagatctaacagatgtagtcttgaaatagatggctataatgtcagtgaagtatttttttccttatttatatacattataactttccttatttatgtacattataattttaaaggcctgatagtcataattattgatgttcagattggtagttatttctgtctcttatgtattcaactataaacatttaatcaagtttatgagacctagatatttagcagagttttggagtaaattattttattaaacaaagaatataaaataaacatttctacttatgttcctgttttaatttacctcatttatatgcatcttgatattgcattttcatattctaaaaactatttttaaagacaggttgattcagaattacagtgtacttg

SEQ ID NO: 243032 - DNA, 671 bp, Homo sapiens
aagcgcgtccagagtgaaataggtgccaggagcccgcagacttcaaattaagtgattaatactggcagccattcttttcacttctgcctccctgcctgcggtctgagctgtggaaagacggggctaccttcctgctctttcttgggcctaggacctgctggggagttgatgatgtggtttttatgctcatgaaggccttgagtttaaacatttgatttgtatcttcgctctctagttggggttttgattgttgttcttatcctgacaggttatcttagcctcatcccaggcaggtctcccctcacgccctcacggagcgtcagccagctggctggtgactggcttctgtgcggtgtggtcctacagaggaacgtgggggcccggaactccctcttggctaaatccatacctaccaaaattttgttttaacatctctgtgtgagaagatgaataacgtttaacttgtggaaatggttttttaaaagtatcctcagaagttgaggtttggagaaattactgagcatttatttctaaactcttgtctctgcagattggatggaatgcacagtaccttgtgtgtgtgtttaatttttgcttctcactgatgcctgggtggattttatttaaattaaaacctatggaccgtattgttttggattgggctaaaccgc

SEQ ID NO: 243033 - DNA, 433 bp, Homo sapiens
caactatgtgttttacaaaatgttctattattgcataaaactgtctttgctctatcaccttctaaagcttcttacactctttcttggtgttaagtcaaacctgcaaatgctttatctgttctccatatcattagagctccatcttccatacatattttaagatagaccttccctccacaattattacccccacagtcttaatgtaaccagtgaacatggacagcagcagtccaatatacattcacattatcaaaacatgatggaagctgtagatatgcctaaatgtccatgttggttaaatctagacttaagaggctctgctcctcagaagttggacttctgaaaaatgctgaacgagaacaagaatcagaagaagaaatgtgactttgatgagattccagtttttctagataaaccttttcttttttacaaa

SEQ ID NO: 243034 - DNA, 458 bp, Homo sapiens
caagaagagacagtttctagaattccatgaagccccgtagtgcctcccctgttaatgaacatctcattgcagctgttctggagttttctaaagtcagaagttgctaatattgagattgtaataacataatcccaatacagacttgccctcttcttccagagaaggtccaagattcagctttagcttcaccatggagtaacttccccaaagcacaagctaaactctgcctcactttcctcatccacaggaaatgggatgacagtttgcatcctaccaaccttacagattattctgagaatgaagtgggagagaatgttcaagagcgagcactgaagagtgtaagccctcttacaatgccaggcacatctgcagaattatctagtccctggcacaggctgattaacaatgaatttacactctgaggaaactaagaataaattcctcagtcttttcttcgg

SEQ ID NO: 243035 - DNA, 670 bp, Homo sapiens
taaaagcttactacttcagtttcaacactgttatcacccatctgctaatttccacaaatatacaaataaatgaaggcaacaagtgcagaaaacagtacctaaatagggtgatcactactttacagatctatctaaacctaagtttctctggataagcactgcatgtagagagagctgcttataaaatagagaaacttccatcatttataccaaattaaaaccagtatgtttaaagtataaaaaccactcacttcagacataatatcttatttcacaaaaattgcaacattttttatttttatttttttatctagacagggcttcaatgtgtttgccaggctgtttttgaactcctggcctcaagtaatcttcccaccttggcctctcaaaatattgggttagaggcagtagaggccatgcccggccaaaaatggaaacttttgaacttcttttcttaaagaatcttcagtccattcacaatcatgaataccattatggcttcacagtagaaaaccatttcaaataatttttaaaaacattaaataagccgggcgcgatggctcacacctgtaatctcagcactttgggaggccgagggaggtggatcatgaggtcgggagatcgagaccatcctaacatggtgaaaccctgtctctactaaaaaatatac

SEQ ID NO: 243036 - DNA, 630 bp, Homo sapiens
atatcattataattgctcagcctcccaataagattttattctcttccttgtgacagcgaagggcagtacccaagagaggtatcttccttatttgccctcaccccaccactccttggactccactttcctattatctacatggcagtagaaaagccaaacactaatatcaactagacaaagaaaggaaagtaaattaactcttactttcttcttttacttttttatgaaacagagtcactttatcacccaggctggagtgcagttgcacaatctcagctcactgcaacctccacctcctgggttcaagcaattcttgtccctcagcctcccaaatagcagggactatagacgcgcaccgccatgcctggctaatttttgtatttttcggtagagatagggtttcgccgtgttggccaggctggtctgaactcctggcctccaatcgcccacccacctcagcctcccaaagtgctgggattacaggagtgagccaccgtgcctggccagctctcactttcatggtgacactagaaggactgataccaggattttcccacagactgtctgcccatctggggagccgtgactctcagacttaaatcaactacaaagaataattgtttgtagttg

SEQ ID NO: 243037 - DNA, 580 bp, Homo sapiens
taatctgtaactaagaggcaacaagaaaaggatgtgttctaaggatcacaaacttattctaagagttaaagaccccttatttagcatctgcgaggcaaaaggagaatgcaattaaacccttttacaggaaataagcataacctataaaatgactttctatacttgtgtctttttcatcactacaaagagtaggcactggtgattagataacactttctaggatgtgagatgacagcaaaaaagggacagccctacttacctttcggtctagaagagggctggaaagattgcctttctactgataacagacaagttacatgtgacagtgatgtggatacacctgcagtgacccctgcctatgtcccagcagagaggccacgagcccctgctgtcaacttcctgggaaggagacctctggaaagttggtgtttccaccattcaagttccctcgcacactccatgactgaacagcggtgtaaccttcagcaagttccaagtttcttaagctctctgagtcccagttttacttcctagtatgttgtaagaatcaaatgacagactgctggtgacacatagtaat

SEQ ID NO: 243038 - DNA, 317 bp, Homo sapiens
tgagctttgtcatttctctgagggaatcactgtcatttctcttccaggctcaaagcagctccccctgccccgtgtaaagcgctgatgagatggcaatttaaactgctttgatgaccaggtttcattaggtaagaaggcccgattaagcaacggtggcccaaataacctcagtggttcagacactgtttttcaaagccagcagaagtcttgccaaattaaaggatgtcaggatgagatgctatgaatatcagtttccttctctctggcaatggagaggattaattaaatgcctgtgaagtgctttgaaaatttaagct

SEQ ID NO: 243039 - DNA, 329 bp, Homo sapiens
gaatatcttgggggttcaataactattgctgagcccaggtccatgggcttaaccactactctagcctgctctgtgaggccaggggccaagttttgctcactatttctgaatcccaagtcccctgacatgtgtctgctgtaaaggacatgttcagttaatgctgaaaaactctgtgcaaggggcatctctggatggatctaataacttaagatttccaggtcacaaaaattcagagctgtgagaatccctggagtatttccagaccaacacactcatttttcttttattgttttgtttcacagaataaaaacactcatttttaatgtagg

SEQ ID NO: 243040 - DNA, 513 bp, Homo sapiens
cctcaaaagtggggaagctgacagtgcagccttctgtctgtagtcaaagttccaagagtcccagagctgatggatgtggagtctgatgttcgagggcaggaagcatccacctgggtgacagagcaagactctgtctcaaaaaataaaataaataagaagaaaaaaaataaagacttctacctcaactagagcacagactccgtgtgaggatatctgattttcagtatcaaatgctctcattttctagtgtcagatccctcatttgtagagtgtaaggctttggctctctttacggctgctcccagctctaatgttcttccatcttctctgcagtcatctcacatgcagggctctttaggggacagcaactttattttcacaaatcttacatagcccaggtgcctgcatgggttcactctgtcctttgaataaaatagtctcaaataaatgcttttgttatgaaatgagagcaacagaaaacagaaagatgaggcatttaacttaagcaaccag

SEQ ID NO: 243041 - DNA, 380 bp, Homo sapiens
ccaagtacataaaggatgcaagggtttctcaggagatcctagtaccgaacagacaccgaacaaaagctggttaaatgaccgttctctgtctcatcaaaagtaaattaacaaacgagctggatagctagtacaatttctactcaggtcttatcctagcatgactaaatatcatactgcttatggtctctgccagagaagaaaatttaagaaatgaagatattgcaaagatgggtaagaaaatctaaaatgaaatgggagtggaagttatttacacaggaataagacgacattaatgaagaaaccgtgcacgcagatataattgccaaatatattgtagcactatgggaggcctaggttaatcacttgaggatcaacctgag

SEQ ID NO: 243042 - DNA, 930 bp, Homo sapiens
gaaagagagatcagactgtcactgtgtctatgtagaaggggaagacataagagactccattttgaaaaagacctgtagtttaaacaattgctttgctgagatgttgatcatttgtagctttgccgcagccccttcctttgacccaacttggagctcacaaaaacctgtgttgtataaaatcgaggtttaagggatctagggctgtgcaggacgcgccttgttaaccaaatgtttacgagcagtatacttggtaggagtcattgccattccctagtctcaataaaccaggggcgcaatgcaccgtggaaagccacagggacctctgcccttgaaagcagggtattgtccaaggtttctccccatgtgacagtctgaaatatggcctcgtgggatgggaaagacctgactgtcccccagcctgacacccgcaatgggtctgtgctgaggtggattagtcaaagaggaaagcctcttgcagttcagatggaggaaggccactgtctcctgcttgcccctgggaactgaatgtctcggtgtaaagcccgatcgtacatttgttcaactctgagctcggagaaaagctgccctgtggcgggaggcgagacatgttggcagtaatgctgccttgttattctttactccgctgagatatttgtgtggagagaaacataaatctggcctacgtgcacgtccaggcatagtaccttcccttgaacttaataatgatatggattcttttgctcacgtgtttgtttttgttgttgctgttgaacttccccttattatcaccctgctcccctactgcattcctttgtgctgtaataatgataatcataatcaataaaaactgagggaactcagaggccggtgccggtgcaggtcctaggtgtgctgagtgccggtcccctggacccactgttgtctccctat

SEQ ID NO: 243043 - DNA, 313 bp, Homo sapiens
ctcatccctcacatcagcagtctatctccctgagcaagttgtccccatttggggcacctaacctaaatgctctcaacctagggaagctgtgctgcaatttctttagggcccaggctgacaccatctagaggtactttctcacacaaacgtgttacagatttgccaactactagacaaggagtgcacacttttgttgtgagttagaatatagacctgaacttggcatgttaattgtagagctcatttttaatgtgctcagagacctaggccacgcacagtgcataaaagagtaaaggcctcagtctaagtaaga

SEQ ID NO: 243044 - DNA, 585 bp, Homo sapiens
  misc_feature (455)..(455): n is a, c, g, or t
  misc_feature (536)..(536): n is a, c, g, or t
  misc_feature (568)..(568): n is a, c, g, or t
gggagacacgttttgttttaatatagggggattaaaatgatctctgagaccccggggctcccgttttgaatgccgagcactggagtaacaaacccaggagtgggcccagtgctttcttcttcaaagccctacttaccacaacaaaatactttgcattccaatccagaagatggctatagaacagggctttttgtctttctataattctgaagggttatgggtctgaatcttgatgggctgcctgtagggactaaaatcaagcaagatggatttgtcacaatcctggtgatacatgttatattttgcaaactgtattttatagtgagcctttgaagaaagacacctgattccatttggaaaaacactccagaataccatatctatatctatattgtttacatcattataaagtttaaggtcaaactgaatttaaactttcatagggtacatttttncttttatggtcagtgctttttgtgtgttgcaagaaatctttacctacccatagaattgccttggtgcctttgtcaaaatcnattgaccatatatctgtggatctggataatcnaattatgtcattggatc

SEQ ID NO: 243045 - DNA, 431 bp, Homo sapiens
caacttcacagaaaccgttccccaacgtgtctctgcataggctgcaacagagtcaaaagacaacttgggagtttgaagatgcatctcagaaggagaaagaagaaacgggacttggtcgcggatcggttaggacacagggagatacagaatgaggagagtcttctagaatccagacaaagacagacagaggaagggagggagaaaggaaatggagaaaagagacagacagaggaagggaaggagggagggaaaggagcagcgagggaggaagtgaggaaggaaatgagaaacagagagagacagaattttaaaaatctagagaaagaagtataaagaaagagagaaagagacatagaaagggaagaaagatgaaagagataaagaataaggaaagaaatagaggaaagccaggaggaaaaaacaaaggaaag

SEQ ID NO: 243046 - DNA, 414 bp, Homo sapiens
ccagtcagtgtccccctccccgtgaccgtgctgtactgtgattcttacatgtattgtatgactgttctctcataaactttgttttcatgaggcagacttggaaagatcttaagacattagtgaaaaaagcaaatcacaagccgggcgcagtagcttacgcgtgtaatcctagcactttgggagggtgaggcaggcagatcacttgaggtcaggagttcaaaaccagcctggccaacatggtgaaaccccgtttctactaaaaatacaaaaaaattagccaggcgtggtggcggacgcctgtaatcccgctactggggaggctgagccaggagaattgcttgaacctgggaggcggaggttgcagtgagccgaggtcacaccactgcactccagcctgggcgatagtccgtctca

SEQ ID NO: 243047 - DNA, 392 bp, Homo sapiens
tcaccatttgccactcttgtctgtgattgagacacccgaggcccattcaggatggagagtaattttttctctgtcttaacttgaagttttaaatagaccacagacgccaagtatattttggttcagcttttaaatagaagtcgcaggccagccttcgtgccagcagcgccatcgctggcagcatcctcctcctcccctcacgcggagactgacttggggagagtcaggaaacatttgagagagcagctgccgaggtggaggctgtgatgtatcttggatgaatctctgtgcaaacagttctttgggttcaagacctagtacagggcgatcctttttgttttttctgtctgaatcattttggtggaataaatagcaaaacattcccacaatag

SEQ ID NO: 243048 - DNA, 518 bp, Homo sapiens
agcgatactgatttctacgaagcatgaagcttttgagctggggtggcctctatatacatctatgtggcattgtttcctgaggtattaatggaggactagaaaatatctcctggatcgctatgaggattctctttaaacacacagctgatacatctatgctaatatactgcgtttcttgttttacatctctccacaaagcaaaatggtacaagagatggcctagttcgccttacgaatgtcaacatccagcttagccccaagatcattcctaaagactaagtgttgcaaatatcaaacatttaaaaattaagaatggctgcataaaatctaatacagaagagcaataaaataaaattagtcatcaatggttaaaatatgttatacattaggatagttaaaacaacattgtacaggtacatgaatagacaaagagacaatagaacagaatagaaaataaagaaacagttaccagtgcatgacgggtttgccatttgaagtggcattttaaatcagtggga

SEQ ID NO: 243049 - DNA, 805 bp, Homo sapiens
gttgagttcaatgctgtctcttcatctgtttctgttataactgcaggaagcagagggtttctgacttctcaacatggtaaaacaaacaaataaacaaacaaaaaccaaacaagctcctcagcaaaatagaggcatgaataagaggcaaacatacatgtagacagacaaattattgttgtgtgagactcatctttgatttcaatttgggaactgagttgagttcaatgctgtctcttcatctgtttctgttataactgcaggaagcagagggtttctgacttctcaacatggtaaaacaaacaaataaacaaacaaaaaccaaacaagcccctcacccacaggtgactgtcaagcctttgttccctttgctgccactgaagccagactggcgcatctgagtaggtttctgggctctctcctacctctatgaagtaattctaggctcactgagaagtgactcctcccactacagctcaccccctaatgcatcaggcccacaactgaccagaatagacttcctttctcttttctgtctgctccctatggagcagttgagaaggttcatttgcatacatcttcatttattgtccttccaaagcctttgataccgagcacgctaagatgggtatcctcattttacaaagatcaaggcagagagaagagaagggactcgcctaggatcacacaattgacatgtcatcgctgtaagtattttaaatgcaggtatgactcccaaacctatgctctccagcactctgcttccaggttttcaggtcctgattgttggagaagagagggcaagggg

SEQ ID NO: 243050 - DNA, 343 bp, Homo sapiens
caggggccagagcctgaaccaatgcccgagagaccaggcaagccgctgactactgtgagcctccgtatcctggtctgtgaaatgacggtgaagacgtggctcctgccacccctgggctcagcagatgaggcccacagacacccaggaggggtggacaacctcttagaagtgagaatgcacaacagggcggagttcgcagacaccaactggcacagtgttcaggaggatagtcctgttctagggtcacattttcccctgttaaaatcagtttcctagttccaaggctctgaactcacagggctggacatttgcatttgaataaagggcagagtggagaattaca

SEQ ID NO: 243051 - DNA, 333 bp, Homo sapiens
tgggagcttggagaacaggggagtgactggggctctgaggtggaccctgttgatgtttatatggagatgtcagcaggacatccaggtgggggtgctgacaggcagcagcagacagcctggagctgagagagaggctgggtgggggatactgaccaggcctgggaacctcacacaagggagccgcagggttcagaatgtggccagctggttgttaaacacagccattattaaaactaaatgatgcaagtgtacaattaagtaacaccaagaaagcaaaggtaatttttaaaaactagtaaaagaagagcaaattaaaaccaaaggaagcagaag

SEQ ID NO: 243052 - DNA, 515 bp, Homo sapiens
tagacagtctcactcttgtcacccaagctggagtgtaatgacatgatcgtggcccactgtaaccttgaactcttgggctcaagtgatctttccagctcagcctcctgagtatctgagactacagttgttcgctgccacacctggctaattttttaattttttatttgtagaggtgaggggtctcgctgtgtttcccaggctggtctggaacccctgacctcaagcagtcctcctgcctcggccttccaaagtgctaggattatagatgtcagccaccacacccaaccattcctcttttcataagtcacaaattaaaataacttaggtgtctaaaatgactcaaacatttttaaagagtcacatgaacctcattattctctccacatatatcttaagttggtgaggaaattatttcttacccttttaaggtaattcatcaagaaattgttatcttagaagaaaaatgtcttgattttggggctaatttttagatttgtactgagttatttcttttt

SEQ ID NO: 243053 - DNA, 406 bp, Homo sapiens
ggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttga

SEQ ID NO: 243054 - DNA, 392 bp, Homo sapiens
aatttagactgatcacaacttaacacatctaagacagtgaacttgaattttacattccaaaatatattacctcttcccatatgaaatacatgtaagaaaataatttcctcttaagcttttttatgtgatctaaagaaatggcaaaatattgggaggctgaggcgggtggatcacaaggtcaggagatcgagaccatcctggctaacacggtgaaaccccgtctctaccaaaaatacaaaaaattagccaggcgtggtggcgggcgcctgtagtcccagctactcggggggctgaggcaggagaatggcgtgaacctgggaggcggagcttgcagtgagctgagattgcgccactgcactccagcctggatgacaaagcgagactccatctca

SEQ ID NO: 243055 - DNA, 443 bp, Homo sapiens
attgacccttaattctgtgtgttatttgaggcttcttaccaatcagtttccctacttatctatgtccttattctaactcctcctactcacactttagtcctggattcaaaacccacctcctccacttctatccacactgacctctgtcccctattcctatagcatactcacggtacatctcattttggcagcttatttatcaagtgattactatgtatgctcaagtgaactagatgttttgtgaacactaagagaatgagataaggtccctgacctgaaggagggaacgttgctgttctgtcatgctatgtttcctgagagcaagccatgtatccacaggaaaatggaagtctacaggttcctccaggatgtctctgtgctatgtacatgctggaatttcagaaagacttgctaaattgaattaaattctctctctctctcca

SEQ ID NO: 243056 - DNA, 478 bp, Homo sapiens
gtacatcaacaaaatgtctaatttagatgtacactaggtttctgtggtctgattgggaccttaagaattgagtaccaatcctggttttaaaaattaaaaatagagatatttagagaatgcagttggaattttgttttgtaaatgaattcctaatgactcaaaatatttgcgggtttttttttattaaacttaactattgcattttatatctcaactcaaatttgtttaaatgtggctgagtaaaggacatttaacctcagcataaatacttgttagaattacttaatatttctacctatatgtgaatgtgtgcatttgtgtgtaagatatatacagagtaggtactctttcccttttggatttcagtaagaagttatgttgaactctaggattcaaaactttgaattgccagcaaaaccgtgtccaaatggattgtatgttttccctttataaataaagaacattgtatatcatttaa

SEQ ID NO: 243057 - DNA, 846 bp, Homo sapiens
cgacagagcaagactctgtctcaaaacaaaaaagaaagaaagaaaagaaacagacacatagaccaatagaacagaatagagaccccagaaacaaatccacacacctacagtgaactcattttcaacaaactgccaagaacatacactggggaaaagacttcaataaatggtgctgggaaaactagatatccatatgcagaagaatgaaactagaccactatctctcaccagatacaaaaatcaaaaaaaatggattaaagacttaaacctaagacctcaaactgtgaaactactacaagaaaacattggggaatatcgccaagacatgggtctgggcaaaaatttcttgagagtgtccctatgggcactgccatcatggcagaggtttggggctaaagagcagagaatttgtttcctgaagaagtgaaagttcaacaggcagggaatggatttcagatttgcatctggatctagattctgttcatctattctatttacatataaatactttgaggggaagatggtggataggagatagggcttacatgcagctcccacttggacagacagaacagtgtgtggagagtcacaccatggacttttgctccaggaaccaccacaggagcataccaggaaaactgaaggaattcacagacacttggaaagaagcggcaggccactgcaaattctgagagacaggtgaaaaactctggtgctctcttgaaagtgccacctcctggctggaggccaaccacctcaggacattacagcaactcatgacagatcccctgctccaaggaaggagaaaacaacagctaattctactgcctccaacatcctggctaa

SEQ ID NO: 243058 - DNA, 440 bp, Homo sapiens
agagccagatttgttattctgaagtttaactttcattttacaggactgtaaattgtggtctaggagcttcacctgaatatctgtgatcacaatggatactcaaaattattagacatttttaaaaagctgatttaaaaaacatgatgctggctgggtgtagtgcattagcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 243059 - DNA, 406 bp, Homo sapiens
cttatttgatttaactattggacttaattgaacttaacaattaccagtggccatttaaaaaaaactaaagaaatgagactgtaattgacaatgggtcacatacttaaagttatatgatcctttttggtagtgctgcatctgttttaataaggactttaatcatctaagttgttctcaaactttatggatataagaaacactaataacatgcagattcttgggtgctaccactcaagctctgattccataggtctggagggaggcacaggaatcagtatcattttaaggagcactactgcttattttgcctttgtggtctatgggctgtactttgagaggtctgattaattaattaaaggagaagattcctaaaatttgagagacaaaataaatggaacacatgaga

SEQ ID NO: 243060 - DNA, 421 bp, Homo sapiens
tcctaaatatcctgattggttatacagtcatttggattaccatgagtccatgcaaatttacgacctaaaagaagctggcaaattgggttaatatttaaataataaccaatctgttcatttattttgatatattttatttagaatttggggtgaggagaaggtaactgtatctgcaataactgctaatggactttctcaatctagatttatggcagtgccattggatctatggaaactctgagaagtggctttagtttactcctgacagtgtctctggttttcaatttttgttctaccctttcattatcttctgctgatgttaaaagtgccttgatcttccttttctcagatttctccaataattattttcatccatctggtataggcttggaaacagatgctgtatgctcacatatgctca

SEQ ID NO: 243061 - DNA, 412 bp, Homo sapiens
atgtatatgtcctcagttatttttttcagtaagttttggctaaaaggtatagaatcctacactctgatagctataagccataagaatatttctctagaggaggtgtcagaacttgctagggcagctatttttgagtatatcattatgttatttgtgtttcttcatgtgcttttaaaaaaacttaaatagtgtgaaaacttttctctcctgatgtgtgagcctttccccttcacttatgtgactggaagtggtactactagaagtgacagcactttaaagttaaaagcttattaaaacatacctcccgtgagtaccactctaacaattacagtggctgtgtcttctctgtcctttttgctgataaaacttaggggaaaattcctggcagctaaatcatggccattttattaaa

SEQ ID NO: 243062 - DNA, 1190 bp, Homo sapiens
attgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagctaatttttgtaattttagtgaagatggggtttcaccattttggccaggctggtcttgaactcctgatctccagtgatttgcccgccttggcctcccaaagtgttgaggttgcaggtgtgagccaccatgcctggcctctaattgattttttaatgtcttagatggagcatgcaatccctggttcttcctattgtgttaaattcctggcttgcttaggctccggtaagtagtttgggaaccgaagcttgattcttgtccatgaacttgttaatgcttcactgaaattgttaatcatcatcaaataaatatttaagcacttattcaaagataaaaataatgggattttcaaaattatcttcaagtttagcaaattatgatgtgaacgttatgaataatacttttaaattgctcactttaagcccttagcagttttgtgttttacagggctataatacatttcagaacctcatttaagcatttgagaagaaattagctaatgtttatctgcagggcatagttttgagatcataaaggccgacaatatttggtcaaattaactttgttcaggtttttataatatattagcttcaacttggcattgtcagtgactgaaaatctgtttgtaggataggtaaaactgcatggttctctcgcctgtggtgcatgtcctattttagcatttttggctgataatagttatttggtcttgcggccagcagatattttgctgtttattatagataacatggaatctggccagtcttttgaagccattatgtaaaacttaattatgtaaagccattatgtaaagattaaaataattttaatcatggt

SEQ ID NO: 243063 - DNA, 819 bp, Homo sapiens
attgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagctaatttttgtaattttagtgaagatggggtttcaccattttggccaggctggtcttgaactcctgatctccagtgatttgcccgccttggcctcccaaagtgttgaggttgcaggtgtgagccaccatgcctggcctctaattgattttttaatgtcttagatggagcatgcaatccctggttcttcctattgtgttaaattcctggcttgcttaggctccggtaagtagtttgggaaccgaagcttgattcttgtccatgaacttgttaatgcttcactggaacaattggtgtaatccattccatccaacataaattatttttaggcctttatttccaaaggacttaaacaatccatcgcgggcttttccacaaaattttcctttcacagtctttaccaacattatgattgtggaacggtctttgcatacaaacttttcaaattggcccttttaaaccctaa

SEQ ID NO: 243064 - DNA, 682 bp, Homo sapiens
  misc_feature (622)..(622): n is a, c, g, or t
  misc_feature (625)..(625): n is a, c, g, or t
gctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttgcatcaggacatcccgatggtgcagccgctattaaaggttcgcttgttcaacgattaaagtcctacgtgatctgagttcagaccggagtaatccaggtcggcttctatctacttcaaaggacatttaactggaaagtgcacttggacgaaccagagtgtaacaaaagcacccaacttacacttaggagatttcaacttaacttgaccgctctgaccaaacctagccccaaacccactccaccttactaccaaacaaccttagncanaccacttacccaaataagtataggcgatagaacatgagacccttgcgcatagatatg

SEQ ID NO: 243065 - DNA, 629 bp, Homo sapiens
  misc_feature (569)..(569): n is a, c, g, or t
  misc_feature (572)..(572): n is a, c, g, or t
gtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaaaaagtatacattttaaacagaatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcaacaaaagcacccaacttacacttaggagatttcaacttaacttgaccgctctgaccaaacctagccccaaacccactccaccttactaccaaacaaccttagncanaccacttacccaaataagtataggcgatagaacatgagacccttgcgcatagatatg

SEQ ID NO: 243066 - DNA, 610 bp, Homo sapiens
  misc_feature (550)..(550): n is a, c, g, or t
  misc_feature (553)..(553): n is a, c, g, or t
ccttgttgcggtggcctcaagagtcaggaatcgagactcacctggtgtgacaaataaacctggactcagcaatgtcgaaagaaaccagccggcgacccaggggaaaggatcctcacacaccacagtgaccaggcaactctgtgcacagaccgaggaaggaaacgcctgggagccagcaaagtatttccttggtggttgggacagaccaagccatatccccaacttctagaagagggcctggtacacaggaagtgctcaagaggtatttgctggataaatactgattgctgtgtgacctgggacacagacatcgccttctctgggcttcaacttttcttactgggatatgaggctctgaccagaagggaggttcccagcctttctgctaaagacccctgaagactacctaagccccctgaagctgccggtgtgctgagatctcaaaccacaaaagcacccaacttacacttaggagatttcaacttaacttgaccgctctgaccaaacctagccccaaacccactccaccttactaccaaacaaccttagncanaccacttacccaaataagtataggcgatagaacatgagacccttgcgcatagatatg

SEQ ID NO: 243067 - DNA, 505 bp, Homo sapiens
  misc_feature (445)..(445): n is a, c, g, or t
  misc_feature (448)..(448): n is a, c, g, or t
aacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaagcacccaacttacacttaggagatttcaacttaacttgaccgctctgaccaaacctagccccaaacccactccaccttactaccaaacaaccttagncanaccacttacccaaataagtataggcgatagaacatgagacccttgcgcatagatatg

SEQ ID NO: 243068 - DNA, 382 bp, Homo sapiens
  misc_feature (322)..(322): n is a, c, g, or t
  misc_feature (325)..(325): n is a, c, g, or t
aacagttttgttttactgtccactagaatgtaagttccatgtgagtactgtacaatttttgtctcttctgatttcttcattgggatctctacagtgccttgaaaatacatgacaaaatagtaagcactcaataaatatttgctgaatgagcaaatcaataaagggaaatagaccagtgaacaagaatgagtacatgctcaaaaggagcttccctttcagacaaaagcacccaacttacacttaggagatttcaacttaacttgaccgctctgaccaaacctagccccaaacccactccaccttactaccaaacaaccttagncanaccacttacccaaataagtataggcgatagaacatgagacccttgcgcatagatatg

SEQ ID NO: 243069 - DNA, 492 bp, Homo sapiens
  misc_feature (491)..(491): n is a, c, g, or t
caatatcgaattgagccttaccccttactgaaagacctttgatagattctgagggtagaatgttgaccaggatggagctgggccttggagagtggggaaggcaggcagtaacacagcaggcagtagatcaacgaggccatatcatggattgtgctgtgggatgtgaaggaaatgaacagacggaggacgcagagcagggcacctcgagctaccacggtcactaaaagctgctatgaccaagtgttctgtgagctgaaacctgaaggccaggaaggagtcactcttgtgaggggctgaaaggaacatcacagagaggggaggagctagcacaaaagctctccagatgggagaggctggtgcactgggcaagggaaagccagcaccatggtgcccagaagggaaggcagctggggggccagtctacgcagggccttgcagagtgtctgggtttactctaagggcaggtgaaatgggaagggtaccgagctcgnt

SEQ ID NO: 243070 - DNA, 379 bp, Homo sapiens
ggagctagcacaaaagctctccagatgggagaggctggtgcactgggcaagggaaagccagcaccatggtgcccagaagggaaggcagctggggggccagtctacgcagggccttgcagagtgtctgggtttactctaagggcagaggggaaggttttgatcataacgcactgcagtctgaaactcctgggctcaggcaatcctgtctcagcttcctgggtagttgggactgtaggcaggcaccaccacctctgcctaattattattatcattttttttggagagacagggtctcaatatgttgctgtgtctcagaggggaaggttttaagtcagggaatgattctgtgagcttaaaaaatcacttggaaattgccata

SEQ ID NO: 243071 - DNA, 377 bp, Homo sapiens
ctgattcctacatttcaagctttcttcaggaggatggtgacaggattaagaaggtgaccaaaaaaatctattatatatatgggattatttgccaagtggagagttcattttggagattttattggtagaaagtttggtttttagacataaaaaaatcttaaaagtgtaccttttaataatttagaaacacccactttgagttttgattaatttgattaattttgattaatttatatcaaaactcaaagtgcatatttctaattattttacattttacaatttaaagatatagtattgtatttgtgtaattcatagattttgtatctttttcattttattttcttgtgttatttataaacatctttcatatcaagttg

SEQ ID NO: 243072 - DNA, 340 bp, Homo sapiens
agtaaaatgctgtaaattggcttcttcggggatactgtcatctctaaagaaatcaagtaggccgggcgtggtggctcacgcctgtaatttcagcactttgggaggccgatgcaggtggatcacgaggtcaggagtccaagaccagcctggccaagatggtgaaactctgtctctactaaaactacaaaaattagctgggcgcggtggcaggtgcctataatcccagctactcggaaggctgaggcaggagaatcgcttgaacctgggtggcagaggttgcagtgagctgagatggtgtcactgcactctagcctaggcaacagagtgagacttcatctca

SEQ ID NO: 243073 - DNA, 336 bp, Homo sapiens
aaattatgtttgtgtttaaaatttaatgttcctggcccagggaggccaaattagtcctctgagtaattgagataatttttcatgcattctgagcatgcaaaattatcttctccagattactttgtctttgatatcaagatcagcttcatatggtttttattttctgaagataagctgtaatgtaattgctttagggaatctgatcatgtaaaaagcctgataggaaagagtttgaaaatgtaatgacattttttgtttcacttgccaactgaaaagaatatgtgacagagaccctttgtgtttctcaagtaaataaagtatttctgattttccaag

SEQ ID NO: 243074 - DNA, 443 bp, Homo sapiens
aatctgtttgaatatttctcctatttctcttatctgtgcatgtatagaaaagacttgtaaactgttgaattgaaatattgattgaaaagatattttaaaagataaaggagccttctgaatatcataacttaaaggtagaaatgtacatatatctcaggtaaaagacaaaaaggataactaaaagaatgaagatgaactttactcagaatatttacaatgaataaaatacagcctcacgtactaccgttaagttggtaatgcgttttatttttcttaccttcgataatttccaccatcctaccaatacaaaacatttttttactccaagttaaatctaattaagatgatttaaggagcattgggggataatgatgctatttattatagaagctgactactctgtgtgcttttgcataaccacagcttagctaccacttataagt

SEQ ID NO: 243075 - DNA, 231 bp, Homo sapiens
aaatgtggcagtcttgctgggaggagcagggtcagggtggtgctccctctgcagagttgcagttggggcctgatgggtctggttgggccccactccttgaccttgtccctcctcacatctttctagccagtagcccatgtctcctacttagtggagtaataaggccaggagaaataggtgtacctttattttcatgtaacggcaaaatgactttccccaaatcacagagct

SEQ ID NO: 243076 - DNA, 334 bp, Homo sapiens
aaaatgagtaagtacaatataaactgagatcaatcaaactactaagatacctactaatgtggccttgtgcaaagggggccagaagtggagtgaaacaaaaatcagtaatgaatacagaagaaggatgacatttgctacatataaatgagtcagaggttgagctctataagctacaaggagaaaagactgcatttgtttcatttctcaatcccatacaatgatgccctccaaaatcacaattacagaaggagagatttttctttgtaagtcacaatgttattataacccgaaagtcaagttttactgaattcaaggacactgcttccaagtatct

SEQ ID NO: 243077 - DNA, 312 bp, Homo sapiens
tgagtattagctagctagaagaagaggaacagaaacaatgtcccagggccagtgaacagcagcatgaaggcccagagttaggatttgaccttccacttgaaagggagccactgggggctcttggggcagggcgagagtggcaggattaaaggaggcctgtgagcacgtgtggaagagcagcctgacctcaccagccccgtggaagatcccaccaagaccggtgcacatctactgtgctggcactctgcctaggcaccaggaacacagcagggaaacagctgtttgtgcccccaagggctcatgggccagtgg

SEQ ID NO: 243078 - DNA, 247 bp, Homo sapiens
ctttcaaatgtatataaaattagaacaattatcaacaaatgatctatcttgctcactctatattcctacctactttcctcccacctcccactgtattatttaaaacaaatcctagagatcacataattttaactgtacattttttagtgctataaaagataaggacattttatagaacatagctctgaaaccattatcccatctaaacatacaatttatgggaattccttaatataaatattcattc

SEQ ID NO: 243079 - DNA, 502 bp, Homo sapiens
tgtgtagaagtattgccttctagaatgcatgatattacacaattgcataaataatgggtatcattttttattattattattattatactttaagttctagggtacttgtgcacaacatgcaggtttgttacatatgtatacatgtgccatgttggtgtgctgcacccgttaactcatcatttacattaggtatatctcctaatgctatccctcccccctccccctacaccacgacaggccccacggtgtctgatgttccccatcctgtgtccaagtgttctcattgttcaattcccacctatgagtgagagcatgcggtgtttggttttctgtccttgctgtagtttgctgagaatgatggtttccagtttcatccatgtccctgcaaaggacatgaactcatccttttttgttataacactatttgcatcaactctttaccatagtcacaataggactgtgataataacataatgaggctaattttttgtttaccttataa

SEQ ID NO: 243080 - DNA, 339 bp, Homo sapiens
aggaaaagataaaatttattacagtcatgatgttcataaaagtataaacaataagatatttccaaatacacgaagaactgagagaactaaagataaagaaaatcataatcacagcagaaattttttacactattctctttgtaacttataaaacaattgtaaaaattcactgacaatctagaaaatctagacactatctatctgaacaaaatctgcacaccttgagtttaaatatatattcctgtgcatgtgaaacttttgtcaagacagatcatatgctagaccataagtctcaataaatttggaaagctgaaatatcagagtaactttttagaacca

SEQ ID NO: 243081 - DNA, 377 bp, Homo sapiens
gtctttctgaatgcttcagctgtcagagatgaaataatgctggagattttttaaaaacagtttgagaaggacttaaacattaagtttgcattaagactactgccacaatacccatttcaatttcaggcctattcaatttgaattgttcaaaatagataatgggtgtttgaatttcacactcttctcttctcccgctccccactattcttgtgattattgttatttttaaagcaaatataggatattatgtcgagatcatgaaaaagtgggtctacaagggatgagtgtgatcctgttttggcgagagtcagggttaccactttttctttcttcttctttttgtctcctctttcttaattcctggcacagttatgtgc

SEQ ID NO: 243082 - DNA, 459 bp, Homo sapiens
acataaactgccccacatttccttactaaactcttctattccccgtgtcctcagctcactgtgctctggccagctgttctagcaccctccttcctcaaggcctttgaatatgctgttcgctttcccttgaacactcttggccaagaaaaacacatggcctcctttttcagttccttaaagtctcttccctacagtcaccttaggagaaaggcctttcctgacaatgctgtgtgcagtctcacccctgctgcctcattgtttcccttatccttgttttctttttcaggtttcttcatagcagttattcactgggtacaaaaattcttttttgtttttttttgagaatcgcttgaacctgggaggtggagattgcagtgagccgagattgcaccatttcactccagcctgggcaacaagagcgaaactccgtctcaaaaaaataaataaataaaaaatcgg

SEQ ID NO: 243083 - DNA, 547 bp, Homo sapiens
ggtttgcacacactcttgcctaattctaaatgtttttagaaacaaattaagatgaaactttaagatttgttagagaaagaataagaaacagcaataaactttattctccttaaaatgtaagatcctgctatgattcttcactggggggaaagaagatacatttagaaaattggttatctcagattcttagtatggttttagttagttagttttaccacttggtagagttaatgatttgacaaatgacatttgcttcttattatcagccagttggttgctagctttaaagagttattataaaggatttttttcagtattaatttatttcataaacatatatttaatttttatatattattatgaaaaaagggaattatttcattcttttttaaaaaagtctagaattagaggctaatatttccttatagaattgtcaggaaacaaactgttgtaataagttgtttttgtgttccaagagatgtgactttgtcagaatacatccaaattcatatttcttagcagatctttaacataacaccatttataa

SEQ ID NO: 243084 - DNA, 428 bp, Homo sapiens
gtcctatctggcacagctgcccagggtttgccttacctgttcacatctgtgggttctctgtgatcaagaactgcctgccctgggaaatccatttgttttcctccactcagtgccaaatgccttcgtctttgtttctgcaagctctcaacattcactgcaggctctaacccaatgacaagtctttagaagagaagagagggaaaaatagacagaaacacaccaaggagaagacaatgtgaagacagaggcagatattggagtgatgcatctacaggccaaggaatgccaagaattgccagcagccaccagaagccaggagataacagattctctgttcgagcctccagaaggatccaatgcagctgacaccttgatttcagacttctggcctccagaactgtgagaataaatatctgatgttttaaact

SEQ ID NO: 243085 - DNA, 625 bp, Homo sapiens
gagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcatttagatatgaagcctaagggtaagatgaacgtcttagatgatctgagatatccaaatacctgtaacaaacatttgtatggtgtat

SEQ ID NO: 243086 - DNA, 457 bp, Homo sapiens
ataggtactcaatatgctaactatgtacatgtgcatctcaacaaatctgaaggtatataatccagagtgtttggaggggttacctctgaaaagaggtgtgtgatctgaggtgtgtttttattctatatgcctctatgtttgaattttttgctacttttttttttttttttgagatggagtctcgttcttgtcacccaggctggagtgtagtggcacaatctctgctccctgcaacctccgccttctgggttcaagcgattctcccgcctcagcctcccgagtagctgggattacaggcgcccgctatcacgactggctaactttttttatttttagtagagacaggttttcaccgtgttggccaggctggtctcgaactcctgacctcagcctcacccttccaaagtgctgggattacaggcatgagccaccgcgctcagccttacttttttctttt

SEQ ID NO: 243087 - DNA, 328 bp, Homo sapiens
tcagtgaaacaaaaagttggttctttgaaaaagaccaataaggttgaagaaccttttactagactgatgaaacaaaagagagagagagagaataattatgttaataacatcaggaatggaggggacattgctgctgaaattaaaagatttaaagaaatgtagtagtaacgacttatctgtgggagatatgttccaaaatcccaagtggatgcttgaaaccacagataatattgaactcttcatatactatattttttccttattatacatacctgtgatagatttatcaatttcgctcagcatgagattaacaataactaataaaaac

SEQ ID NO: 243088 - DNA, 423 bp, Homo sapiens
attttaagataaaatacaattttgtagctgctataagtacaactagatatttaaaagaatgcaaagtggtatttttcactgaagttagaaaatcgaaaatttgccacatctgaaactttacaaagtgtttaggaataggccgggcacagtgcctcacacctgtaatcccagcactttgggaggccaaggcaagcggatcacctgaggtcaggagttcaagaccagcctggccaacatggtgaaaccccatctctactaaaaatacaaaaattagctggacatggtggtgggtgcctgtaatcccagctacttggggggctgaggcaggagaattgcctaaacctgggaggcagaggctgctgtgagccaagattgtgccactgcactccagcctggacgacagagcgagactctctctcaaaa

SEQ ID NO: 243089 - DNA, 357 bp, Homo sapiens
ccaacatggcacatgtatatatatgtaacaaacctgcacgttatgcacatgtaccctaaaacttaaagtataataaaaaaaaaagaaaaggaagacctggtattttataaggactatcatatgtcaggcacagtcataaaattgatatgcgatatcccacttcatctttgcacctcttcggtggttattatttgccctaatttatagataatgaaaatgagattcaaagaatataagtgacttgcttaaggttacagagctactcaggagcagaatgaaagacaaattcttatctgtctgatccaggatatttgtttttttgttaaaaatgatctatattttcatattctaaattgc

SEQ ID NO: 243090 - DNA, 468 bp, Homo sapiens
ttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgc

SEQ ID NO: 243091 - DNA, 396 bp, Homo sapiens
aaatccatcttttgcttgggagcctagaagtttgttacagtaaagacttgcatttctgcactggattggaattaaggtcatttagtaagaatttactatttaaaaaaatggaaatagagtttagaaaatatctgagacagaaacttagatacatttccaacatggcaaaacctaggacttagagaaaacaaacctatcatgcggttagaggagagaaggggacactcagaaacctgagcacatttcttagagctggtggaaggaggcagaaagcactactcgggagactgaggcaagagaatcacttgaacccaggaggtggagattgcagtgagccaagattgcaccactggactccagcctgggtggcagagtgagactctgtctcaaaaaaaa

SEQ ID NO: 243092 - DNA, 951 bp, Homo sapiens
tgcattgtcctctcatgaaatgacgctaaataatgttaaaggtttccagtatgatttcactgaaattggttgcttccttctgtacagatgtttttgtggtttagaacctcagccaaggcaaacattatgaatgagatgcagagaccaccatgtcctatgaagggctgagagttcctttgggagttattttacttgtgattctgacacctctgttttgacaaagcttcattctttcagtctcttctttccgtctccctctcctggtgctattggtttgttgtgggtggttttcctaattaagttaatctgcaacctagtttttctgggtccacagatgccagaatgctgaatttatttatcttgaatgtttttgttggctactgttgagacacattcttcctcttccccttttaccccaagtctgttttaaacattttttttttgaggcttccagacgcacttcaataaagaaagaatttctctctggtgtccatttgtcaatttttttgtgggggatgtatattgtaaataatataatagatatgtaaaaggttgtaaataaaacccaaaggttatagaggaaaagatgtgtaaatttgactacatcaaaaatttaaaactttttgcatgattttctttcggatttttgccttttccttgcacatttgttggttctctttcgatataaatcagaaaaatgaatcttttatctgtcaaatgcatggcaaagattcttcccagtctatcatttgtcctacagttttgattatggttcctttcatcacagaacatttctattatttatttaactaaaaaatgtcacaatgatgtctgtagcgtagattttataaagcatctgatggtcatattttataatctaaattttggaaaagtatttggataatgagagatggagaaggtagagggaaggatcaagggagggatagagag

SEQ ID NO: 243093 - DNA, 755 bp, Homo sapiens
ggatttaaatgcacaactgtttaaatgaactaaacagcatgatttcatgtatagtcatggagcacacaaacaatattttctggacacacgtgtttcttcttttaactgtaaaagaaaaaatgatttcacaggaattacattatttaaatctatttccttctcatgtgactgaagtttaaagttcttagtgctgcaatcgcatcttctcaggtgtgttctgtttccgtccacctatgcataggtgttggtgttgttcatgtcaagctgcctaatttgtttagtaggtgttcgaatggggcatacaattctctagacatgtagcaagcacacgggagaagccaccatccaggtgattcgcagcagtaaggctgatcagaaatttgatcctggctcaggggggttccggcagtaatcaaactctattcaccttgggtgagatttcgttatacctattcagccctgcttcagtgaaatctcactcaggaaaatagattctgtctccaactggaatctcccaaagccatgactatgtttctgatcagcactacagctcagatgaagcgttcagttacctgccagccagtcagcatttccccagactgcaaccagtgttggaaccaatctgcaggagtgggtggattggtagtgaaactggttctggtgaaaaaacttcaaaaaattttcacagaaaaatgattgactcccacttaattcaatgaagcaggattactctctgggacccaagaagaggatgc

SEQ ID NO: 243094 - DNA, 701 bp, Homo sapiens
ggatttaaatgcacaactgtttaaatgaactaaacagcatgatttcatgtatagtcatggagcacacaaacaatattttctggacacacgtgtttcttcttttaactgtaaaagaaaaaatgatttcacaggaattacattatttaaatctatttccttctcatgtgactgaagtttaaagttcttagtgctgcaatcgcatcttctcaggtgtgttctgtttccgtccacctatgcataggtgttggtgttgttcatgtcaagctgcctaatttgtttagtaggtgttcgaatggggcatacaattctctagacatgtagcaagcacacgggagaagccaccatccaggtgattcgcagcagtaaggctgatcagaaatttgatcctggctcaggggggttccggcagtaatcaaactctattcaccttgggtgagatttcgttatacctattcagccctgcttcagtgaaatctcactcaggtcagcactacagctcagatgaagcgttcagttacctgccagccagtcagcatttccccagactgcaaccagtgttggaaccaatctgcaggagtgggtggattggtagtgaaactggttctggtgaaaaaacttcaaaaaattttcacagaaaaatgattgactcccacttaattcaatgaagcaggattactctctgggacccaagaagaggatgc

SEQ ID NO: 243095 - DNA, 462 bp, Homo sapiens
tcggtgaggcactctggtgatgtgactggtgggtgcagtccactggccctgaagaggagagtctgtgtccctgggtataaagctgtgctgtccagaggctgaagtccacagcccctcgtgttctctctcccctcttcttctcccacaatacacataggtacacactctcatatgcacatacatgtacacatacatgcatattctttacttttcctaaatgatacaggattgaagaagaagctgatcatgacaaggactatgactagggggttaaaaaagaggcttggaggagaataagatcaacaagcctgattctcctgaaaatgacatcaaaatttagaggtgaccaaggaggcactggccacttcattataatctaattttagtagcaaatgatacttattagtttaaaaaaagagaaaatcattggtattttttctttcttttttttgagactccatc

SEQ ID NO: 243096 - DNA, 743 bp, Homo sapiens
gtggcagatccccccaaccctccttttcctcatccccacctacctccaccctagctcctagcttagtgtttgctctatggataataattttcttctttctccctcctttgtagagtggagtcttgttcaactgagaacttggagcttcggaagaaggtagaggttctagagaacactaataggtaagtgtcactggactgagagctgattgcgctaccaatggaagatggggaaggaagaggatagaatccagaaccagggatggcagaaaagtggaggaggtcacagtgaaagtgcagttgtgctgagatgctcagcatggccaaactccacccacccactcctgctacacacacacgcatgcacacgtgctactcttgcacatatacaaacacatatgcacacatgctctcatgttcacatccacaatacacataggtacacactctcatatgcacatacatgtacacatacatgcatattctttacttttcctaaatgatacaggattgaagaagaagctgatcatgacaaggactatgactagggggttaaaaaagaggcttggaggagaataagatcaacaagcctgattctcctgaaaatgacatcaaaatttagaggtgaccaaggaggcactggccacttcattataatctaattttagtagcaaatgatacttattagtttaaaaaaagagaaaatcattggtattttttctttcttttttttgagactccatc

SEQ ID NO: 243097 - DNA, 1320 bp, Homo sapiens
gcgacaccagtgctccatctgcctcaaggccttcgccaggccctggtccctgtcgcgccaccggctggtccactccaccgaccgccctttcgtgtgcccagactgcggcctggccttccgcctcgcctcctacctccgccagcaccgccgcgtccacggccccctcagcctgctggccccgctgcccgcggcgggcaagaaggacgacaaggcctcgggtgcacggaactcagccaaggggccggaggggggcgagggggcggagtgcgggggtgcctcggaagggggagaaggcgggcagaacggaggcgacgccgccccggctcggccccccgccggggagccccgcttctggtgcccagagtgcggcaaaggtttcaggcgccgggcgcacctgcggcagcacggggtgacccactcgggagcgcgccccttccagtgcgtgcgctgccagcgggagttcaagcgcctggccgacctggcgcgccacgcacaggtgcacgcggggggcccagccccgcacccgtgcccccgctgcccgcgccgcttctcgcgcgcctacagcctcctgcgccaccagcgctgccaccgcgcagagctggagagggccgccgcgctgcaggcactgcaggcccaggccccgacgtcgccgccaccgcccccgccgcccctgaaggccgagcaggaggaagaagggctcccgctgcccctcgcaaacattaaggaagagccgccctctccggggaccccaccccagtccccgccggctccccctgtcttcctcagcgcctcctgtttcgacagccaagaccactcagccttcgagatggaggaggaagaggtagacagcaaagctcacctgcgcgggctggggggcctggcctcctgaccttcgccgccctgccctccgccgctccgcctgagctccccggtttgcagaatggaggagggaagttgaaggagccacctcctctgtctacccacccgtccccttcacgcccttgacactaaggagtggggggccctggactgccccttcctcccccatcgcccgcccccagaacccctgatgctggttaggaaccgctcaccccaacatgtgtcttaaggcaggacgacttggaaaaaaaggcggcggacagttggccagagggatggagactggtggggacgcccccgcctccctgtcccccgtttcacacactggacaccatcacctctttggaactgccagaccctgggggtccccagtgagcaaaggtctgtccttgtccctttgtctgtctgtgaataaatgtgagttcgtgaaatccaaaaaag

SEQ ID NO: 243098 - DNA, 422 bp, Homo sapiens
actgattctatggccctgcaattaaatcactggctgggttcttgtcatctgtgaaacatgatgattatggtcatgacgccacttttggatggaccacgcaatgctttggccacaccaatcactgctggtttaggccacataataactggaacagctcacatcaatgtctgacatcgaatgtgcagagaaataaagtaagtatgatgaaacaaacaccattctctaaatgttaaaaaggttttgcatagagataggcttaagtaagttaggttgatgattgacctaattttggaaatcagagcaacttcacttttttttttaattcaccaacaatcaaatatatcatgttaatgaaacatgagcgtgttggccaggcacggtggcccacacctatgatcctagcactttgggaggctgaggtg

SEQ ID NO: 243099 - DNA, 491 bp, Homo sapiens
tgttggagagaaatcacactaccatcaaagacaacgggtcaaaaagaatgccgtcctaagctgagaagccatcttcctaacgacagccatgtaatatgaaagggaaaaacacactgttattgaagaacttatcagctatgtcacatcttccacacaaatactcaggaaagttaaaagaaaattttacctcggacacagttgatgtacctcagtcttgtacaaaacttagaactcactaagtctgaaataagactttaaactctctctgaggtgaagttgtaatacagtgagaatgataatatatagtatattaggatttacttactcctgtgttgttctggactatagactgccacacatatcagatgcacatgactgacatgtatatcttcattttgctattatttgtggtgaactaatacaggatttactgtaaaagtataataatgcagtagcaatatactaataaatcaatgcagttaatatacaag

SEQ ID NO: 243100 - DNA, 439 bp, Homo sapiens
ccctgttaaaactcttattgcttgatatagctgaaagatgacttctgctaatcttactcagtgaatggagcaatagcccatgagtctagttgtgtgttgtatatctaaactctcttgcgcctacagaatatgtaccatagggaaaatgtttaacagtagtaagccatagtatttgtaatataccttagtttttagaaccgttttagatgtacagaaaaaattgagaagaaaataatctgttctcatataccctgtataaagttgtcccttttattgacttcttatactaatgcagtacatttattaaaattatttaaccaatattgatacgttatcatcaattaaagtccatagtttattcatgtatccttagctcttacttaagtctgttgtattgctcaacagttgcatccagaatacattgcttttaattgtcctg

SEQ ID NO: 243101 - DNA, 485 bp, Homo sapiens
accccacccccacaaagtaggggcactgaagcctctgggcagagctgttgaactaaatgagcaagttcatgtaaaacacctggaaggtgggaggctctcaatcaatggcagttgccactgagaccacagtctcttcatcagaagggttggtgggacggctttggtggtcccagccagcttggctctcagtgaaccaaaagcgtgaaagcctctctccctcccttcaggaagctaacccagttttcaaatgaaggaatgactcttcacattgtcattaattttcctgagaagattttcttatatccattagctatacactataaatacattgggatcttttgtttttctagaaaaaaaaatcattttagccttgtattctggcacattagattgttcttttatccttgctttttaaaaaacctttcaaacggcttgccttccatggaagaataaatagtctgtcatttctggagagaacttgtaaa

SEQ ID NO: 243102 - DNA, 1008 bp, Homo sapiens
tgctcaaaaagttctggattttagagcattttagagttcaggtttttggattggggatgttcaacctggatttcagtttacagttctagtcaaacacttatgaagtaaagaaaaactatgcttagaagctgcaggctggttgatgttataacctataaggtgacagagagaacatgtaacactgaacacttgaggacaaatgcaaggccaacatgcagattatacattgcatcccagctacatgacatcataaagcatcgtgtggaagagattaatcccttggtcaagcttccggaagagtctctgtgtctccaggaccaacctgtagcggtcaccagacttcttaagtcttagtgggtttcattgttgttgttgttttgtcatctttaagatggaataatactgagttattgagggaaaactaaaatgagataagaaaggtaaaggttttagccagttcctggcacagaggaagtcctcagtaaaggttacctgttttctttattatgaaaaatattgactcttgagaatcaaatctatcattttcacttcaagattacaaacaacagcaataattaatgaattgtgattttaatagaaatatgtacatgtgccaatatgccacatattaatatccatctcactgacccaagtacgtagctgttctttttcaggtcctaccagaaaaaaaataaacagcagctgttctttagtggtaggcaggattcaaaaatcactttctgccactctacttttgagtaccaaagtgccagaagcctgaatcacaaatttagcagtgcattacaaatcagttaactgacttgttcccttggtgaaatgaaatgaacaatctggtctaggtctactcaggacatctgtgtagatttctagcttgtgggggagacttgacctatttcctccatgtcatctacacctaaaatttacatgaagacatgtaaaaagtactatattagctcaacacttcaacagattaaaaaaaaaacaccg

SEQ ID NO: 243103 - DNA, 443 bp, Homo sapiens
aatctgtctttggggctctcagcccaacatgatctctttcacgtggatagaaggatgccaagaaggtgcctggggacctgggagagaggcattaataactaaaccccaggaagtgtgcccatgctaatcgccacagtcctatgagaaaaacacttgggcatgcctgactctgtagcacctatttgcagaatcatacactctcagggctagaataggctcaggtggggatttatctagacccacaattctagacccacccagagacctcacaattcagaccctccataaaatgagtccatgtcctgaaaggcagagaagagaaggctttgattctactattagacttgcttctcttaattcaccgttgcctcctattgttatctttgttagtttaaaatttcttgtaataaacgcttgtatggcactttacatttcagaatgct

SEQ ID NO: 243104 - DNA, 431 bp, Homo sapiens
ttccagactgtgcaaagaagaactaaaagattagcgaagctccaatttaagcatttgcctccttagtccctttttctactacataactttaatatttggaacgatttagaaatctgaacttctctaaattggatttctcattgctaattccagttgtcgttctctcaagatgggcttaggttttaaataggttacttatatttcaaagtcatctaaagttttagttctttaaattcaacaaggcagaaattttacgttttaggcatggcagatgtcatgttttatacagtaacttcttaaaggtctttaaacagatatagctctggctcttaaaaaaatgtaccaatttatctcctgatgtgctaacgtgggggagaaagagagagagaaatgactggcatttgcaaacacataatactgttaaattgcaa

SEQ ID NO: 243105 - DNA, 376 bp, Homo sapiens
tgtccttccaacatagcctctgtttgttacctaactcagtttggaaggatttctggttgtttgcaaaacgtctccactaagataatgaagagctctaggctatcattctgtgacagatgcttccctgactctttacctttaaaaaggttttttttttttccaaagaaaaagggaaaatgacttcaatacattcttaaaacacacacccacatatcttagtaaaatatagaaaggatgtatccaaaatgtggttttccctccaaaatgctatcatatattaccatgaaatagtcatggtcaaacagtgctaacgaaggctaccatttattgactgtttcctctgtgccaacaaaaaaatttcataagtgctgcttca

SEQ ID NO: 243106 - DNA, 524 bp, Homo sapiens
gactttcagtgcttagtcattagattattcctgttctctgtgctacctcacttccttgacatagaataccatcatggatgacttctacatttattgctccagacctttccttaaactccagatttgtgtattcaattgtctgcataacctcactacttgaatgtataatagacatctcaaaatggatacttccaaaatcaaactcaaaatcaaagtcaaataattttccttccagatttttatctcctcctgttagacttccccatttctgtaaatggcaactccacatgtccagttgagagttgtgcaagccaaaagccttggagtcattattagcttctctttttcttacacatcatttccagtgtgtcagcaaattgttatgattctacattcaaaatattttagattctaatcatttcccaccacctccaccactacaacccttggttagatgccatcacttctctgtatctttgcaataaaattctaattggtccctgagcttccacctttgacctgcc

SEQ ID NO: 243107 - DNA, 429 bp, Homo sapiens
gcggccgctactactactactaaattcggcggcgggcgacctgcaggttctggccaccagtcagagcggctgggtgcacaggctgaggtaggacagtgtctgcaaaggaccacttcgagctcctcagtgtcagtcaccaggacagagggcctgtgtgtgaggcgccatacccaagggcctgccctgccactgatgcccgtaacgggtgagtctgaactgggacaagcgcgtccatgctgcctccctccctaatacgcccaggcaatcctgagaaattccaacttcaccgagcgcccccaacccgtcctgctaggtgatttctagtcgcctgcatgcgcaacaccggcgcccctcaggttcagcgtcccgggccaggacagagctataaggcacttttgctacaccccagttttttaggggtgagaaggt

SEQ ID NO: 243108 - DNA, 506 bp, Homo sapiens
tgtccgcgatgtctgcatctgagggattaaaacgtagggtgggatgagctaaaacgttagcaatgtatttaaagacatggtcagcataactgaagaaaaagattatcagaacggaaaaatggggttcaaagagacgaaaggtgtcagaacatgtccaaccctagccaaggagagagagacaatatttgaaggacagggtcagggtagtaaattggcgtccctggccaacgtcattagcacaaatgggcactgggatcaaacttagtagccttgggtatattgaaaacatgccgtttctagacctggaaaaaaaaaagccgtgtttcagctcagaggctacccgagctgttctgatgaagcaagcggagcacctcagtttccaaaacccggaggtctgtaacgaaacgaacaagtaagagacaaacctgatcgtttcctcccctgcttaaacagttttctctttctcttattgcctctagaataaagttcaatcctcctgcttcaac

SEQ ID NO: 243109 - DNA, 437 bp, Homo sapiens
tcaggggatttagggaaaggctccagagcaggaggcatggctggctgaggttagcagccttggtttgaggtctgggcagctggtgggaggaggatatggtgaacagctgggatacagatgcccccgggcatggcaaagtcttggagtcatcagctcaactccacaaaagactcagctttgcatatggtgggcctggcccctgagtggagcctaccgtctttccccattaactgcaaatgacgtttccctcattcagctacactggcaaacagtaccaagcgccttctccataccaggcactttgctggacattgagatgctgcaatgaagcagatgcccaaaaaaaccctagtttaaaaagtatgtaatttttaaaaatgttactggtttttgaattctgaaagtcaagcaatacattcattagtcacctcaccacc

SEQ ID NO: 243110 - DNA, 435 bp, Homo sapiens
gcagatggggaaactgaggcctggaaacagagaacggtgggaccaaggtcacatgatggcggaaggaggacaaggaaggaggctgactgcgtatccagcacgtgttccgtgccaagcctgtgcaggggccaaggaccggggtctctggacagcgccggttgctgggtcccacgctgggcgacagggcctttgcaatcaggccgacagggtttgaacccttgccgcggcactttccagatggccttggccactgtcccctctctgaccttcagatggagcccatggcacctccggagggggtgtgtgcttccaggaccaaatccacttgtgcgtggttaggcacgaggtggggggaggcggctcagccaccgggacctgtcctgcctccaccctctgtgcaacccctttccttgccttttgtctctgttgcttttg

SEQ ID NO: 243111 - DNA, 370 bp, Homo sapiens
ccccatctctactaagaatacaaaaactaattgggtatggtggtggcacatgcctgtaatcccagctacccaggaggctgaggcaggagaatcgccggaacccgggaggcggaggctgcagtgagctgagattgggccactgcactccagtctgggtgacagagcaagactccgtctcaaaaaaaaaaaaaaaaacttcgaaagagacactcgtaaaaacaaataggaaagattagtggattattagcttttatgctgttagttaatacaggtaattaacattaactatttaaaaataaattattaaacatctccctgttgaataatactaaagacttttacaaattgagataaaatgtgtatgactatc

SEQ ID NO: 243112 - DNA, 429 bp, Homo sapiens
cccgctggaaagggcagagcagatgcccttacacccatagcccctgggggtcatgcctgtgagttcttgcatatcagcttgtgacagcgttgtgacctgcccctttgtcaccttgccaccacatcaccccccaggggtctgggcatttcctcgaagctgcttccaggacaggatcaggaacgtgttacttgggtggggggctgggagggaggcaaggagctctggttctgcccatgtcctccagcctcgagtgtgcaactgctcttctgggaacttgggtctcctcatctgaaacacagggaattagagaagatgattttgtaacgctcgaaggctctgtaatccccaaaaacatgctctaaagggatctccagtccagcatatcaacccaaacaaaagacaacgctgtggttacttgttcaaaaaaaa

SEQ ID NO: 243113 - DNA, 341 bp, Homo sapiens
aggcaaaatgtctgctgcagatgtagaccatttaactgtaatctatttcaaaggctgacactttcaaaatgatctgattaactgggattgtcggacataatataaaatgtatccaagcttttcaagatgtggatttcatttgttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggcctcagtg

SEQ ID NO: 243114 - DNA, 263 bp, Homo sapiens
cactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgctgggattacaggcgtgagccactgtgcccagtccacacttgacatttacca

SEQ ID NO: 243115 - DNA, 222 bp, Homo sapiens
cgcttggcgctatccttataaaaaaaaaaaactgactgtgtcaagcccctaaaaaaccctaccatagtcccctatatccccctttggggtgaagaccacattcccccatcatggaggtgggaaggttgatgagacaccactcagcacgaggcaggcattcatgttaggggacaccaagccccgctgctccccagcctcccctctcacttgtctgtctcctcc

SEQ ID NO: 243116 - DNA, 864 bp, Homo sapiens
  misc_feature (837)..(838): n is a, c, g, or t
tttttttttaagttaaaaaaaatagtcttaaaaaatgtttgggctgggtgcagtggctcatgtatgtaatcccagcactttaggaggccgaggtgggcagactgcttgagctcaggagttcgagaccagtctggacaacatggcaaaaccccatttctactaaaaacacaaaaattagccaggtatggtggcacatgcatgtagtcccagctactggggaggctgaggaaggaggatcacatgaacccaggatgtggaggtggcagtgagccgagatcatgccattgcactgcagtctaggcaacagagtagggaaaaatgaaatgctcccctaataagcaccattttcctttattctccttgtgctttgctaagtgaaatgactacgtttctctagacagtggtggatgatattcaacttgcaaaaatatagagaactgccctccttcccattgaaaaggcagaggaaaaggaaaaaggctttccccacagtgctgagaccccactgtatgtcaggacacgggccagtgttcccatctcctggctcagtcatggtgttgctactgcctggacagtgcgtttatccagctgcccacccgccacccattccatcagaaccagtgggctcagcaactgtctgctaacaagaatcatgaagcatttctttttgtttttttagaggtagggtctcactccatcactcaggctggagtgcagtggtaagatcgcaggtcactgcagactcaaactcctgggctcatgtgattctcccacctcagccacctgagtagccgggccacaggcgtgtgccaccacacctggttaatttcgtctgannggccgcgatttagtagtagtagtagt

SEQ ID NO: 243117 - DNA, 182 bp, Homo sapiens
aggatggagctgctgcaggttccttccctcggaaccgtgccctctgcacagagtgcgcttgcccctgccctgccaaattccactgggccctaccctgggaagcctgttcagagcctctgggccgaattccttgcccgaagagctggcagcccctagtacctggtgaattacgttgttgttgg

SEQ ID NO: 243118 - DNA, 366 bp, Homo sapiens
acctaatcactgagagactgttacacactcaaaatgtgtgttttgagatatgagtctttatctgctaatggtaattctctcaaaagactattgaaatcaaaggtcaagactaatcactcactaaaatgtggtgtaccacgatagccagccccactgcttctacaaagcagcagtcattcattccctcccgcctcctttctctctctccctctgtctctctctctctcctaagttccccccagttaatgcagtggcgccgggatggatttactggctgcttttgaggtgctaacaacctgttaaccttccagttgctggtttttaatcttttagtctaatgtgaatgataaagaccttagcttatta

SEQ ID NO: 243119 - DNA, 362 bp, Homo sapiens
tagagaatgtagaaatatctataagtttttcatgtcatcctgctcattttttgttttcttcacacttatttcctagaatttctaccagtggatagaggtatccacagactaaaattagttttgtgggtgagcctaactttggggaatgggagggaggatattagtggtcagtgtggagtagaattcttacctcaatgctcttgaagttgttctctgtaacttgagaagaaaattccaagaaagtttgttttttttcagagagagggagactggagtctgaacttgtcacaccctgtgctatctgatgaaaatacagaggcaatgactctcaaattttccataatttaacgtcctgtcccaaa

SEQ ID NO: 243120 - DNA, 378 bp, Homo sapiens
tagtgcaattcaaattctattcttgaagcttaaagataacattggagctggcccaaactagtaaaatatatgattgtgaatggagtttatcaaaatgtagacacagtaaatatcctaaagctttaaatctacttctgaaacaatgacaagcaggcattttgccagtgctaatttgctttactctattgattcaagctttattgggcattctattgtctcttctagggaaggcatcagtggaatacagaacagtgaaggcttattcaagataatgttatactcatgaatcacgccacctaatacctgcactgcttagacatgcagaacataaagcgtcttctcaagatatctcagtaaaagatatctcttcttatatac

SEQ ID NO: 243121 - DNA, 386 bp, Homo sapiens
actgttagaactaggtttttttgtattccagagtaaatctttcaatagacttttgtacctttggtttgaaaaataactacacacatgcccttattttgtttctgctttgcccacgtttaagctttgttgatcctataggtagatggcatttatttgttgaaaaactagtcagaaaaattcttactttatagagaactacagacgtgctagtggcacttttatgcccaatacagcccagtggattatttaatattttctttaattgctgaagagatttttgccagaaataaaacaattagcactcacagatttgatttccataccaatgtgaaatcttgactctgcacattattcaaaagtgaaaccatactgagaacaaagaaaga

SEQ ID NO: 243122 - DNA, 1637 bp, Homo sapiens
  misc_feature (282)..(282): n is a, c, g, or t
  misc_feature (1189)..(1189): n is a, c, g, or t
  misc_feature (1195)..(1195): n is a, c, g, or t
  misc_feature (1197)..(1197): n is a, c, g, or t
  misc_feature (1250)..(1250): n is a, c, g, or t
  misc_feature (1267)..(1267): n is a, c, g, or t
  misc_feature (1274)..(1274): n is a, c, g, or t
  misc_feature (1277)..(1277): n is a, c, g, or t
  misc_feature (1294)..(1294): n is a, c, g, or t
ctcaagtgtatagtccttcctaggctgcttcaaagcaggcatagcaactattaataaatacttgttggataataaataataaaacagaaggaataatgctgtaacctaaggaaaggagctagatagatagctttgaacatcaggaccttcctagtacccctgagattgtcccacatgggtgaccccttctttatctctaagtttaggttagtccatgttaatgcagtgctatactgtcattcagtgacctttggagaaaatccagaaattttatttaaaatngagaaattatatttggaggaattatatttagaggaaaaggagagaaccaacaaatggaaaattccaagtttcttttcgttgagctaatgttaagaggataaattatcttgttatcggctaagaaagagaatagacttggaaattgtcctgcttccaagaggatggttgaagaaatcaaagaatgaaggagttacttggaggtccacctgccccttccttgttcagttccatctggccttggagccaggtaaaaaatagctgttatctaggggtgtggagaaggttacctcttcaaatcatttagattcttagagcacaatggaccttaagatctccccactaaccccaactgcattggctgcatgaagctgcaggagctgcctggggggcatgtcataatagggaccctctgctttgcttgtcatgcactcaggcttcagtgaagatgacagcccatcacacacttcccacttcatggagaggacacccagtccctctctccaatcctaacctctcacccacactcctgtctgcaaaaacctgaaggttatttctgcctggaggatccactgatatctgagtcaatttgtcctaaactcaaactactattatcttctcagaggccatctcagaggtcacctctgcccaaatccccttccttcccctccaggcagagtaaagcattccgtatacttctgtttcctattaaccctttccttctctgttcttgtgttagctaggtattgagcctttgtgccctctcaccagaggggaggatccttcagggaggagcttgtgaaggaaagaaagaagcatggagtagagtgtgacgggtagcattttcagacacatttctgccccctgcagtgggtcatacctgtaatccttctagcactttgggaggccnaggcangnggatcacttgagtccaggagttcgagactcaactgtgtaggctgggcaacatngtgagaccctgtctctncaaaaantanaaaattacctggacatngtggcacacacctgtggtcccagctactacagaggctgaggtggaaggattgtttgagcccgggaggtcaaggctgcagtgagctctgatcgtgccactgggctccagcctgggcaacagagcgagaccctgtcaaaaaagaaaaaaagaaagaaagaaagacacatttcttcaacttcacaattttggatagaggtggacttgaataccaggccatctgaattactgggggcagttaaaacagtaggtttaaagggatggtgataacaaatgttttccaagggaccctattatttatttttatattaatgtcttatatatccaattatagtttatttttttg

SEQ ID NO: 243123 - DNA, 381 bp, Homo sapiens
agaatcagtgaacttaaaaacaagtcaaatcccagtgtcatggtgcacatctatattctcagctatacagaggctgaggtggaaggattgtttgagcccgggaggtcaaggctgcagtgagctctgatcgtgccactgggctccagcctgggcaacagagcgagaccctgtcaaaaaagaaaaaaagaaagaaagaaagacacatttcttcaacttcacaattttggatagaggtggacttgaataccaggccatctgaattactgggggcagttaaaacagtaggtttaaagggatggtgataacaaatgttttccaagggaccctattatttatttttatattaatgtcttatatatccaattatagtttatttttttg

SEQ ID NO: 243124 - DNA, 569 bp, Homo sapiens
gccaccatggccttccattggtgcttgcacacagtgtctcctcttataagggcactaatcctattggatatatgccccactcttatgacctcatttaaccattattacttctttagggaccccattttcgagtatagctacactgaaggttaattttgagtggacacattcaatccataacatagttgatagtctccttgcctgaaagtaatagatgagtaagaacttgtaaataaaagctacctgaagcatttttgactttcagcattatcagtatacaaataataggtttggagatgtagacgcctttctaaaatctcaaaataggtttcttttctccttcgtccttttctgggacttcttggagtgtttcattttgttttgttatagttggcatttagaaatgaatcttgtcatttttagatcactccacgtgttcatgctacctttcttgttcatttttccattcgtgtactctgctttttacttgtcattgttttcttctgttttgatggtttttgacttggattttgtttttgttgtttggcttttaagatgtacattattac

SEQ ID NO: 243125 - DNA, 481 bp, Homo sapiens
ccctggacttatttcactatgttctaaccaaatgagaaaggaagcgccaacagttttcaatgcaaacacataattaaggtagtaagatgtctgaattatagatttggtgatctacaatcagcaggtgcctcagattctttctgtattactgaagtctctggttgcttgcatgggttggaaattaaaggaattataagcattaaagattgaagtttagttctataaggaactttagcaataatctagtgatagtcaatggatgttaactttcttttttagaagcatctctaaaattatgattctcctctaaagaatgtacctttctctaaaaagtgcccacatgcacatccacataaaatctttacaaacatcaagggatttgagatctccctgaagctgattcatggaccctccattaagagtcctgtattagatcatgccactgcactccagcctgggcaacataaaagactttgtctct

SEQ ID NO: 243126 - DNA, 1099 bp, Homo sapiens
atataaataccattgtccaagagagaagggaacatttttccttacagtagaactccatctattaaatgtggaagacatgaggaattagaaaaaaatcttcatttgggaactgccgtattgataattatttcaggtagatatcaacagatactaaaactagtaggaaagttcagtgaacaacagcatatttacataatcacaaagtactttcccacaaaatacttactatgatggggaaaattataacttcgtactagagaaatctggttaacaacactttaaccaagtgatcaaagctaacatcaccaggaatgggaaagctccatatcagatgcttgatatggtgcattgcggaggacatactatcacttctgtgacattcctgccaaaaaatgcataatctgaatcaaataataggaaaacataagcccaatctgaaggacattctgtaagataaatggcctgtactcttcaaaaatgtcagagtcatgagagacaaagactgaaaaacttttctggattgaagaaaattaaaagagacatgccatctaaatataacatgtgatcctagattaggacactagtagcacaattggcaagattggtctaggtctttagatattaaatctagccataggaggcaataagaaaaagaaaaacttatatcaatgataatcttctgacttgttgatcatactagagtatactgttatgcaccacataaccacatctctattgacaacaaactgcataaatgaagatgatcccataagattatattactgtatttttgctataccttttctatattaggtatttttagaacacaagtaagtgccattgtgttacagttgcctacagtatccagtatagtagcatgctgtacaggtttgtagcctaggagcagtaggctagaccgtatagcctaggtgtgtaggaggctgttgtaccatctaggtttgtgtaaattctctctatgatgtttgcataatgatgaaatcacctaatgacacgcttctccaaatgtggtgcataactgtatatgtaagcatgtcttcgtgtttaggaaataatacaaaaatatttaaacaaatggttc

SEQ ID NO: 243127 - DNA, 205 bp, Homo sapiens
agctgggcctggagactcccctgggaggcaacagcggggtctgcagacgcccttctccagccggagctgggactgttcagtcactgggagaagggatgtgggtctgaagagcttggttgcagaaacttcggggtctacaaacgcaggcgggagctgagccaaaagagcttgtttgctgggaggtgggagatgcagcccggaggaa

SEQ ID NO: 243128 - DNA, 479 bp, Homo sapiens
gaatccatggtgccactttcccggtgatcccggtgggggaaggggttgccgcccggcagagattcagtcccgaatcccgacagcgaagagacttgtatgccacctgcaggccggggagcggggcgcgctggggctgcaccaccccgaactttgtaacaatctagagcaccacagagtgtttccagagatgggtttcagtagcccaggctggtctcgaactcctggactcaagtgattggccctcctcggcctcccaaagtcctgggattacaagcgtgagccaccatgctcagttggcgggggattatctgtgatccaatgaagttggactagagatgtgaagccttagaaaacggtggattgaaaaaagaattttagtctcctccagagattatattttgtgtgttcattgctctcaaaaacatgaaaataaagagtattttatattgtgatttgtaggacaatagcatgcttgtata

SEQ ID NO: 243129 - DNA, 670 bp, Homo sapiens
gaatccatggtgccactttcccggtgatcccggtgggggaaggggttgccgcccggcagagattcagtcccgaatcccgacagcgaagagacttgtatgccacctgcaggccggggagcggggcgcgctggggctgcaccaccccgaactttgtaacaatctagagcaccacagagtgtttccaggtcggcacaaaagcgaacgggacagggcgccctgggcggcggcagcttggccggcccgctgcctagcgcgcccccgaggggcggtaatggaacgtacctttggctgaagaaagagtgctcccggccagcgcggggtcgcctagggggttccgcgctgcctaatgcaaaggatggaaaagttacagaagcagagatgggtttcagtagcccaggctggtctcgaactcctggactcaagtgattggccctcctcggcctcccaaagtcctgggattacaagcgtgagccaccatgctcagttggcgggggattatctgtgatccaatgaagttggactagagatgtgaagccttagaaaacggtggattgaaaaaagaattttagtctcctccagagattatattttgtgtgttcattgctctcaaaaacatgaaaataaagagtattttatattgtgatttgtaggacaatagcatgcttgtata

SEQ ID NO: 243130 - DNA, 304 bp, Homo sapiens
aaagcagaagtcaataacagaaggaaaactggaaatttcacgaatatgtggaaattaacacattcataagcaaccagtggataaaagaagaaaacagaagggaaatttaaaaatgctttgactggagtcactgctgctaaggtccctaccacagatgcaagaaaaaagctttatgctttctgtctgattatgacagctaagattgaatgcagcaatatagaaactacataaacatggagggggcagataatttttgcaactcagaaataaccttataaacagcaaataactggttttactcaaa

SEQ ID NO: 243131 - DNA, 770 bp, Homo sapiens
ccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagtttaacatagcacagggccttctgaaaatcgcacttgtcaaagacgactcatctatttctccagacttcagtaaagaatgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattga

SEQ ID NO: 243132 - DNA, 254 bp, Homo sapiens
cgatggcttcaaaaaggagtactctagtggagagagcacaagttgcttggcttttctgatctagccttagaagtcacttctgccatgctctatttgttgaaacactgtaaaacatcatcagtttgaaggagacagtatatacaccttacctcttcatgggaggattgtcaaagtctctctgtaagaagagcatagtataggagatattgttgtagccacctttgcaaaatacaattgacacacttaatatttat

SEQ ID NO: 243133 - DNA, 514 bp, Homo sapiens
tgaggaccataagatagaagatgagaatccatctgccctcttctctgcacccaggcttcaatcctgtttgatcatgcaggggctacaaggccttcgacacaaagaacttgtcttagattctaatcagtttaacaaataggacagacagctgctgagcactgtctgagtgacactgatttacatacaaatgaaccaccaatgtccccttctatcaactcagaataaaatctggttttagcatatgcagtcctacgagacatggttaaaggatatgaatgatagatagagataaaagaaatcaaggaccattcctccacaagtctccaaagaggaaaacaacaatcgaagaaaaaagagtgagagaacagatgggctggcagagttttgctttctatgtgacattgtgtacttattattcgcatgaggactaatttataaacccggatagtgtttataaactatactgtcctaatggaaatgaaagcattaatacaactagaagattctttacttt

SEQ ID NO: 243134 - DNA, 465 bp, Homo sapiens
agaactgggtagagatgaggacagaggagacgtttcatgtttggtggtacaacacagacacacacacttacaataatatttattacaatacctttctgaaaaaatgtagataagtagaaatgtttactttttatgattaataaacagcatgacttagtctattaaatgtaacagttgaagaccatttacatttttaccgatcttggtgtactctatgtagaatgtttctgacatagccttttcctcttctttgaaatgctccattcctagtgagttatatatttagctctccacctgttatttattatttttgtttacagaaaaccataagtgcacagaacacataaaaggccctataaagatgagttttctaatccaattaggaagataatactttgggcaacagacaaaatgggcaaagagatgaaaatatttttatagtgcagatcagaaaagagtttcata

SEQ ID NO: 243135 - DNA, 140 bp, Homo sapiens
agctatacctgtaacaggtagatttcattttgtaaattgtatctcatgaagttgatttgaaaagcctacactgagaggcagtattttaactattctgagataacattgattaaaaaatgcaacatgccaaaatacactaa

SEQ ID NO: 243136 - DNA, 447 bp, Homo sapiens
aaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccaggtactcaggaggctgaggtgggaggattgcttgagcctgggaagtcaaggctgtagtgagcaaagatcacaccactgcagtc

SEQ ID NO: 243137 - DNA, 429 bp, Homo sapiens
gttgagatcgtgccattgcactccagcctgggtgaaaagagtgaaactccatctcaaaaaaaaaagaaagaagaaaaaaaaaagaatttcttaacttacttacatttcctgcctctcctgaaacttcatcacactctctttcgcataagactttacccccactttcttaccacctggagtaataggaagtgagcatttgttgcatgatatcaaatctcaccactcttctgttagttcctcaatcatacaacagaatccttttataatattggtgaaagatagactattacagtcacatattcttcacatggcaaatggggaaggggtccttttcataggcatcaggtatttgggcagtaactacagaggtggcctctgggagagaagtagttcaatggagcttgtaaacattaatcaccaagtcaaaaa

SEQ ID NO: 243138 - DNA, 372 bp, Homo sapiens
cttctggtaactctgaacaaggtataattattttcagatacattttatttatgagaaaactgaagctcagataattaaatgacttggctctgttgatatctgagtctagagagtgaaaccatggagatcttttagtagagccacctgtcaggaccaatatatcactgaggcatattgttttcacacttgtctccctgatactcttcccattctcctttggcccttcttcaaagcttcatttgagaccctggattttggcttccaaatcctgataaaaaataggaaagaaaaagtatggtgtaatatcagagcactgaactgggttctagtcccagccaggccacaaacttggttacgtcattgagcaagtca

SEQ ID NO: 243139 - DNA, 319 bp, Homo sapiens
ttcctgagtggctgggactataggtgtgcaccactatacctggctaattttttcttattttttgtagacatgggggtctcgctgttgcccaggctggtctcaaactccttgccttaagcagtcttcccaaagcctcccaaagctctgggactgtaggcatgagccactgcatctggcctcagcatgattaaacccatgtaaaccccgctgaccagagctcccacgcaaagccactggaagctggctgcatgtgtttgacatcatgtacctcttttcctcctttgggacctcaaattgaaccacaaacttaacaaactgc

SEQ ID NO: 243140 - DNA, 454 bp, Homo sapiens
tttaaaaaagacatttattcagcgtcacgatcagactattacatttagcaatcaacagcatgggtgaaaaaaaaatctacattaaaaccctttgttggaatgctttacactttccacagaacagaaactaaaataacctcttatacaattagtcacaaatacagtcctcaagttttttgcccatacacgagtatttgtctaaaacatgacttgtttgtagcagctaggccttgccaccactgtgcttggctgagttcacaaacctcttgtaacctgtagcttccttgtcacttctctggctctcccttcctgctaagctttgtttactaattaaaatcttctgccaaagccatagctgctgctgctactggatccaccatagccaccttggtttcgtggtttggcaaagtattggcctccaccaccacaggggccagagcttctgcctccaaaa

SEQ ID NO: 243141 - DNA, 1122 bp, Homo sapiens
cagatagtgagggtacgaaagtccttggtaaggttttccttttaataaaaagcaacccccaaatcattttcttttctgacaaaaagcagcctgtaaaatcgagcctcagacatagacaagcaaactggaagcttgtacaggcgaatgccagcagttgtgccgataggaatatactacctgggactaggtatgttcaaaatggtggctcaatcttctcttttttgccagccgcgtgcacagtaaggcacagacaagatggtgctggccaagtggaaagcccacttgtataataagtttaggatcgggtgaccagccttcccagtacattctataaatgtcacaactggtcggaccaacctgtgggccctatgtaaatcagacacagcctcccgaagcctgccaataaaatctgctgcggtctgccacatttcccttttcagacgcctctcttgtgcacccgtgagagagctgctctcctctctcctttcttttacagattaaactttccgctccttaactcacacacatgtgttcgtgtcttcaatcctcttggcactagatgatgagccctgggtatttaccccagacagtgatgccacttcacaaggaaacagatgttaaagcccttctcagagaattttccaagagtaaagctggtgatggatagccaaacattaatcagcgaaaaggagtttgacctatagagccaaggagaagttggacaaagaacgtgaaaaggacaacaggcaaatccaatccagtgaatgagagctcaatgagaatcttcaaaggaccacagtatgctgtacaattttttttaaaaacatctagaagggtattttcatggattgatttttatggatttttataaatatttttcattggttaatggaagccatccataaaatgaataatatttaatctattctttccacttcaatggaatgttagataaataaaatcaccattgactggtgagtttaaggtggatctgtaaacatttttcaaaaagaagaaaaaaaagtcgtagtttatttttttcagaagcctacagtgaagtctatgggcatatgggaatcagaaaacataactaaataaaattttctctatgatatctaaaaa

SEQ ID NO: 243142 - DNA, 375 bp, Homo sapiens
ggagagatggggatagcttccttgaggaagtgaagggtaaattgagatctgaaggcacagtaagaattaactagacaagggcagcaggggagagggaatagtagatgcagaagtctggtgctgaaagggtgcttagaatgtttgaagaagtttaagcatagagaataggctggaaagtgagccaaatgaggctgaagagacaggctggggtcagattggccggactttgtaggccacaataagggattttgtccttactctgtgagcagcaggagaattgcttgagcctgggaggcagagggggtggcgagccaagattgcaccattatactccaggcctaggcaacaagagcgaaactgtctcaaaaaaaaaaa

SEQ ID NO: 243143 - DNA, 397 bp, Homo sapiens
ttaagcctacttttaatgaccacgtagtattccattatacattcatgcttccaaagttatttagccaatccctgttgtttgatggtgcagcagcttcctgtcccttgaacgtcctaaacaacaagagacctgccttttggttatatttcatttgacttgaggctatagtcaggaaaggagcatgtttttatattgtttagcagcttttctttggtatttgtttctccaagttaaaatcactagcgattctgatgggagaggggtaggaatagcaagaaatgttttttaaatggagcagtgaacaatctccccctcagatcaggaacaaagcaagtatgtttacccttacatgtctgttctacattttactaggggactagccagtgtaagcacacaa

SEQ ID NO: 243144 - DNA, 469 bp, Homo sapiens
taagtacagcaatcctctcctatgcttcctaggttcaggacacactttttcccttgtaatccacttcaaagagattgtgctatttcgttttctggcccttgagtccataactttaactttcaactgcatttggtttagcaacatattatgccaaacaagcagaatgaatgtttaatgggatttataatgaaagaatttctttggcaattgcaagatggctgaatgattgaataggaagtaaagaataaagactaaaggtatttgaaagtccctgtctcttacctctctccctgactgaatattcagctagccaattatctaaaagacaactggtatttcatttggaaatgttggccaatattctgaatattttactttattcaatatgtagctacttggaagtcatccaaacaattaataaacacttaaaaattttactgtggatgtttgtctttatctaaaaaatcga

SEQ ID NO: 243145 - DNA, 421 bp, Homo sapiens
attggcttctaccttatctcatcccatacagaattttgggtggtgaacaaagacctataagatttggccagagaactctctgagcagcagattaagtggagaatgaggcaaaaattacccccacgtaccaaaaaaggaggcagcaaacaaacttacttgctcctaagcttcctggtagccaatcgggaaagtgaaaatagaacagctacacagattataatatccatgagatttttaatttttctccaaaggaattcagtaacttttcatgtgtgtgagtgtgtgtgtgtgtgtgtgtgtgtggctgtagagcatgtctttatgaagacagccctttatgttactactattactgccaataataatcctcacagcaaactcatgaaataaacatgatcattattcccagttgacaaatgag

SEQ ID NO: 243146 - DNA, 381 bp, Homo sapiens
ctttttcttgtgttggttttggtcagttatatttccaagaaatttgtctatttattctaagtcatcaaatttattattgtaaagttgtctgtgatacctttgtattatttttataatattttcaagatctgtagtgatacctctcttttcattactataattggaaatgtgtatttttaacctttttcttcccatcggcattgctagagagttttccacatttttaaagtttttcagagaataaaattttgaatttctccattgtatgtctggcatatttgccattaatttattctattaccattcttttgttctttcttctacttcttgagattgattaaccgtatttgtttagcttcttgagatgtcgacgcttacatt

SEQ ID NO: 243147 - DNA, 266 bp, Homo sapiens
cctctttctcagtagactcaagttcagcccacatattacatcaccaaaaattgctggagactgggggcgggaatctccttaggatttcctctttgtagccttaaataggggggtgggatcagcaggaggttgaatagttttgaacaaggagagattgtgtgcaggttgaaggaagggcaccatctggaaacaaactatcatagttcagcgggcaattataaaacaaacattttagtctgctggccagagatcttttaagttgaata

SEQ ID NO: 243148 - DNA, 475 bp, Homo sapiens
atcttgcaacattcattcccagggtcgctgtaattggttcaactccatacaaaaaaatgaggaagaagaagaggaagaagatgaagaaaaagacgattctgactacatagaacaggaagtggggcttcctcttttgacaccaatctctgaagatttaggttattttacgtaactattatcacacacagacacacaaacaatataatatactgtgtgcattatatagtaaatatgagagtcggaaagctctaaaaactggacaggagccaaggtctcatcctcttcccattcatgttctgggatgatagggagtgaagaatgtagctggccacatcaatgttctctgacagaggttgaaggagtcatgcagacaggaaacataagttggctgtagcgctttctggaaatgctgacaattgtctcctttattattcttgtcttgcattctgcagaccataaacaaatggcataaata

SEQ ID NO: 243149 - DNA, 459 bp, Homo sapiens
tgtctcctttttgcatagtcatgaatgtgttgaaagtgctggggtgtctggttctgaaaacattaagatcataagtttgtatttatgactacatataatatttcattaaaataatcttagcaataaagagcaagaattgaatttatttatttatttttaagatggtgcctcactctgtctcccaggctggattgcagtggcgcaatcatagttcactgtagtctccaactcctgggctcaagtgattctcttgcctcagcctcccaagtagctgagactccaggtgcacaccatcacacctggccaattaaaaaaaaaaaagttgtagagatgggggtctctctttgcttcctaagctgatggcaaactcctggcttccagcatttctcctgcctcagcttcccaaagtggtaggattacaggcgtgaccaatcacacttggccctacatttttttttt

SEQ ID NO: 243150 - DNA, 322 bp, Homo sapiens
accagaagacccactgtagaataaatgctaaaagaaattcttcaggctggaaggaataatatcaaagggaaagctggaattgcaggatgaagtaggaacaacagaaatagtaaatatacgggtaattacaaaagatttattttttctcctctcaaattctttaaaatacatgtgactgttgaaagcaaaagttataacattgtcaggaaggaggttcagtgtatacggatgtgatacatgtgacaactataacataaaaagagagggtaaatggacctgtacacttatagagcctttacattctgtttgaagtggtaaaaga

SEQ ID NO: 243151 - DNA, 395 bp, Homo sapiens
ctcaaactcctgacctcaagtgatcctcccacctgggactccccaagtgctgggattacaggtgtgagccaccacgcctgaccacctttattgatttttgaatgctaatccaacttctccatgctagaataatcttaacttgttcaagacatgtaatcttttaaaaaatgtatattcctggattcagtttgttactatctcaagatttttctcactacattcatgaatgataatagcctgtaattttcttttttaaaaaatttccttgtgttgtttgtttttcctcatcgttccctaatggtttggtattaaggttatacaggcctcataaaatgagtttaacattgggattattttcccttgcatgtttagtagaattaactggtgaaaacatc

SEQ ID NO: 243152 - DNA, 402 bp, Homo sapiens
cggtagtattaataggagagcaaagagctctggacgagccagaagtcattcctattccacctgcattccctaccagcacacatgtggttcactcagacgggctcaagcaggccaggcgaagccctcttaagaggcagagatttctgttcctgggccaatttaattatttaaatttttgcaaacatttactcacattcgatggcagatctgtctgctaaaattagacagtcctacagtggtcacaaatgacagattcctacaatctatgaatcttcaagggtactccccaatcctgctgtacatacaaaggggttacaattagaccactcattgtaaaggccaattatatgtcctcagtaaaaagaggggggcagtggtgatctggagcctgcttataccagc

SEQ ID NO: 243153 - DNA, 408 bp, Homo sapiens
gagtacaaatcttcacaaagcacccgcatccaatgttccagtcagtagtcagttaatgctcctgcaaacgtatcatttcctctttggtttttccttttcaaaaacaacctaaatccaagtgcgttcttccccgttcttttcaaaatccttaattttaattcatgaatttacatcaccgataccaaagcaaaaacgatccccgacgcctgcccggtacaaagcagttcggcttgcggagcgcgaaagggaggtgcgcacgccctctggcggcgcggccccgtgcgtcccagacgagccggcaccggccgcgaggacccgccgccgggaccccagcctgcgccgcaccctcgcgccctgcgcccccgcgtggcctgcgcccccgccctgccccgccccgccctcccgctc

SEQ ID NO: 243154 - DNA, 459 bp, Homo sapiens
tgcctcagactcctgaatagttgggaccgcaggcatgcaccaccttgcgtggctcctgttcagtttttaattgggttgttgttgagtttgaaaagttttttatatattctggattctagaccattttcagatgtatgatttgcgtatattttctcctgttcattgtcttttcattcttttgatattgccctttgatacacaaaggtttttaattttgatgaagtccagtttatccattttacttttgttgcttgtgctttggtgtcatatctgacagaccattgccaaatccaagttcatgaagttttacccctcttctgagagttttagaagtttaagttttagttgatatatttaggtctttgatctattttgagttaatttttgcacatggtgttaggtaagggtctgacttcattctttcgcatgtggttatccatttgttcatcaccatatttt

SEQ ID NO: 243155 - DNA, 204 bp, Homo sapiens
catccaaaatgactactaatcaggataaatttatctatggatctgtttggtggatatatttatatatctaattttaacaaattcatgaggctgtgaactcttatatttcagtttttacttaattctgtatcgctatcattctgtatgccattagcatccttcatatgtggtatttattcctttgcataaatgtgttataactgg

SEQ ID NO: 243156 - DNA, 253 bp, Homo sapiens
agagcccatctcttgaagtggggggaaaaggggaaaaatcctctacggcgtttattctggttctgggtgggccagggcttcactgttttacattcccacccacagtgtaggagggttccagtttctccacatccttaccaacacttgttattgtccatctttttcatgtagcagtaatttctttggcttgttccagaatcttacatttttttcttacataaaaattggtatctaataaatatgagtagatctc

SEQ ID NO: 243157 - DNA, 643 bp, Homo sapiens
tgtaaagcatttcttcctgatacttaagcagtgccttttagtgaatgttcaggtgtcttttttctccagtgttaatatgaaaaacagttcaacaaaaatgtacacatattctattttaaaattacaaaatcttaccaaattgcctcaggaaatagctgtcactactgcattaattctaattgttcagtcaatatttattaaagtctcatctttccagatattatgcaagatcctggggaaactagatacatggaaaagcccttccttctgagaggctcttggtctagtgtgtgtaaacaaatatgcatattgaaattctgctggtcacccagtaaacacatatttggtacttgggactattgccaagcaccatgaaggcattggtccttgtattcaagattgcattctaaacatgagcaatttttaaaaatagtactgtgtaaatgtttataaaagagtgtcgtacagagtaagtactgccaaggtacttattttgaagtacttgagaaatgagaaggagtagtcagagggcttcgaagtggaagtctcccagtccttctctcagcagctagacttgctttctacttaatacagccattgatgagaatgctttcatggaactgtattcctagtatacttgtct

SEQ ID NO: 243158 - DNA, 509 bp, Homo sapiens
tctcttcatatgcagtcatgcattgtttaacaatgaggatacattctgaaacacgcattgttaggcaattaagtcattgtgtggacatcatagaacgcacttaaacaagcctataggctttgtggtgtagcctgttgctcctgggctacaaacctatacagcacgatactgtactgaacactctaggcaatgtaacacaatggtaagtatttgtgtatctaaacatagaaaaggcacagtaaggctgggcgcagtggctcatgcctgtaatcccagcacttgaggttgggagtttgagaccagcctggccaaaatcaggaaacctcatcttttctaaaaatacaaaaattagctggatgtggtggtgcactcctgtagtcccagatactcaggaggctgaggcaaaagaatcgcttgaacccaggagccaggaggcagaggttgcagtgagccgagatcaccccactgcactccagcctggggaacagagagagagactccatctcaaa

SEQ ID NO: 243159 - DNA, 660 bp, Homo sapiens
ctgtgagaagcccttttttaggtctttctgctctgttattcagatgtatacagggtataaataaagtttatgaccaaattgcaccacttgtgataagcaggattcacacaattacattcaccactccttagggaggacccattaccatgggcatacatagtattaactataaatgcatttagaatagtctttggcttagtatgtgctaaccaaattcagaaatataaaataaaatttgcataaacattaaggggaaaaaaaaagaataatacaatgaattgtgatgacctatctggcctttcttctttgaaatgcagaaactccaccaaacacctcttttggtcaaatggtccctggtcccctttagtttccaggctctcccatataaggtggctaaaagttaaatttgagtatcttagcttagaagatagttcattcaattcaaaatgcatttcttgagatgataaaaaaatatatacgtaaagtaaaaaatgactaaggtgttcatgaagcaatacgataagtagaatatctagggatgatggatagggagttgattttaaactaaacaaccaccaaaaagctatattagtgtttcgtgtgtacatgtgtaaatgtacctttcatttcacaacttatttttaaataagtaaaaaaaaa

SEQ ID NO: 243160 - DNA, 448 bp, Homo sapiens
gtcgagctgcgcggggctgctggaagcccaggcgggggaagggggccgtgtgtgggggcgcagagcgcccttgagccttacgcagaggtcttgtgtgttcctagttaagccctcccacgcccgaggccccatcgcttcctctccaccctctttacccaccaatattccaagcccagatcctaattccccaccgcattaccccgccctggatttggggaatgtttttctttattttaatatagctcaaggaaaaaatacgtatatcttgagagatttggggtggggaaaacaaaagccttgcggagtagaaaaaacaaaggcttatttttataaatgtttaatgttttcaccccctggatgctccgagacgccgtaattgtgacggcggggtacgtgtgccataaatcatttagttgctaataaaaattctgcctgtttgccctggaat

SEQ ID NO: 243161 - DNA, 139 bp, Homo sapiens
tatgtcagaagacggaaggatgctgagaggaatttgagggaatgggccttgctatgtttcctccagtttactatccttagttcatatcctttgtcctatcacattttcccacaacactccactcttcattaaatcaaat

SEQ ID NO: 243162 - DNA, 384 bp, Homo sapiens
gctaataagatgctccacaaacacttattggatgaatgaatggttagaattccaggcaactcacttgctcgctccagattaagaactggtgttatgggctgggcgtggtgacacacgcctgtaatcctagcactttgagaggttgaggcaggccaatcacttgagctcaggagctggagatcagcctggataacatggcaaaaccccgtatctacaaaaataaaaaatttttaaaaaaattagccaggcatggtgatgtgtgcctgtagtcccagctatcaagggggctgagataggaggatcgcttgagccttggaggtcgaggctgcagtgagctgtgatcgcaccactgcactccagcctggaaatgagactctgtctcaa

SEQ ID NO: 243163 - DNA, 507 bp, Homo sapiens
agaaatgttgttccatggggcctggggatcagatcagccagacagaaggaactgaaatcagggttcttgaccttggcactattgacaccttggggtagatcattccttgttctgagtccatcctgtgcattggaagatgtgtagcagcatccctggcctctacccagagatagatgccagtagcagtccccagttgtgacaatcaaaaatattaatactccaggccaggcagagtggctcatgcctgtaatcttagcactctgggaggccaaggcaggtggatcacctgaggtcaggagttcgagactagcctggctaacatgatgaaaccccatctctactaaaaatacaaaaattagctgggcgtagtggcgggcgcctgtaatcccagctactcggcaggctgagccaaggagaatcgcttggacccgggggcagaggttgcgatgagccaagatcgcgccactacactccagcctgggcgaaagagtgaaactctgtctcaaa

SEQ ID NO: 243164 - DNA, 671 bp, Homo sapiens
tccaactttccattgctcctaagacaaacctcacgtcttcagcacagcctccaagctatgcacaagctgtcacctgcccaggactccgcccctctctcctctcactccaggttccatcccttccctcccttcctccagcaacccaagtgcctcttgctacaggccccgcctggtcttttccatgaggtgccatcagccccatttctggaagaagtaagtgtccctgtcacacgctcctgctgcccccctctgcatcccggccctgacagcaaggctgcaggtagctgtcccagaaggagagggaaagggctcagcgcacccatcttacgtttggaaaactgccacctgcttccaccccacagggctcagggagctgcttcagagccgggtaagggtgtgagctgcagagccaactactggcactttctgtgtgatcttgagcaagccacatcacctccctttgcctcagtttactcatctctaaaatgaagatattgggccggatacagtggctcacatctgtaatctcagcactttgggaggcctaggtgggcagaggtggccatggctgttcggggttttggggtggggtgggggtcctgttctttgtaccttgagctcaggagtttgagaccaacctggacaacatggtaaaaccccgtctctaccta

SEQ ID NO: 243165 - DNA, 462 bp, Homo sapiens
ctgaagtcctttccgttattcttctttttaacatagagaagctttattcatattttgtattaatatttttctatataaaatgtgcctttggttctttttatgacttaaattttatttctgtatctcattgtgaggggctatcctgtgcctgtacccactagatgccagtagcagccccctagttgtgaaaaccaaaaatgtgttcagacattgtcacatgtcttctggggagcataattgtccttgattgagaaccactggaataaagaaaactaatatattagactttagtttctaaagatttttctgatcttcttaggtgtacttgctgttgcttccttgatatttgtcaaaaagcgtagagataaggagaagtcctccctgctatgtggttcccaaccatcccaccctcaaagcattcttcaagtctttttcaatatcaggtgttggaagtttaagaga

SEQ ID NO: 243166 - DNA, 1159 bp, Homo sapiens
gattcatggaaaaacaagatagattgttttggagaagcaatttggtgtggtgattaagagcatggactctgtagtcgggttgcctcagttcagaattctgtgaatcatttactggttctgtgaccttggagaagttactcaggcttttctgtgccttggtttcctcctgtaaaatgaagataatggtatctacttcatagagttgtagggattaaatgaatgttcatgtgtgtgtcacttaaaagaatgcctgccacataaccctaaaaaatgttgctactttttcagtattatttttactacttggaaagaataggtcatggatagtaagtgagagatgacagcaattggagatttaaagagacaagttaataaaagaactttaaaggtcatgaagtttagtttccctattttgcagtgagaaatttacaacaaaatgtagtgttagcattttgtccaacatgtcgcctggttgtgttaactactcagaaggagcattttaggacagttaagtgtaatgtctttgttggcttaaccaaacagaaatcagttaagcgttattaatgatgtggcatgcatgcatgataaggatataaaatatcctgatttattgaaggaattaaaaagggaatttttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatgga

SEQ ID NO: 243167 - DNA, 574 bp, Homo sapiens
cctaattttttttttaatagagtctcactctgtcgccccggctggtgtgcagtggcacgatctcagctcactgcaacctctgcctcctgggctcaagcaattcatctacctcagcctcccaagtcgctgggattacaggtgcccaccactgcgcccagctaatttttgtattttcagtggagacggggtttcgccatgttggccaagctggtcttgaactcctgacctcaggtgatccgcctgcctcggcctcccaaagtgctaggaccacaggcatgagccactgcacccagcctgttctgcctaattttttttaaaccatgcattaatgatgaaatagtcaccgctttcatgacagctttccttgctctccaaactgtgtattattaccatctcttctgtattctaggagaggaggaagagaggtgtatatgcctctttatagcctgtgtaacattctgttttgtattacagccatgtttgtacttgggatggggaccttagcatctcttgttgaacagagcgctttatacacaacagaccaacacgtttggttggatgaatggtcatattc

SEQ ID NO: 243168 - DNA, 510 bp, Homo sapiens
aaaagcgtacacaagaagaacacaatttatgaaatacaggataatacaggatccatggatgtagtggggagtggaaaatggcccaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggaaaaaattt

SEQ ID NO: 243169 - DNA, 483 bp, Homo sapiens
aaaagcgtacacaagaagaacacaatttatgaaatacaggataatacaggatccatggatgtagtggggagtggaaaatggcccaatatcaagtgtgagaaaggagataaacttcgactcttctgccttcaactgagaacagttgaccgcaagctgaaactggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggaaaaaattt

SEQ ID NO: 243170 - DNA, 370 bp, Homo sapiens
ctgctttttcctacaaagtctcagtgctatttatggttctgttgttcctccagaattttgaaatattgctgttttgttatgtttatgagatacagtagttagcgtttcttcaatataataatgaatggaaggtttcttttgttttacaaatgatttttttatctccttccctagtcctgtgacatctctaattctgactttattattaccaagttgcttgttaaatgtcttcaatgcaaatgaaggttatttttcatagaaaattaaagacacatctgcattcaagttatatagagtttttttttaattttggccccaaaatgtatgcttttcatataaggcagaataaactgtattatttgaaaagata

SEQ ID NO: 243171 - DNA, 499 bp, Homo sapiens
cttttacagctttgtccaacatcaaaatcaggtccatatataagacagtttctagccagtgttttataggagtgatttctggatgtggtatctgtaatgtggccaagataatgtgaagactctgccttctgtgggtcggttatagacaagtcacttatgttaccatcttgtcaacaacttgaattcctcagtttgtcctttttctggttacttctttcttatccaattttttaaaaaatgaaacagttcagtcagagcaatgtgtgcaacttattagcctgaacagatgagctaggaaagtcatctactctccatattcctgcatttaacaactatttattcatgacctactaagtgcaatacactctgtaggccctgaggatagcgtgataagccccatagacacagtttctgtcctgtgaagtttatactctagtggagaagatagtaattcagcagtcacaaagaaaacataaaattgtaactctgcccattacaa

SEQ ID NO: 243172 - DNA, 528 bp, Homo sapiens
cattggatgctgtgtatcatcaaaaaaagcttctggttaaaatgtgcatggaattcagcattaaatcttgaatgtaagtgtgctagtttggtagaattttcctaaatgtattgaatgtaatttataaattatcaagggaaattgttttagaagagtttcagaaagtatatagtatatattataattattgattataatgtgaaacatatagtccttgaaatagtaaactctatgtttatgagaaagaaattcacctcaacattatttatatcatctattgaacctcaagttggtttataaaaatttttagagtttgaagtcatatataatgtataaaaaagaccttaaattgacaatattttttgcgttctcagagtgaaacataggctgggcgcagtggctcatgcctgtaatcccagcacggggggatcactttagcccaggggtttgagaccagcctgggtaacagagagagaatctgtctctacaaaaataaaaaaaaaaaggtttcaaatgaaacacaggttt

SEQ ID NO: 243173 - DNA, 713 bp, Homo sapiens
aggtggagcttgcagtgagccgagatcgtgccattgcactccagcctgggtgacagagcgagactctgtctcattaaaaaaaaaaaaaaaaaaaaaaaaaaaaaatttcagattgagagagactagaactcctccataaaaataaattaatttcatcacagctagtgctaagagattcctgaaacctgaaacctggaggtacttaggaaacaaggattcttcctgcatcgggtcctggatggagatcagacagttggtagtggtgttgcccctccctctttccttcccttagcaaataagtatttcaataaaatatgtgtatttcaataaaatgttagatcaggaggctctctttaaatgttattttatctatatcaaacacatttaaaccatcaaagcccagacataccagcatatgttgtggcatgccccagttcatcattttgtatgcttaaatcaaaatacttagcacttcagaaaatgatttaccatcaagttttaaatagctacctgatatcatatattctcttttaatttcacagcacattgaattcactgaatatcaagttccagttcctgtggtaaagaatctctgtagtagagtttatgtgtagcatttaaggtatacattgctcctattctgtgcttttcccaaattattatatatttacagacatagttctttgaagcttagataaattataaacaagtgt

SEQ ID NO: 243174 - DNA, 381 bp, Homo sapiens
gtctctcagaacaagacagcatttcctgcattctaggaggctctctaattccccttcccagttactgctatctccggctctcaagggccacctttgttctgacttgtattaatgtagattagttttgcctactatagaacttcacataaatgtaatcatagagtatgtactcctgtgtcttgtttctttcactaagcattaaggctggtgtatgcacattgttacatgtgtcagaaatatgttgtatgttatttttattgctgagtgatatttcattggatgaatatgtcataatttaccctttctactgatagacatatgggtttctagtttttttctgttatgaataaaactgctaatgaacatttttgtaaagtcttt

SEQ ID NO: 243175 - DNA, 282 bp, Homo sapiens
cccaggagtttgacactagtctggccaacatagtgagatctcatctcttttaaaaaaaaaaaaaatccagcttcagattgcaaaccttccctccacctgaggcgaagctggctcttcttcctgcatgctccctttgtgcttcctttagaccatagtgagcccctaaggttatttagttttactttcctaagaggccagcccaggatctggttaaagaaggtctccctaaacatcgggtaaaagtacataaataaaatggttatcttggtgagcagtcccttt

SEQ ID NO: 243176 - DNA, 621 bp, Homo sapiens
cctcccaagtggttgggattgcaggcatgtgccaccaagccaggctaatttttgtttgtttgtttgtttgtttgttttttgggatgaagtctcactctgttgcccaggctggagtgcagaggttgcagtgagccaagattatgccactgcactccaacctggaccacagagcaagactccatctcaaaagataaataaataaataaacaaacaaacaaacaaaaattggatttgaacccctttctcttctcagcctccaggctcagctgaaatgccaaaacatatatgaacaaaacagtttccccagttggaatgtttattttttagacagggtctcattctgtctcccaggctggagcaccatgatgcaaccttggctcactggagcctcgacctccagggctcaagtgatcctcccacctcagcctcccagttagctgggattacatgcatgcaccatcatgcccagctaatttttgtatttttagtgaagatgggatttcaacatgttgcccaggctggtctcgaactcccgggctcaagcaactcatctgcctcagcctcccaaagtgctgggattataggcatgagccaccatgcccagccttgataataatttaa

SEQ ID NO: 243177 - DNA, 423 bp, Homo sapiens
tgatgaaaaatcaaaatgtgtgagatgcagttaaagcagcattctagggaaaaatgtttcaaatcaatagtctaaactttcatcctaagaaacttagaaaaataacaaattaaaccaaaagcaagcaacaataagcaaataagaagcagaactcaatgaaatcgaaaacaaaaacgagagaaaaacatgaataaaatccaaagatcaagtaaattaataaagctctagacagaataagagaagacgcaaattgccaacatcaggaatgaaagagaacatatcagccgggcacagtggctcacgcttgtaacccaagcactttgggaggctgaggcgggtggatcacctgaggtcaggagttcgagaccagccaggccaatgtatagtgaaacctcatctctactaaaaaattacaaaaattat

SEQ ID NO: 243178 - DNA, 450 bp, Homo sapiens
agataataatttaagaattctgccaatctgtattcgtatgtttcttcccagttatgtctttaaggcctaagaccagacactctactgccctgtgcctgcctttggagcttgagcggggaaagggacagggaggagggaggtaggggttagggatagttccccaaggactgccaggaggaggaatgggtgctgggcagatgaaaacaccagcatcctccctagattctcgatgggcaggaaaccccaccttccctctttcctcttcccatcttccttattcccaaaataatctccccccgtaacctgagtgctgcatcagcctgggcagtgatctgatactctgatttatatactttaaaacaaaggtgtaaataatacacaagtcccctagggatcttgtaatgaaaagaagagtttaatatcccaaataaaactctaatgaagagttta

SEQ ID NO: 243179 - DNA, 521 bp, Homo sapiens
tttaactatacgaagtacaagaggctgagtaagcttggaatccttagaagatcaatatgctagttctggcttatcattttacaaaactgaggcccacaaggaccaaaaggctgtcacataactggcaggtaactgtgtcacactatgaaggtccttgcgtttagtcttttctcgagagcaggaaatctaggctcatagcaaaggacagggtggtgcgtccttctgggaagcattctgctcttgtccgtcccaggattccaaagggtacctccgtacctcagttatttcccttacaccgggacatcagttacataaacccctcctgatgtccgacctggctcacaataaataatcaacactggttcacttagaggtttctggtcctaacgaccagtccacagagcgtccacgaagacttccagaggccagtggtgatgtggggaataaacccgcctaaaccgaattaaaccagcctttcctcctcggagtacaagaaggtaggtgaagccgacgcggctttt

SEQ ID NO: 243180 - DNA, 459 bp, Homo sapiens
caggagggaaagcctgtggaagaatgctttttttaaatcgcttattctgtggtctgcatgataaatacattatttacaaatacctacagcttttgctatcccttactagttaaatattattttgcaatgcagtctggacatctgtttcaaaatagaacaaaactgttgtattttttagtttgtatactgttgtctgtcagagtggctataatcacatttaaaaattaactgtgtacaaattacagatttctttagaaagttggttgtatacattaactgtgtatatcctactaacagatatagttacttctgagacaattaatttgacttgaatataattagtacattagatgagataattagctgttttatagactacctaatattgtcatgaggctagcaaattgtttcaaaaactttatcttttataatatatcgaaaaacattaactcctaaatt

SEQ ID NO: 243181 - DNA, 470 bp, Homo sapiens
acacatcatctgatattactaaataaggtaaaggctagaagggataaaggacaagactaacaaatatgactaaatactaatagaaaaagttccatatacaaaaaaagcaccgaaaataaaatcaacagacaggctgggtatggtggctcatgcctgcaatcccagaactttgggaggccaaggagggaggatcacttgagctcaggagattgagactagtctgggcaacataggtcctttttctacaaaaaaattttttaaaaaaattatctgggcatggtggtgcgcacttgtagtcccagctactcaggagcctgtggccagagggctgcaaggttgaggctacagtgagctgtgatcatgccattgcactccagcctgcacgacaaagcaagatcctgtctcaaaaaaaaagtcaatggacaaactgcaagaagtatttacaagtaaggatttatttcccaaataca

SEQ ID NO: 243182 - DNA, 720 bp, Homo sapiens
gaataacttaattcttaggagacacttaaataagaattatttctgttattgaaacacagttccagttacagggtctttgaaatcatgagagagttgtacagttatatttctgtatagtgtgaagagctatcttattttttgcagattacttactttgttaatatacctccccctcctttaaccaattggtccattattattgtaagcgtattacaaagaatactcttttggaagtcagaagaatgatacctaatctttaatttcttatcaggaactaggttttcattgtatgatggacacgatgtaacccctaaagacagaaaaagaagtgaaaaatagtcctcattctcatggatttatagctgtagtagaagaaaagatagattaaaaagggcataagttcctctaatgtttattgcaatgtgaagctagatagaaaaatagaagaaaacagagagaatcatgatcatggcaataaagagagagtagctaactcagctggaattggcctggagaaaacgatggtgagaactcccggagaacgttagaactgagctgaagcttgcagaatgcataggagtctggcaggcagatgaggcagggaggacattaaaggcaggaggaatagcacatgatagtgggctgcaggctgggctgtagtttgaggggctgtaattcaatacaggcggatgcaggggaaaagcaggcggtgaagtgaaa

SEQ ID NO: 243183 - DNA, 227 bp, Homo sapiens
ttttcatttgaagccggggttcattgcagcttgatgtaagatctaaaagaagactttggaggccctgacatccccttctaaggctattgccacctgtccagatgacaatagaagtcctgctggtccaacctcaagcctgaatgccaagattagcttccaattgtgtctacatttagcccatggagatggatgttttaactatcattaaagtgacatcctttcagtta

SEQ ID NO: 243184 - DNA, 435 bp, Homo sapiens
ggtccccttgcatccggacagaacccatgacttgcttctaaccaaaagaatatggcaaacgtgagggatgttactcccgtgagcaagctgcatcacgtggcacagataaggggatactgctcccatgactgccttaccttgtataagactgactcagggccgggtgcagttggctcacgcctgtaatcccaacactttgggaggccaacgcaggtggatcaccaagtcaggagatcgagaccatcctggccggcatggtgaaactccgtctctactaagaatacaaaaattggctgagcatggtgatgtgcgcctgtagtcccagctacttgggaggctgaggcaggagaatcgcttgaacctgggaggcgcaggttacagtgagccgagatcgtgccactgcactccagcctggcaacagagtgggactccatc

SEQ ID NO: 243185 - DNA, 499 bp, Homo sapiens
ctccgtgagacaagagatgctctcagggaaaagacattggctttaggaagtgtacagctggacctaaggcaagcacagcatcgaataaaggaaatgaagcagatgcatccaaatggagaagctaaagaaagtcaatccattggaaagcagaactctttagaggagagaatacgtcaacaagaacttgaaaatctcttgcttgaacgacaactagaggatgctcgtaaggaaggcgataataaagagatagtcattaatatccacagagactgtcttgagaatggaaaggaagatcttctagaagaaagaaataaggaattaatgaaagaatataattatttaaaagaaaaactgcttcagtgtgaaaaagaaaaagcagaaagagaagtaagtatgaagaaaactataaacttctggaaagaaaatttaaatatttcattctggctatatgttgaacctagttcaatatacaaataaatagatgaaaatgtgtttacca

SEQ ID NO: 243186 - DNA, 469 bp, Homo sapiens
ttttttgtttgttttttggaaggaggatatataaagtaattattactacatttttagctgttgccaagttgaaagtcagtgtttagttttttttaaaaagggctatttagtgtggaattcctaaatattatagttccctcttctgtcctttcagagctattgcaccctgttaaattttttttgcattcagttcaaccagtgtttgaaaattaccaatagacttaaagtacttctctgaagttagaagagctcctatgtctgatgctatattgctagtatttctattcaggttggaatttggaatagtcattatcaaaagttatttgtaggcaaaagaaaacaaaaagaaaaaagttatctgtaggaaatattggagactggggtacaaggtaagtgacacagtgaagaagcacagacaatttcagaatatgagacacctaacatggtttctgcaaggtattggcgtgga

SEQ ID NO: 243187 - DNA, 375 bp, Homo sapiens
tggagctctggaaggggtcagtggacaagtgggtagagccaacaccaattatagggttttgtcagcaaagaccaacatctttggggcctcaagtgtaaggccaggcagcccactgtctgctttggggcaagttacctatccttttagtgttttagtatctcaggtaaatggtcattttccctgccccgtggcatgggactcttccgctgatagctttaaagagtcacctttcattttgaaaatgaaccctcctgaaatggcaatggattgatgattttgggggttgggtcttagatacatgggagtttattatactattgcatttttatgtatgtttaaaattctccgtaataaaatgtattttagcaacaacaa

SEQ ID NO: 243188 - DNA, 454 bp, Homo sapiens
atcagatgatttccatagttttcatagcaaatggaaatggctagaactatgtgataattatgtttctacccctactgcctggtacagtgtatgtctcataatacatatttgtaaaaaaaaaaaaaaaaaaacagaaggtaaaaaagaggaatgaaggtgattaaactctgagatagtgttaggtggcaagttaccagggatcttgagagagcatgaagattagtaatttggaaaatcagagggtagtaagattggtaacaatgagcttctaactgaaatgcctaaggttgctaactatgtcatttaaatttgaggctgttttttccttcatgataatttggttctttggtccttccccaaaccttctcaagtcatttatttaagtagtacacagagattttgcaatatctttttcatttccaaaggcattgtatttcaaaaaactgtcaccatt

SEQ ID NO: 243189 - DNA, 462 bp, Homo sapiens
  misc_feature (374)..(374): n is a, c, g, or t
  misc_feature (408)..(408): n is a, c, g, or t
  misc_feature (454)..(454): n is a, c, g, or t
aaaaaaaaagccatgctattgtgtgacatttttttccaatgtttatttcccaccaaaaagtaaatgcattttaacccattctgtggttcactgtagcttaaggaaaccaagcatatagatgcattagtgattttgtttatattatgtaaaatgtaacgatctatcttagaaataccacagtttgtatttttctttaaggagtaaagatttgtctttaaaaataacttgatattttcctggctttcatttaatacaatggaaaataaagtattacacgaaaaaaaaattttttcttagagacagtatctcattatgttaccccagggcttgaagtgcagtggctatttcaccaggcacgattataggctccactnataggcctcaaaagtcctggggttccaaggcctncctgaaggtagctaggacctttcaagggtacaatggccacccttgncctggggt

SEQ ID NO: 243190 - DNA, 758 bp, Homo sapiens
ctggtgtattcttacaaaatttaaggaagaagtaatgcctattctacacaaactcttctagaaaatcaagagaaaagaacccttcccagctcactttatgaggccatcgttaccctgaggccaaaaccagacagagatattctaaaagaaaagtctacagaaaaatgttcctcatgaacatagatataaaacttctaaacagacgtttagcctatcaagtccaacaaaaacatgaaaagaaagacacacatggccaagtacattgtccttcccaggaaggtaagtaaggttggtttaacatccaaaaatgcaatgaatgtaactcaacatatttctaaactaaaaagaaaaaccacacaacaatctctaaagtggcagaaaaagcatttgacaaaatccagcatgtatacttgattaacactctcacagcctaatagaataaaacttcctcaagctgataaaggacatctacaaaaaccctacaattaacatgacacttaataatgaaggtctgaatgcatttcttctaagatcaagaacaagccaagagtatgttctcactactactaatcaatgttattctggagattctagccagggcagtaaggcaagaaaaagcaacaagtatagtaataatactgtcttgatgggcagatgacatgtttgtctatgaagaaaattcaatagaatctttaaagaaactcttgaaactaacaggtgagtttagcaaagctataccctatcaacaaaaaataaaa

SEQ ID NO: 243191 - DNA, 732 bp, Homo sapiens
taaaaaataaagatttttttaaaaaaaacaaacaaatacctcctgccccacaaaaaaaatttctcaccccatccaagtaccagtcactagactctaacaaacagttcggaattcaactggtgtccaaaaggttaacaacattaccaaggtgaaggaaccaaatcggtatcatacactggagccatggggaagcttttggaactaggatttctgagaactttttaccatatacagcagggaaatctttgtaaaaaggaggaaattggtatagtatattctgctgctggcacgaaacgtgtttttaccaaactaaagtatcctgtagttcaaaaatgttatcacaagattccatttgtgtatctatttaaagttttggtatattttcaataaaaattaataaaaatatttcttctcataatatgtggtttaaatccagattatttcacaatatgtggtttaaatccagattatttcactgtaatatgtcttgatagagttttagaatattgaaatagggtattaagatgctttaaatcgattactgatttgaacattgtaagtgtatatttctatttgtgtgtgtgtgtcatattcaaatatgattaatcatgtatgttggtgtgtgaacatatgcatatataaagcatttttatcagctgtttctggcttcataccacagagaacaatctgaactgtcaaagaaaattaaaccttgagtaagaattcctcaag

SEQ ID NO: 243192 - DNA, 516 bp, Homo sapiens
tcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaa

SEQ ID NO: 243193 - DNA, 504 bp, Homo sapiens
aaaaatatctggttagcatgctgtcttgaattcaaagtatgaagattgtgttggctgcagaaactttcatgaagtttctgatttctttgaagatttgggggattctaatcagtactctcaagggcttaaaggaccattgttaagaaagatggactgggttgattacatttagttattttaggttcactcttaaggttaattcctttgatcatagaaccagcaaccttgtacatgagcaaaatgttgatggttctctgggatgtaactcataataagctgtttgttgggccctttaaggtcatagtagaattcatttcatattgctgaaattgggaaaggcacaaaaatgtttgaagtgaatacacttacttgaaataacaagcatgaaggtacaacattttgttaaattttgggttttgggtaatgagtttcatttaatgcatagaggaggggaggacataaatatgctctccaggggtgtgagattgcagtgtttatcaaaaa

SEQ ID NO: 243194 - DNA, 413 bp, Homo sapiens
ggattcacccttggcactggtttttgtgtctgccaaaaggttacctgtgggtagctcagcctggtctgttcccacccatttggccttgattccctgaggcttagtaggaatatctgaccactatgcactccacagatcagcccattgcctgagataacagagagcttctcccagtaaacaaggatcaattatatacccagccatgttggttgcagctggcttacccataagtgccatatactggcaaacaggttgaactacacagcccaatataaaacctgccaatagaagtgcatagggctatgaaagcagagccaaaaacccctaaccaacattctctacagtcatacccacctgggtgggggtgaggtgtagagcaagggaaggaaaataacaccaataatattataggg

SEQ ID NO: 243195 - DNA, 360 bp, Homo sapiens
cccctagacctccaattatttctaaaaatatttttcaaacacaatgcctatcatataatcagaaataaccaggcacatgaagagaataataagggagtaataacaatcaagaattttacaaaattaataacaggcaacaaaccacagatccaagagtctcagatagcaccaagcaggataaatgccaagtaataatctatatctatagattattatattcaaactgcagaaaatcgaagacaaaatcttgaaaggagccagagaaaaataacacctgcctataggggaacaaggataaggattacattggccttctcttcagaaaacatgcaagcaagaagagagtgaagtgaaatatgt

SEQ ID NO: 243196 - DNA, 233 bp, Homo sapiens
gtctttcaaatcagataggtggggaaaaaagagttacaaacaaaaaatatattgatactgtcttttatgtttatctcattagctacctttatgagtgctctttacttattcatgtggattcaggttaccatctagtgtccttttatttcagcctaaagaactccctttagtattctcataggggaggtttggttacaaatgacagaaatcaaatttaaactagctcaggtgaa

SEQ ID NO: 243197 - DNA, 328 bp, Homo sapiens
aacccctggtaaaggaggtgaggaacttgctggggggagcacacaaacacctgctgatgtgcctgacttggatacccaggaagttgctggctttctcttcctttccccaacatttttatttgtttgtttgaggcagagtcttgctctgtcacccagcctggagtgcaaaggcgtgatcttggctgagtgcaatggcatgatcttggctcactgcaacctccgcctcctgaggcgggagaatggcgtgaacccgggaggcggagcttgcagtgagccgagatcgcgccactgcactccagcctgggcaacagagcgagactccgtctca

SEQ ID NO: 243198 - DNA, 381 bp, Homo sapiens
tttaataggcagacacaacccccactagtctcaggcatgaagcatgagccagaaagacactcacattatgcgactgagatttcagagaagttaacatagcaaaacttagttcacactaattcataatgatgtactaaaccttcatttagtcagttcaaggaacttatccattacctgcctagaatgaagggaattaaagtataattacgatgaagctgttcaggtggaagaagtagataataaaatttgaatacccttgctactaggaattcaccccacgaaaataaaacagttaaaactcattttccaaacatttactgagtacaaactatttgccagacccaaaacactgctcagtacaggatggctaaaggagaaaag

SEQ ID NO: 243199 - DNA, 592 bp, Homo sapiens
aaagtaagatgtagctgtggccatcgctttccaaacctgtatgaaagtaaaaatgctaaattctcatcttttgagcagagcaaatttatattgcatcttcatgttccattcttagtatgatgttactctattattcattgaataaagaataggtttgggttgggtgagtccttctgaagcccaaaaaaatcatttatcttaagataattattttttaatgtaattgtgacaaagcttataggcaggaattatgagactactgcaattcttttctaatattatataagatatgaagtatttcattgggggtcattattgctcacttaagccaaatagattataatttttgctataaaagatggctaaaaattagtatttatataggttgtccagcagtaggaaatgggaagtaatgaacagtcagataaaatgttaaggttcattataaggtactatccttataatactgattattattagactgactttgaatctcattttttaaggatgcttaggtttacatagctcagatcagctatcttatatcattgaaacaactgtcttaactctttgttacttaaaatatacatca

SEQ ID NO: 243200 - DNA, 660 bp, Homo sapiens
gggtcagaacctagtccagctcatccttcgatctgcaggaagcagctcattcagtaaaggcagcaccagcagatgcttaacagatgtttgctgaatggaattaaattgatagttcatctaaagccaagtctttggcatactgaagaatttctagtttgtttattgaattaacacttattttctgtaatatatgaagcactgggtgttgcttttttgataactttttaatatatgcataaaacagattcatccatcttaaataaataagataaagtacatggtacaagtttatgcttaataaagcactttatgctgatcagctaaaaaatagaatcaattcttctttaaaaatgagagtgaactctgtgtaaagaatgtgacccacactctgttttcgtctccttgtttttctctaaaagcaagtcttaatcgaccccacaggcaaacaaacaaaaaagatgaatgagaaactgtaaaaaatactgaacttataaagtgctctttataatatgatatgacaaagcttgcagaagaatttcaaaggatattaacaggcttctcacaaaagagatggaaataaacaagagatttcagttttgtactctgcacacttttgtatcatcgcttaaatttttatcagcagaaaaaatatttctttta

SEQ ID NO: 243201 - DNA, 471 bp, Homo sapiens
catttacctcatactctcccctagcatagtcatttgcattctggaaggcaagaccttctcccccatcttgtagtcactgtaaagccaagcatggtgcctttgcacagaggaggaacatggcaaaaatttattgttacaacaaattggtacttgatagtttttttaaattgtctttaagaaaaagaaataggccaggcgcagtggctcacccctgtaatcccagcactttcggaggctgaggtgggtggatcacttggtcaggagatcaagaccatcctggctaacacggtgaaacccagtctctactaaaaatacaaaaaattagccaggcatggtggcaggcacctgtagtccctgctacttgggaggctgagtcaggagaatggcgtgaacccaggaggtggagcttgcagtgagctgagatcgcgccactgcactccagcctgggcgacagagtgatactccgtctca

SEQ ID NO: 243202 - DNA, 937 bp, Homo sapiens
tgacttaaaaacataatacaaatctgcagtaatctagatagtatggtactggcagaagaacagacaaatagatcagtgagacagagtccaaaaatagacccatacagaaaaagtcatatgatctttgacaaaaggagcaaagggaacaccattgaaaaaagatactcgtttcaataaatggtgctggcgtaacaggacagccacatacagcaaaaaaagtgaatctagacacagaccttccactcatctcaaaatttaactcaaaatggttctgatgcctaaatttgaactccaaaactagggacttccagttccaaaatggcagtgtagaagcatactggcttcattccccaccaacagaaaacgaaaaacaaatatacagcactgagattgacaccagcaacaacccagagcccaagtatgaggatgaaatagttcctggggccacagagaagtggaaaaactccagtaggagaatcagacttccactttcatgatgcttctgccctacccttatgcccacacagaaaatctcccccacctcataatttctacactgaaagaagtaaaattgaagtggtcaaccatcttccccacctccttgggttccctggcaggagatctgtccttgccttaacccacaggtagcatcatgactgcctgcagggaaaatatcactgaagaccagcagagactattattcccagccccagaaacttcactgtgcaacttggccaaaggagacaccaaatcagaatggctgttcagcagtaccatgctgtaggaggtacatttcccaggtcctgtaggcacaaacccctacctagcctgccttcccacactgccagtgtaatccatttgggacattcagcgctccaaacatttactagagctgaggcaaacctgggcttatggcgccacctagagctgaaaagga

SEQ ID NO: 243203 - DNA, 167 bp, Homo sapiens
gtttttgcctagcaccagtaagacaagaagagaatgctctagtatttagaataaagggagctcagattttgaaatgacaactacagaaagccttactctaacttactggagaaatttaaaatcaagggaatctgaaatttgatcctatgaggattgtaaccagttga

SEQ ID NO: 243204 - DNA, 1255 bp, Homo sapiens
ggaggcggagaggcagcatccaccagcccgctccccgcctccaggacagagcctcggtctgcatgggggtgacaggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacatgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggcaaaag

SEQ ID NO: 243205 - DNA, 454 bp, Homo sapiens
cactggcattaggcggctttccaccctgggggtcgggcctcaccaaggttgggaatgctcaggctggggtctgccctgttgaaagcctgttggccccaaccctggggtccaggacacttttcttgaggggagaatgagggtgcagggctctccagtacaccttgctttctggtagtgaatggacacagaatgtaatctcagctgcccagacgcgggcagcagcagaagaccccttacccccagcgacctcttcagaggggcctctgggctcacccctctccttcaaccaccctctggggcccaagtgacactctctcttttgtgttgcagctcagtgccgccaggaaaagagaaagagaatccattattggtgaaaatccattttaagctgtcagcccccacaatcccagagaaatgactagacagaaccaataaagcctccagtgctggcaaa

SEQ ID NO: 243206 - DNA, 464 bp, Homo sapiens
ctgttatcactcgcgtgctacagcatggcgttttaaagcctacaaactctccttacaattcccccattttacctgtcctaaaaccagacaagccttacaagttagttcaggatctgcgccttatcaaccacattgttttgttgcctatccaccccatggtgccaaacccatatactctcctatcctcaatacctgcctctacaacccattattctgttctggatctcaaacatgctttctttactattcctttgcacccgtcatcccagcctctcttcgctttcacttggactgaccctgacacccatcaagctcagcaaattacctaggctgtacagccgcaaagcttcacagacagcccccattacttgaatcaagcccaaatttctttttcatctgttacctatctcggcataattctcataaaagcacacgtgctctccctgccaatcgtgtccgactga

SEQ ID NO: 243207 - DNA, 219 bp, Homo sapiens
atggtttagccacatggttattgtggggtaattcaaaggtgtcacctgacacctgagatattaaaaagtaaacatgggagagttatatttatttctgagatgctgtggaagcattcagtgctcattccattatattcatcaggcctcataatatattctcttctacactcttcaaccaaagggagcaggagagaacttggaaatgtaatagatgaaact

SEQ ID NO: 243208 - DNA, 493 bp, Homo sapiens
gacttcagatggccaccacaaacagaaaaggaagatagtgcatgtaatggatgcctgttgttttttcctgccaagcattcattcacccttctgattttccttgggaaaaaaacacctgtcccaatcatagtttctgtggctcagatgggaccatctgtgaggtccaggcctagctgatccacctcggccttccagtatactccatccatcctagacatttttctctttttaagaaaggtactcaattttaaatctcttggcatgggaaatttgggggaataagtaaatttatttctattggaactagaaattgagaaaaattgaaatttttttagcattctatcctttttcataatacagaaatgcaaacatagaaaaacagggaaaacctctgaagcactgctggaaaacaagatgagagtaccaaataacaaaaggtactaggaacatgtaaacctgtgctgctgacagctacctggtaccaggaaaaaaa

SEQ ID NO: 243209 - DNA, 480 bp, Homo sapiens
ttcagaagtatattgttctgcagtattttcctaatatctttttaataagtatagtgtctgtattgttatctcctatttcattcttaatattggagatttttgtcttctcttttcttatttttgtcaattttgctagagatttattaatttttttaagaacaagctttttgttttattgttttcctctttccaatttcactgactttttgccttatctttatgatttctttctttctgctggatttgagtttatttcactttttttcccctagtttctagaggtgcaacttacggacttgagatctacctcttttctcactgttatgaacaggactgggagacccaagatacctccttctcacaacatagctgctgctgctgtcacgtcaatgatgactactactgtacactgaaggcaccactatttaactactcaccattattacaccatttcaaattaaatgaatgtacagatttaaa

SEQ ID NO: 243210 - DNA, 363 bp, Homo sapiens
ctgttcttcctaaagcatcggccttcagtaacttcccaaatctgaggttctatcgtttagaaacagtaaggaaatatgtagaattcttaattagcatcacttagtaattaattgagtttgaagtgcagttataaactgaaaaacacgattactatcttggtatatacgaatcacttccttactcatctcttggcaatacttttagaaagcctactctctagattaagtcatttacttataactttaagtttaggagatgggggatgagtctctattaaaggtggttcataccaaaatacagaactcaaaaagatgcagaacaggctatccttctctcctatacttattaacctaaattaaggt

SEQ ID NO: 243211 - DNA, 448 bp, Homo sapiens
ccattgccccagagaaaagcagcctggctggaggagatgctgggcagaagcaggaaggaaggaaagatgcctggcgtggagaagacttagaagtgatgaccatcacctgttctctgaaaggatgggatgttatcacagcatatcatatatattgtatgttgcatctcagatgacatcatacatcaccttacatcatgtatcacttgtatatcatatgtcatatgttacatgccacatcatgtttcatgtaatatatatcacatatatcacatatcacataatctaccatataacatatcacatattatatatcacacgtcatataactgtctttcgtatttcttaatggatcacatcatatcacattatgtcataaatgacattatatcacatcacatatcatatgctatttgtgtgtatatagataatatatcatatcagatctggt

SEQ ID NO: 243212 - DNA, 416 bp, Homo sapiens
agaaacctggactttattctgtaggtggtaaggaactgttaagttttaaaggagggagaagccatgatcaatttttattgtatttaattgtttttcaaaacccaatgctggtattgaatgaaggttagtttgaaagaatgtaagaccaaagctaggaaaatcgtttaagaaaccattataattggccaaatgaaagataaagttctgtaaggcaatggcagtagtaccatttggaaaggaagaattaattgaattaataacagctataaaactttctgatcagttccatagaattggaatgtgcagaaaaggagactgtgaagagggttccccaggtctagcctaggtgactagaatatcttgaaaccattgaacaggataagaagtactagaggaataattgagagtaaagatta

SEQ ID NO: 243213 - DNA, 411 bp, Homo sapiens
gccatgttggccaggctggtctagaactcctgacctcaagtgatccgcccgcctcggcctcccaaacttctggggttacaggcgtgagccacttgcaccccgccctgtattttttaaaagcaccataagtgagtccaacatgtaatcagggttgagaacaactaagagagatagttatgttacaatggaacagataatttaggaagacttagttccatactcagctctcccactttccacttgtgagaccttgagcaacttacttttctctaagccttagcctccccaactaaaaatgagttgttgtaggtatcaaataaaacaataaatgaggtttccatttttaaaaaacaaacctcctatttgtattgcattttagtttagaaaatgcttttatatctactatgtcaa

SEQ ID NO: 243214 - DNA, 471 bp, Homo sapiens
gggatgtcctctgtgattcgtgcaggagggagacatagttctggtttctcgcagatggtcacaggaatgaggaaagaatgactctttggctcctagcagcagaatcttaactgagtatgacttagcatccttcttcttgctgtgtcatctctcttctcagggcagaagatatttacgaattagcacattctgctagcacatctgtgggaaaagagacacggtcttactgcgttgaccaggatggtctcaaactcctggctacaggctatcctcctgcctctgtctcccaaagtgctgggattacaagcatgagccaccaggcctggcccaattgcttcttaacaacttactattctttgttcactacagtgtatacataactgactttttctttggagcttcattttgtaatgaaggctctggtcacatgtaagacttgtattaaataaatttgcctgctgttctgttaaa

SEQ ID NO: 243215 - DNA, 388 bp, Homo sapiens
aggtcatcattcgtttcaggaagttgagtgaggcctgagacagcaatgtttcgtttagcctggcggtggccctccttgtcttcaagaagagcatccgtggctagcagtggaagatggggttgggccccagagacacggtcttactgcgttgaccaggatggtctcaaactcctggctacaggctatcctcctgcctctgtctcccaaagtgctgggattacaagcatgagccaccaggcctggcccaattgcttcttaacaacttactattctttgttcactacagtgtatacataactgactttttctttggagcttcattttgtaatgaaggctctggtcacatgtaagacttgtattaaataaatttgcctgctgttctgttaaa

SEQ ID NO: 243216 - DNA, 337 bp, Homo sapiens
aagaaaaaactgataagttggattccaacaaaattaaaacctctttctccccaaaagacactgctaaaagaataaaaagagaagctccagtaagatagctaaaacacagattgtcaataagcctttgaaaagatgctcaatatcgttaatcatttttagaaacacaaattaaaaccacaattagataacacacctattggaacagctaacatttaaaaacaacgactgatacatgtcaaggacacagaacaaccaaaactctcatacactgctggttagaatgaaaaatattatagccactctggaaaacagtttggcagtttcttataaaggtaac

SEQ ID NO: 243217 - DNA, 502 bp, Homo sapiens
ccaggattttccaatctctacaatgttaaggggttgttgtgtagttgcattggaagagagaaaggaaacacactctttcattgctgaattctaaataatgatgccctgaattagttctatgagaagtactggcagacagctgttatgtctgcagggcatcaaggggcaggtgtgtctcaccctactaagaattggcagaaatgttttaacctcttctttaggcatctggtgagtattgcagatcttcaggctgtccctaaaaggaggtaggtagccttctctgtggtcactgtgttggatttggaagaaaatataagtagatgttaaggtcagtgctctccaggagatttcaatccaggctatctgtgttcagggaatgatttgcaagaagttggtttatagacgtttactctggaggcacaagctggctgccatgctgagtaagtcctctttgtagatgatgtattttgcttgggcaccaacagaattaaaaacgaaaaac

SEQ ID NO: 243218 - DNA, 580 bp, Homo sapiens
caaccatgatcttctgttatccagaatattcagggcattgggttctcagatcaaaacaaatatttaaataagaagtcattaaaatcactttatattttttaattgatatcttatagaattacaatatgtatatgcggcatctaacatacatattcttttctaaaagtttacatgtcagttgtttgatacatggaacaccttttttgtacatatttaaacatatcaaggaaatagtcacattatcagagtagaccataaactccaatttaattgctagccttttttctggctagaccatctgatttgatatactttatatcaaatactatacactttataatgagtctcatcacattaaataacacaaattattaccccaagttggcatttagaaacaagggagtatgataattgtatagccgggaagattttaatagatatatcagcctggtgatgtggctcacacctgtaatcccagctactcaggaggctgaggtgggaggatcacttgtagctcagagctcgaaaccagcttgggcaagacagtgagaccccttcccttaaaaattttaaaaaataa

SEQ ID NO: 243219 - DNA, 585 bp, Homo sapiens
catagactttattgattgtttatctggttttttgtttgtttgtttatttgtatttgtagaaacagagtctcactatgttgcccttctggtctcaaactcctggcctccggagatcccccagtcttggtctcccaaagtactggggttacaagtgtaagccaccacatctggcttcactgattattttttgtcactttatcttgctttcctttgtagggcctctatttttgttctaagattatgctttatttttcatccttgtatagctcttcttttgttttcccaattttattttatatatttatttttgagacggagtctcgctctgtcgcccaggctagagtgcattggcacaatctcggctcactgcaattgtaagctccacctcccgggttcacgccattctcccgcctcagcctcccgagtagctgggaccacaggtgcccaccaccacccccggctaattttttgtattttttgtacagacggggtttcaccgtgttagccaggatggtcttgatctcctgacctcatgatccgcccgctttggcctcccaaagtgctgggattacaggtgtaagccac

SEQ ID NO: 243220 - DNA, 453 bp, Homo sapiens
gtcagtttcagttccccctctcgtgctagagtcatgcatctgtgacactgtcaggagtgtggggatttgagggtgttgcccacaagtgttttcatgactctttggaattcaaaaggacttttcctgaattgatagactcagttgataggtcacctgaaacagacccaggagacctgattgcatgtttgggcagaggtcagaggctcagataccagctgctgccccaccagtggctcagcctgtgacctcggaagaagccccctgactttcctgcctcagtttctcatggcagagaacagatggcaggtgaacatcataaaacattgggaccttatgaatactggtattttggtgtgagatttttttttttcctaccctttatccttattaagattaattcatgcttacaataatatattcatgattctcgaagcagaagaaagagatggaaca

SEQ ID NO: 243221 - DNA, 502 bp, Homo sapiens
tagagtgcagtggcatgatcacagctccctgcggggtagatttcctgggctcaagctatcttcccgcctcagtctcccgaacagtcagggctacaggcacgtgtcaccacgcccggcctggtccccataagtcccctcttctccgagccaaacatcttcacaccttctggtgatcattagtggagaggcctgtgagaggctctggtgtcaatgtccctgaaatcgagggctccaaattggtcatggctctccagatggcccaaacagttccagttcacaaacatttattgagcatctactacattccaggcactgtggttattataaatcactgagacactgtttgccctaaaggagctacgtgtgtttggtaacagcttcacagtaagtgacgaataagatagcattaatccacatttgacagcaaaagtaccaaaaaagaaagaaagaaaaagaagagagagaaaggaaagaaaagaaaagaagagaaagaaagaggccg

SEQ ID NO: 243222 - DNA, 765 bp, Homo sapiens
attttattataaatggtagagaataaagaagcaaaaaggcaggtaaggtttatatgcttcaccaatagtagtaaaatgtcaacaccaatagactttgataaagtatgtgtatataatgtaataactagaacaattcccaaaaaggttataccaagaggtatacctaacaacaaccaatattacacaagctcctccagaaaatagccaacattaccctgataccaaaatcaaaaaaagtacaaagagagaaaagtgcagagtaacatctctcatgaatatgatgcaaaattcataagaaaatacaaacaagtagaacacagtaacatatacaaagaactatataccatgaccaagggatgcaaggatggctcaatatttgaaaatcaatcaatataattcaccatattaatgggctacagaagaaaaatcacataatcatatcatgaatacagaaaaagcatttgacaaaattcaatactcataattaaaaattcccataaaactaggaatagggggatctccataacttgatttaaaaaatctacacaaacatacagctaacatcatacctaatggtgaaagactgaatgctttacctctaagactaggaaaaagacaaagatgcgccctctctccactgctattcaacatagtatgagaagtcctagccagtgaaataagtcaagagaaagaaataaaatctgtattcgcaaatcagaaaggaagagataacactattcttcttagcagagaacatgatagttc

SEQ ID NO: 243223 - DNA, 508 bp, Homo sapiens
cagaaatagtccaggtcaagggcatggctaaaatgtgctatggcttgagtttgttcccaccaaaactcacgcttgaaatttgatccccaaggtggccgcgctgggaggtgggcctagtgggaagggtttgggtcatgcaggcatatccctcatgaatggcttggtaccattgtagtgaagtagttctctctctagactgacttagttctcacagaattgttcccaagggagtaggttgttacgaagccaggatgccccttggttttgcctcttcaaacacatccatgtcccctttgaccttccccgctatgacacagcatgaaaagccctcaacagaaatggagcagatgctggcaacatgcttcttgtacttcctagcctgaagaatcatgagctaaataaaataaaccttttttctttataaattacccagcctaaggtattgttatagcaacattaaaaggactaagatgagtatcaatacacaaaaattctcaaagtcaaatta

SEQ ID NO: 243224 - DNA, 712 bp, Homo sapiens
gtaattccagctacttggaaggctgaggcacagagaatcacttgaacccaggaggcagaggttgcagtgagccgagattaagctgctgcactctagcctgggccacagagtgagactcagtctcaaaagaaaaaaaaaagtgggattattaggtcaaacggtacgtgtgttttaaatttagatatactcaagatgccctttagataggatgtctatttcaaattcccatcaacagtgtattagtattcaattccatatattcttgctagtgatttgtcatctttagcttgttgggagtttaaagtagtttgaaacagttttctgtttctttttcagcatcaggacttacttccatagcttaactcttcggagggagctgataaaaatgaaagatcagtgacaagggagtggtgtagaccagtggtcttcaaactttttggttgcttaccccatcactaaaaaattttgagcattaagcaggtgcggtacatggttctgtggtcccatctacttagttggctgaggcaggagaatgtttgaggccaggagttcaaggctaaagttcactgtgattgtgcttatgaatatagccgctgtactctagcctggacaacatagcgagaccatctctttagaaaaaaaaaaaagatgagatgggaagaatgaagtcagaaaaaaaaaattgataggacttcgtgttgttgctttgaga

SEQ ID NO: 243225 - DNA, 406 bp, Homo sapiens
ttttaatctacagagtgaagcaaaaaataaaatagggtcaaattctgccatatgcttcggactctctatgcttcttgggccatgttttattcttctagctgcatctagagagaagtttctagataacatgatttcctttttgcaggatttaggtctctgcatattaaattgatcacagtgtgtgactaagaactaatctcctaatgttctagctagttattgggttagcagtatatacatattaggagatgaatgttgtttgtgagacttcacccttatatcaaaatgcattaacacgtgtatggagaaaaagagaaaagcagtagactaaaagaaaacttgtttataagcctgtatgattgtaatagtgaatcagaagcaagtgaataaaaactcacactaaatt

SEQ ID NO: 243226 - DNA, 446 bp, Homo sapiens
tctgcagcaccacgagatgcccacgtggcacctggacgtccatgcatatgttgaggcccgtgcacgcgcagagaccccagcgcagaagccgccccgcacgccagggcttatgtatgccagcgctgggagacctccagcgcccgaggacatacggcaagtggttccaccagggtgtcagcctagcaggccaacctgggaacccatgtggacaagcggcctttcagcccaggcgcccgcctcgggtggaggcgtggagacttctggcgcagccctgagctggtggcctaacctacctggaaaatcctagcccgagaagcagcgcgagtgagccttttgggtggttccaaggcccttcaccaagctctcacttcctgacttcaccgttgggtctgttgtactaggaaataataacgcctcccatttatcaagggtttactctgtaaaag

SEQ ID NO: 243227 - DNA, 4133 bp, Homo sapiens
  misc_feature (846)..(846): n is a, c, g, or t
  misc_feature (1225)..(1225): n is a, c, g, or t
  misc_feature (1270)..(1270): n is a, c, g, or t
  misc_feature (1491)..(1491): n is a, c, g, or t
  misc_feature (1504)..(1504): n is a, c, g, or t
  misc_feature (4077)..(4077): n is a, c, g, or t
  misc_feature (4131)..(4131): n is a, c, g, or t
gtaacccaggagatttgttcctgggtttcacattcacagcacttgtgggcctccaggccgacctgaggcattgaaaatctcagttgttggtttggtctgtgctgagctccttactcaccttttaaagttggctgtttgcagttgtactcccttcctcatttctgttttctttgtacctttttatttaaataaactttaagtatatactttgggtattaacaaatatgtatgccatgaatataatatacgatgattatcatggcaatgaagatacagaactttccgtgaccccaaaagttgccatatgtccctttggtatcaatcctcctacacgtctggctgcagcaaccactgatctgctttgtatctatagatgacttttgtctgttttgaattttgaagaaatggaactgtacgttatagactgtggtctgactcttttcacttagcataatgattctgaggttcatccatgtcgtttgtgtcagtagtttgttcctctttattactgagcggtggtctgtattgggataacacaatttgtttatccattcacctgctgatgaacatctgtgttgtctcccctgattaggtattgtgaataaagctgctgtgaatattcatgtatgagtctttgggtggacatgtggtttatttcccttggataaataccagtagtgagattgctgggtcatataagagcatttttgttgttgttgttgttggtggtggtggtggtgtttgcttgtttttacatgttaaaataagatacagccaaactattttccaaagtgatgatgcattccagtcagcagttgctccgcaccttcaccagcatttgatgtngtctctttttaattttagccattgtaacagtgtgcaaggacgttatattgtggttttagttggcatttccttgataaatgatgttgagcgttttatatataggcttattggtcatttgtacatcttcttttctgaaaccttgcactttttttttttgaaacaaggttgcctaagctgaatgcattatttcaactatttacaagttcacaaaataacacctttttaatgtatatttgctcacatattaatgtagtaaacatattatttaccatgtgctaatcactttacacatactggcttatatgtacatctccatattagacatatgagattagtactttcattacccccattttgcagatgggaaactgagacctanagacattaaataacctgccagtgttaatacggctagtgaaaaaanggagttagtattcaaacatgggcatcagactccactagaaacattaaataacctgccagtgttaatacggctagtgaaaaaacggagttagtattcaaacatgggcatcagactccactagaaacattaaataacttgccagtgttaatacggctagtaaaaaacagagttagtattcaaacatgggcatcagactccactacagacattaaataacctgncagtgttaatacngctagtgaaaaacagagttagtattcaaacatgggcatcagactccactacagacattaaataacctgccagtgttaatacgactagtgaaaaacagagttagtattcaaacatgggcatcagactccactagaaacattaaataacttgccagtgttaatacggctagtaaaaaacagagttagtattcaaacatgggcatcagactccactagaggcattaaataacttgccagtgttaatacggctagtgaaaaaacagagttagtattcaaacatgggcatcagactccactagagacattaaataacttgccagtgttaatacagctagtaaaaaacagagttagtattcaaacatgggcatcagactccactagaggcattaaataacttgccagtgttaatacggctagtgaaaaacagagttagtattcaaacttgggcatcagactccatatctttgttgttggccaggagcaggcaaactataagcctgggtgccagaatgagccatgccgttcttgtatgtatcatgtcttgtctattgttacagcagcagagctgagtagtttcggtagagatggtttggactgtgaaggctgccctttacagaaaacagttgcctgcccctgctcttgcgcattgtattttgtcttcactgttcctgccttcttgtctggttctaaggaatgaaaggaggacaccagctcagatttcctaaaaatgtctttatgtataatttttaaaaattctcaaaaaaaatcttcctataaaagtcaaaaggatgaaaatgaatgtagcaggaacaactgtgaggtgtcccagctacagtagtcattgagtttttttgcataaaaatacgattgtaaagatagattccataaaatgtgatgttctttgtcctggtactgaccccggtagagtgttgcctatgtttttggcttaacatttatagggcattatttgaaaaactgaattctgatccaagcagagatgaggggaacaaggctgagaccttaattactggctctctcttgtcagagaaaggtgctttttgtcatattcccatgggatttgattgaccttcggacggcctgtgtctgttaggaggcatttctatttctcaggtttgagggctagtcagtaaaatttggatgaatttggactggatagagggactcaacctgaattgtgaaaatcctgagttacagaatttttaaaagttctatgttttagttatatataataatttagctattttaaagcacaaaacaaatacgtgcacttggagaatggagtccacagcattcagcaacagtggcctgaagcagagccccagataaaacactgggttgaatgtcagtgtgctgacatcagtgttttttattatatgactgtgttctttctataaaaatcaggcattgtgagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggattattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagtggccgggcgcagtggttcacgcctgtaatcccagcacttaaggaggccggtggaccacgaggccaggagttcgagaccagcctggccaacatggtgaaaccctgtctctactaaaaatacaaaaattagcagggtgtgatagtgggcaccagtaattccagctactcaggaggctgaggcaggagaatcgcttgaacctgggaggcagaggttgcagtgagccgagatcgtgccactgcactcccacctgggcgacaagagcaacactctgtctttaaaaaaaaaaaaaaaaaaaaaaaaaaagattagtgaaaccaaaagctgcgttcttgaaaagattaacaaaattgtcaaacttgtagatagatggactaagaaaaaagaagattccaattgctaaaataaaaaatgacaatggggacattactgggccgggcgtggtggctcatgcctgtaatcccagcactttgggaggccgaggtgggtgggtcacttgaggtcaggagtttcagatcagtctggccaacatggtgaaaccccgtctttaccaaaaatacaaaaattagctgggcacggtggcgggcacctgtaatcccagctgctcaggaggccgaggcaggagaatcacttgaacccgggaggcggaggctgtagtgagccnaggttgtgcctctgcactccagcctgggaaacagagcaagactctgtccccccncc

SEQ ID NO: 243228 - DNA, 1550 bp, Homo sapiens
  misc_feature (1494)..(1494): n is a, c, g, or t
  misc_feature (1548)..(1548): n is a, c, g, or t
gggattacttaaaagacaaatacagggccaattaaaaaaaaaaaaaaaaaaaaaaaaaaaaaaaaaacatgtcggccggggaatttggactggatagagggactcaacctgaattgtgaaaatcctgagttacagaatttttaaaagttctatgttttagttatatataataatttagctattttaaagcacaaaacaaatacgtgcacttggagaatggagtccacagcattcagcaacagtggcctgaagcagagccccagataaaacactgggttgaatgtcagtgtgctgacatcagtgttttttattatatgactgtgttctttctataaaaatcaggcattgtgagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggattattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagtggccgggcgcagtggttcacgcctgtaatcccagcacttaaggaggccggtggaccacgaggccaggagttcgagaccagcctggccaacatggtgaaaccctgtctctactaaaaatacaaaaattagcagggtgtgatagtgggcaccagtaattccagctactcaggaggctgaggcaggagaatcgcttgaacctgggaggcagaggttgcagtgagccgagatcgtgccactgcactcccacctgggcgacaagagcaacactctgtctttaaaaaaaaaaaaaaaaaaaaaaaaaaagattagtgaaaccaaaagctgcgttcttgaaaagattaacaaaattgtcaaacttgtagatagatggactaagaaaaaagaagattccaattgctaaaataaaaaatgacaatggggacattactgggccgggcgtggtggctcatgcctgtaatcccagcactttgggaggccgaggtgggtgggtcacttgaggtcaggagtttcagatcagtctggccaacatggtgaaaccccgtctttaccaaaaatacaaaaattagctgggcacggtggcgggcacctgtaatcccagctgctcaggaggccgaggcaggagaatcacttgaacccgggaggcggaggctgtagtgagccnaggttgtgcctctgcactccagcctgggaaacagagcaagactctgtccccccncc

SEQ ID NO: 243229 - DNA, 655 bp, Homo sapiens
gtcaaaatcaattgaccatatatctgtggatctggataatctatttatgtcattgatctatgtatctattcttacacaagtccccactgtcttgattattgtggctttatagtatattgaaattcagtattgttaagttctacaatcttttccaagattgttttgactatcaggtcctttctttataaagtttatattaagcttgtcaatttttctttaaaaaaaaagtctactgggattgtgattgggattgcattgaatttataggtcaatttgggaagaattgacaaaaaatattgaaccttccaatccatggacatggtatatttttccacttatttgggtcttttaaaatatatctcagcaatgttttgttgttttggtgacaaagtcttgtacatcttttgttaaatgtattcctaaatattctgtggttatgctattgtaaatagtatttttatttcatttttaagtttattgctggtatatagaaatgcattttatttttgtatattgatttgtatcctgtaatcttgttaaattgagtttgattagttgtttttttattttgttgtaaatgccttgttacaggattccctatgcacataaccatgtcatgtgtgaataaagacagttctacttctttctctcaatc

SEQ ID NO: 243230 - DNA, 1301 bp, Homo sapiens
aatggagcaggtaaaagacatgcacaggaaatatactctaaaaatagatttagggaatgggatatgatatatgggagcagaggaaggagaagggagtgagagagaatctggagctgtattgagaaaggttttgtgtggtctaattaatttggacaaatgagccaagattacttgaagattaagtagaatgtatattcggagtaccttagggatattgtgggttcagttccataccacagcagtgaagtaaatattgcaatatagtgagtcacaccatttttttgatttctcagtgcattaaagttatgtttatactgtaccatagtctattaacctataacccccttatgtctaaaaaacaatgtacacacattaatttaaaaatactttattgctgaaaaatactagtaaccatctgagctttcaatgagttgtaatctttttgctgtagagtgtcttacctgagtgttgatggctgctgactgatcagggtggtgattgctgaaagctggagtagctgtggtaatttcttaaaataagacagcagtaaacttttttgccttgattgtctcttccattcacgaaagatttctctgtagcatgtaatgctgtttgatagtatttacctacagtaatatgtctttcaaaattggagtctgtcgtctcaaactttgctgcaattttataaactaaatttatggaatattctaaatctcttattttctttccaccagtgttcacagcatcttaaccagtagtagattgcatttcaagaaaccactgttttcacttgtctataagaagcagctactcatatgttaaagtttgatcatgaggttacagcaattcagtgtcatcttcacactttacttctaagtctcttgttacttttaccacatctgcagttacttcctcccctgatgtcttggactcctgaaaatcgtccataagggttagaatcagcttcttcccaactcctattgatgttggtatttttacccctcccatgagtcacaaatgttcttaatggcatctagaacagtgaatcctttccagaaggttttcaacttactttgcccagattcaacagaagtatctctctacatggcaactataaggcagctctctacatggcagcttttaagtagtatctcttttaagtagtatctctacatggcagcttttaagtagtatctctctacatggcagcttttacgacttgaaagttagcctggcatggtagcttatgcctgtaatcccagctactcatgaggcctgagaccaggagttcaagatcagcg

SEQ ID NO: 243231 - DNA, 533 bp, Homo sapiens
catatctcaggctatcacatggggagaaaccttggacaatacctggctttcctaggcagaggtccctgcagccttccgcagtgtattgtgtccctgggtacttgaaattagagaatggtaatgacttttaacaagcatactgccttcaagcacttttttaacaaagcacagcctgcatagccctaaatccattaaaccttgagtcaacacagcacgtctctgcgacacagggttggggtagggttacagattaacagcatctcaaggcagaagaatttttcttagtacagaacaaaatagagtctcttatgtctacttctttctacatagacacagtaacagcctgatctctttcgtttccccacaaatccatatagtatttgagtgtgataatgtaaaaatcagtattcatttctaaatctaagtactgctttgagaattttgttggtaattccagttgctgctgcttcagcagaaggaagcttctccaaattaaaataaattaaaaacttgctaaaaactatgttgactca

SEQ ID NO: 243232 - DNA, 448 bp, Homo sapiens
gcggcgacgaggacggcctggagctcgacggggcccccggcaggggcaagcgcgcggcgcagcctgtggcagcaggcaaggtgggcggtgcggctgtggtggtcgccgaacccgagcacaccaagaacacgtctctgcgacacagggttggggtagggttacagattaacagcatctcaaggcagaagaatttttcttagtacagaacaaaatagagtctcttatgtctacttctttctacatagacacagtaacagcctgatctctttcgtttccccacaaatccatatagtatttgagtgtgataatgtaaaaatcagtattcatttctaaatctaagtactgctttgagaattttgttggtaattccagttgctgctgcttcagcagaaggaagcttctccaaattaaaataaattaaaaacttgctaaaaactatgttgactca

SEQ ID NO: 243233 - DNA, 443 bp, Homo sapiens
cactgagaagttaggaaaattgcccaaggcaaatcagaaagatgggattcaaacccaagttatcttattgcagaatctaaactctggaccactaggccacatggcctctctgacaatactagctagatgctagcccaacttcagtatcccttaatttttatatttcctctacccctcatctgaagttagcattgttttttccaccagtgatgtttttaaataggcagatgaatggatgctccaagataatcactccaccagctctatacatagtaggtccaagggggtacaatgaccaccgtgacccagcctttgaaaaattgagatctgctaatggcaggcacaatctgtgtgtagtgcattttcctggggagagagggtctgctgctttcctcagagtatcaaagggatcccccaaatggaaaaagacattagttattaaa

SEQ ID NO: 243234 - DNA, 502 bp, Homo sapiens
atccctaacccctggcaagtactaatctgttttccacttctactacttgaattttgaaaggcatacaataaaatattgaatggtacaacacaacataaatgaaagcaagtgacaagtgagaaagtggaggtggtgatcagattgctcagtggtgaaaagaattatgttataaatggggccaactatgaataaaggtgccccaacccgcatgtgcagattccttcttcgcagactcactcacatagcgcgtcatgtcagtgcaggtggcagcgccaaccgtgctcctcagtctgtcctcaccaggcccacgtgagaacacaggaacagattagcaacaagagcccccagccttggcctgggcgcagaggcgcctctggccctcatgttctcttgtcacactggtgggagctgccttgcctggggtctgtctctcccaccgaccctgcttggctctgggttgaaggcatgacgagtgaggcgggagtgcagatgaaatgaccct

SEQ ID NO: 243235 - DNA, 346 bp, Homo sapiens
cagtgataggtatttattctcttgaaattgtgggtttgctgggtagtggatgatctaaacttggcttactcaaagtcaaaagcccaaagtcaagcagggcagggagtaacttgcacaatactatagtgacagtaatctactgcagtgatctagtacagttgatttagagaagaatggtaagatgcttattatgacaactattgtgctttcttctttctgctctctattgttgacactctcctgatagcactttttcattttggttgctgaataatacctgttgattggatactcctagaatcataatgtaatacagcagatttcttctcttcatgttatgtagaaa

SEQ ID NO: 243236 - DNA, 517 bp, Homo sapiens
gagaatttgcttcaatttttaaagtatatgagttggtttctatttgagtaagtgttaattccacttggtttctcagaaataatagtcctattctgtacctaggagcatataaacttcagtataaaactgccttatcacctattttgttacattttctcattatttcttctaccctggttcttcttacttcttttaaagaatacataaaatacagatgaactattttaaagtaactgtttccagaacttgagagagtaaattctcaaaatgagttatttaatggagtgaaaattttatggagtaaatttttacttaaccacattttaaataataatgttacttttgcatattgttctggaagattttttttcccaaacaaaataactttataatcctttatagttttatttattaataaacgtatggataagtaaatacaattttagataaatataaatatgtacattttttaaatttaagaatttttaagtaataataaaccattttgcttagacaa

SEQ ID NO: 243237 - DNA, 604 bp, Homo sapiens
tttttttttttttttttcatttttttaaaaaaatcaattttactgaggaaaaattactgtcaaatgcacacattttaagttacagaagatgacttttgacattcacatacactgtgtaaccaccacaccaatcagtcaagatattataggacatttccattaccccaaacagtcccatcatgctcctttgagtcagcctttctctcagcttccactccaggcactcactgatctcatttctgtcacaattgataaatgttacctgctctagaactttacattaagaaaacattaaagtctgtactttttgtatctggctattttaattcaacatattttagatacatctattaccaatagtttgttcttatgcatatctcaaaaatttattcctttctaattgctggctagtatttcagtctttttggaatgtttttctatttttttatctttattagtcagtttttatgttttattttcttttattatactttaaggtttagggtacatgtgcacaacgtgcaggtttgttacatatgtatacatgtgccatattggtgtgctgcacccattaacttgtcatttaacattaggtatgtcgagc

SEQ ID NO: 243238 - DNA, 456 bp, Homo sapiens
caatattggtcctgcacagtgcagtcccatcatgctcctttgagtcagcctttctctcagcttccactccaggcactcactgatctcatttctgtcacaattgataaatgttacctgctctagaactttacattaagaaaacattaaagtctgtactttttgtatctggctattttaattcaacatattttagatacatctattaccaatagtttgttcttatgcatatctcaaaaatttattcctttctaattgctggctagtatttcagtctttttggaatgtttttctatttttttatctttattagtcagtttttatgttttattttcttttattatactttaaggtttagggtacatgtgcacaacgtgcaggtttgttacatatgtatacatgtgccatattggtgtgctgcacccattaacttgtcatttaacattaggtatgtcgagc

SEQ ID NO: 243239 - DNA, 437 bp, Homo sapiens
ccttttatgtgtgaagctccccaaacagtggggtgtcctgcattcaaatatattttagtacctattcaccaaggaaatgtgctaatgaaaattttctttcttaaatttgcatttccttattatgctaaaatagctactgatttttcttcaattttgattatgtatggggttctaccgaacaccgtttttaaccccctacatataattgcacaaaaatgtacacctgtggataaaatggttttaatttctctcattgacttggtgatttcagtgggagttgaacacaggctagacggccccagtaatggggtgggggtgtattaggtgtttttttcatggcaatgagtatttcatgaaacccttccaggctaccaaatttagggggactggatattcccaataaatgtgtattataataggaagctatttacaattga

SEQ ID NO: 243240 - DNA, 337 bp, Homo sapiens
tctagagttctcaaccggtccttccctatcccttggatccctggatggtgtcttgttttaacctttgttggcaacaaagagcccaaccctttggatttgactagaaatagctcacaacttaatcctccagcgatataattgtcttcgttactcccagtgatggagtctggtgaatttccagggccttccattatggcaccatcagtacccacccctgtttatgccacatttacaccttgtctgttcattcctctagctcttgctaaccattaatctgctttctgtctctgtggatttgcctgttctagatatttcatataaatggaatcatgcggta

SEQ ID NO: 243241 - DNA, 685 bp, Homo sapiens
actgtttagaaaagaaaatttctggggaactataagccaaacaattcccaaaacttatacaaagttgggaatattttaaattccaataatccagtgtagagaggcctcattaaacacattggagaattcaagaaagagattagaaggattatgctttagcagtggggctaaactagccctgtagtagtggttactctcaactctcctaaaataaaaggtctaaaatcagcctcaaaatgattcagctatcagtgttcagcagatatattacttgccagtatcaagtccaacactctggattacaataaaatccagcattcaacgacacaagattcacaatgttgacaatccaaataaaaagttgacaagcaaagaatttttcttctgattatggatgaaagactataaccgggaaaaaatcaatctgtagaaatagatgcccccctcccacacacacaccagaaataatgtactttgcagacaggactttagaatagttattataaaaactatatatgtccaaggaattcataggaaacatgagcataatgagagaaatggaagacaaacaagttgaacatttatttttcaattatgaaaaatatctgaaataaaaatttcattgatggaattaactgaattagacactacagaagaaattgtgatattgaggttaaagatctgg

SEQ ID NO: 243242 - DNA, 400 bp, Homo sapiens
tcttgaattctgtccctccaaggagagggcaatgcctgagcccacggaagttgggtcaggggcagcattggaagtcagagcctgcaatgctcacgtaaatgcaaaagatggttccttcagtgccagtaagaaggctgtcttgaacatgaggaatacagcagcaagcaagacagagaggtgcctgctttctggggagacaacaaacagataaataagcacaacactgtcctgccaagctaagtgacatcaatgaaacaaggcaaggtaataagaagaggctgggaaaaggcttagctgtgattttgctttctgcagtttgagttgcctatgttcaacagaggttcaaaaatattaaatggaacatttcagaaataaacaatcctaagtttaaattgcatgc

SEQ ID NO: 243243 - DNA, 796 bp, Homo sapiens
aagatttcacatcctagcatgtactgttgtaaaggtggaagcattcacacaaacgttccatgtcagaagtgagacacctagaagcaggaggttggaacaacacacagtgactccattgcagtggaatggcgggtaaacccctccatatcctcctttcttgggccaggtagcaatgtgaggagtctgcctgtgttggagcttggaacgggggaaaagggcagtatcttctccaggctgatgagggccaggagtgattgagataatcaatatggaaaaccagttgctgggataatccatgttgaatcttttccatcctactgacggcccaagtaggttattcatacagtctgtactttaagtaaaggtggttgaaccactaagcatttttggaaagacaatacataagaaagaaagctcaaagggaagaacttcccctaggaaatagttaatacaaaaaaaaaattatagtaatgtgaaataactgctgaaaatgcctgaatatctagagtttcctctccctactcccatacccagttagtgtccatcagaaaacagggtgtccttacagccgtgtgctgagagtatcttcacttcttatcagcaaagtaatgtttgggaattctaggcaggtaagcagggaaacaacataagtaacagagtcaaaaccataatggctgtgaaatgagaggagagtggaacaagtgagatattttgtgagattttggaaaactgaaattgtgctgatgtggtttaaacttgatgtagtaagtggtgctctaccattgcacataatgca

SEQ ID NO: 243244 - DNA, 1093 bp, Homo sapiens
attccatgttgtgagctaaaggggattgtactgatcttgaagataacaaatctgcctgcttcaaaggtttcaccgattttattgctgtgtttcaaacacatttccacatatggtatgatatttaatttgcaaaataaatccgtaaagcaggaattactaacctaattttgcagatgagaaaactgaggcttaaagttgttcaaggtcaaagtcacgatgtccatcatgctgtagctcaatgaatgagtctcacattgtttcatgttgttttatttctactttctcaatccatgtacaagatagatttacaaactactgttttatgttggttgtatgaatttcaatacatttactgttagaaataacaaaaggtcttagactgccagatgctgttcccatcaactctacttaattcataatatagctgaactctgtcataaatctaataacgatgtggacattagccagaagtatgatgtggctgaacctcaccactgaacacaaaatgagaattcacctcatcttttcatttgaatttatttctactaaaatatatgtattatttttcttgatttctaaccaggccccttctgaagaaaactggttaactctaaattgttactaaattttgaatcttcctgtatttagcaataaaagttactgctaattgtaataacaattatgaggaaaaatttatttaaatgcttcatagaaagttaattttcatttaatagaaaagaaataaaaaatctgcttcagactgtttgatttctctattaggcaattgaccctaactagtatatggtgattttgagtattaaaaaagaagttataattttccagaatattaatgtttattattttgaaagcaagtaaaattctccagtaggaagattaataaaacaattcattaaaattctcatcagaaaatcctatgctttcaaatgtatctgctcaaagatgtcactctatgtgcggcaaagctttgttttacttgatcaagaaatgaatgtgactttatgatcttgtattcaactgtgaacagctgctcattaataaaaagccattaaagtccaagtcagaacagcaggtc

SEQ ID NO: 243245 - DNA, 1275 bp, Homo sapiens
ccgcaccggcatctggacttctgaaaaaaacaacaatgacaacaacaataaaaaacaaaaaacacaacgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243246 - DNA, 6218 bp, Homo sapiens
aaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgttttagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243247 - DNA, 6446 bp, Homo sapiens
aaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243248 - DNA, 6541 bp, Homo sapiens
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243249 - DNA, 3821 bp, Homo sapiens
catctcatcagagctccttctggcttgcatttcagcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243250 - DNA, 3096 bp, Homo sapiens
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaaggtaaagaaacctactcaccacacagggtccacggggcctggagatgtcaggctcctggctcacaggagttctgaacttgctctaaaaaattggactaggagttcgagaccagccgaggcaacatagtgagacccccatctctacca

SEQ ID NO: 243251 - DNA, 6316 bp, Homo sapiens
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaacggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243252 - DNA, 6040 bp, Homo sapiens
aaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgttttagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243253 - DNA, 3865 bp, Homo sapiens
tggcacaattttggacacgcggtgagtgttcagtaattattcactatcactgttgttgatcttgggtcttatctatctcatcttctcttgggaacttaggaagtgaatagtccaggcacgttcactgattatagtggcccaagataagtaaaaacataccactaatttcaccaaagcatggcatgggcttttgcatcaaattttttggcctcatttcatgcaaacgaagtgaattcactttacattgaccaatgcttcctgatttctctttcagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaattgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggctcagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagagagggaaagttgattttaggcacacatgtaccctccttgacagcaggaactcagacttcaatcttgggggtctaagaccagaatattttccttctgccagaaaagaatcttgcacatatactcctgaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattgggaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagaaaaaaaaatg

SEQ ID NO: 243254 - DNA, 2968 bp, Homo sapiens
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttgtgagtcctgtttaatgaattgggcccccagtaggtagaagcagattcactttctcttgttcatgatggaaggctgggctgctaggaggccttctgcttttcgacaggggcttttattatcattactatgacaaaacagtacctaacactgattgggagcacacatactataacatttacagtaaatttatcacgcgttgctctaagtcttct

SEQ ID NO: 243255 - DNA, 515 bp, Homo sapiens
ccattataataaaataggaggccaggtgtggtggctaatgcctgtaatcccagcattttgggaggctgaggcaggaggattgcttgaggccaggagtttgagaccagcctaggcaaccatagcaagaccccatctctagaaaaaaattaaaaatcagctgggtgtgatggcagtgaggtgtgatcctgtcactgcacttcagcctgagcaacagagcaagatcctggctctaaaatacaagaaataaaatatgtaactttgttcagagatgtcttttaaaaattgtggcacatttactattttaatcactgttgaccgccttaatatgtgtcaaactgtcaatttaagtaggaactactagatctcagatctattctttttaaaaaagtgttacctattttattactgttaaaattttgatgtagtatgaaaaagccctgagtcatagttacagccatttgccacagaaattctaaatctcgtaattttaattccaaataaattgataattgtta

SEQ ID NO: 243256 - DNA, 379 bp, Homo sapiens
gagttgctggtctccggttcccaggctaggtggggatgctgtgagcctgcaatattgtcactcttgttttctgaagcatttcccaagagaaggccagaatgtttcaagattgataccctgcttggggaaagcgtgtagcctcctcggggtcagctttgaaaagagacagctgtctttgttgtattttgaaagtggtgttttcgcacttcatagtctcactctgcatttagtggtggcttacaattatttgtgattttatttaatagccactggcacacagtgcttattatgtgccaggcagcgatctaagcactttacaaaattaactcatttaaacctcatgatagcttatgaggtagatcccagtattatctgcatt

SEQ ID NO: 243257 - DNA, 346 bp, Homo sapiens
ctgaggttcagagaagttaagtgattagctcaagatcacacagctaattagaagagcccaaatccaaacctgacctgttcgtctctcagcaccgagctcctaccccaggcaacatgatctgaatgggggctgggtacccactggtatggactgaattgtgcctccaatacaaaataattgtatgttgaaaccataactcccaatgtgaccgcattcagaggtcaggcttttaggaaggtagttaaggttcaatgaggtcataagggggtgcccaaagcaatagaactgatgttcttataagcaaaggaagcctgggcaacacagtgagaccctctttctataacat

SEQ ID NO: 243258 - DNA, 516 bp, Homo sapiens
  misc_feature (306)..(306): n is a, c, g, or t
  misc_feature (334)..(334): n is a, c, g, or t
acattgacatcaaacaaggattactctgaatgtggcttgcagtggtgtcgtctctgctttggagggagagtggaaagtcctacgaccgttctcattggagaaccccttgggatccccgccccccattttattcctgaaatattctacaaagtggaggatttcctaatgttcagatgccttgaccccaaatcccccaggactttcgtggcccgccccatggctaatctgcttttctcggattgtcgcggtcccgtgatctctcccggacagtggccaccctccttccagagcaggcctcccagctgnaagtctcttcgagaggctcaggccatgngatctaggatcatggctcggtacagcgcggcattacaggccaggagatgcccacccgtctccgggggccgtttgacaaacatcggctacttccggacaagccactggtcctgccatcttggtttgttcatgcatattcagcaagagaactgcatattcatgagcaaccgcccttccccggga

SEQ ID NO: 243259 - DNA, 460 bp, Homo sapiens
atatcccagagcgctgctgtaagaataaaataatgtgtataaagcacttagtgtaatacctggcacatggtgggtgcacctgtcagtattgctgggggacctttccaaattgttttcattatttcagaattagtactatacatgttagataataagaaatatagacaagtggccgggcacagtggctcacacctgtaatccaagcactttgggaggccgaggcgggaggatcacctgaggtcaggagtttgagaccagcctggccaacatggtgaaaccccgtctctattaaaaatacaaaaattagccaggcatgatggtgggtgcctataatcccagctactcaggaggctgaggcagaagaatcacttgaacccgggaggcgtaggttgcggtgagccaagatcgtgtcattgcactccagcctaggcaacaaaagcgaaactccatctcaaaaaaa

SEQ ID NO: 243260 - DNA, 231 bp, Homo sapiens
attgagcccatggtagagtgatcaactgtcctagcttgcctgggactgggggatttcccaggatgtgagacttgcagtggtaaaactggggaagtcctcggtaaaccttgaagagttggccactgtgccaggggaatcacttgaacccgggaggcgtaggttgcggtgagccaagatcgtgtcattgcactccagcctaggcaacaaaagcgaaactccatctcaaaaaaa

SEQ ID NO: 243261 - DNA, 375 bp, Homo sapiens
agccaagatcgcgccattgcactccagcctgggcaacaagagcaaaattctgcaaaaagaaagaaagaaagcccacaaaatcaaacaaaaaaccaaaaataacagaggggaattgtaaagtcaatttggtaagtaaccaccagaattcaaaacaaaatgtcagggtgtatcatacatcatgataaatatgtttcatagattttgtttgtttgtttgagacagagcctttgtctgttgcccaggcaggagtgcagtggcgtgatcacagctcactgcagccttgaactcctgggttcaagtgctcttcccacctcaacctcccaagtagctgggactatagatgcatgctgctgagcctggcttattattattttt

SEQ ID NO: 243262 - DNA, 507 bp, Homo sapiens
ctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaa

SEQ ID NO: 243263 - DNA, 468 bp, Homo sapiens
taagcacttcatgtatattaactcaattgttcccacaacatgagatggatacctcatcattcccactttgcaggtgatataacagtaaatgcagcagaaaactgtaaactgttaagcagtttgtccaaggtcacccagccaaaagtgatggagttagaattcagatccactctgatacatacctctcatagatggccaccagcagcctgaggttcatatcaccctaaaaacaaacaaatgagcatatcctccacaatcatgtccagcacaaccatatccatcccccagaagggccctgaatgggccttgcccatccctgaaccagtcccctggggcggggtagggccactccggttgctctgattgagtctctcaccctcctctgtgatacaggtggggccttgtggttgacagccccagagattaggaaggagcacttgtagagagaaaaagatactaggcaggaaa

SEQ ID NO: 243264 - DNA, 370 bp, Homo sapiens
ccacttgtgaggacacaggttgcaggcccctgaagctgggcgtctgtattaattaagattctgggtttacaaatgagagaagccaagtcatgcttgttctgcaagaattacttcacggaacggttactgtggtgtatggaatctgagggagaggtgatcaagtgaggggttttggcctgtgccgcagactcagctgggatgagcccccaggcccctgtcctctcatctctgccctcctcagagtagcagctctgtcctctgccttcggatgtacactgaggattgagcagcccaggcaactcctgagttttccattttaagcttcagccaccagagagactcactgacacgctcttggtctcctaaatgc

SEQ ID NO: 243265 - DNA, 524 bp, Homo sapiens
gtgaagaatcacagttcattatttctaactatttcatctaagatttgaaaggaaaaaatcccttctatgaattacagttggccctccgtatccatgagttctgcacccacaaattcaactgacctcagatcaaaattatttgaaaaagcgtatttgaaaaaaatacaacaataaaaacactacaaatgtaaaaaaagtacaatataacaactatttacataacatttatatatattactatgtattataattaatctacagatgatttgaagtatgcaggggatgctaggttatatacaaattctacactgttttagatcagggatgtgaacacttgcagattttggggtccacaggggtcctggaattaattccctgtggatactgagagatgactggacatccattctgcatgctatatattttccttttaattattattgctgtttcggtttccctgaaaaatacaacatgttttaaacttctctatattataaatctcatttaaaaagtgttgaatcaat

SEQ ID NO: 243266 - DNA, 488 bp, Homo sapiens
agttgggggcaccaaccctctgcacagtcgaaaattcacaataactcttgactctccaaaagtttcattagtagtaacctactgttgacctagctgataacataagcaattcattaaggcttattttatatgttatgtgtattatgtactgtattcttaataaagtatgctagagaaaagaaaatgttactaagaaaatcataagagaaaatatatttactattcatcaagtgggagtggatcgtcattaatccacttcatcctcatcacttcacatcgagtaggctgaggaggaggaggaagaggaggggttggatttgccctctcaggagtggcagaagcagaaaatcctcatataggccaggcgtggtggttcacgcctgtaatccagcgctttgggaggccaaggtgggaagataatttgagctcaggagtttcagaccagcttgggcaacatagcaagacccccgtctctattgaaaaaaaaa

SEQ ID NO: 243267 - DNA, 506 bp, Homo sapiens
tagtaaataggaatttagcttcaattagaggtgtgtgtgtgtgtgtgtgtttcccactaccaggcacataataggtgttcagttattgattaaaagaaatgtctttaatttcttcagtcttctctgaaattggcagtgggtcagttgattctggcatcatatatgcagaaaatactcattctgtactgtctttgccagtcttttgaacctaaattattgttgagagttgattaaacaatatcacttggttgaaaagattgtttttaattcatcctttaatgcaggctcttcagttttcaagtactttttagactaccctggttctcttccaaattataagattattgatatgagaaagaattgtaaatgaacatcagccctgacacatttgttaatatttatttgcccctctggaacataggccagtaaatttttattattttatgtgattattatagtgaaaaggacccaaaccatcaaataaaaacattttaatagttacctga

SEQ ID NO: 243268 - DNA, 557 bp, Homo sapiens
acagctgatctcagtcccaggggcccattggctgggcaagtggggcaggaggtgggcaggactggggcaggctagggaaaggtcatttatggctgattaaatctttctctcctgtctcaatctcttgattacctttcctcttgcttcccctacttcatttttggtggggagtggggagggaagaagtccctactttttatttatatatatttaaatttgtattatcttaagagttattgttttttcccctttatttctcccacctgttctttctctcttcttctttctttcctctccttctcctctcctctcctcccctctcctttttcttttcttttctttttccctttcctttcctttccttttctcttctcttttctctctctctttctttctgtacctctctttcctttttctttttttttcttttttgagacagagtttcactctctcgcctaggctggagtgcagcagcatgatcttgacttactgcaatctctgcctgccgagttcaagcaattctcctgcctcagcctccctagtagctgggattacag

SEQ ID NO: 243269 - DNA, 513 bp, Homo sapiens
acagctgatctcagtcccaggggcccattggctgggcaagtggggcaggaggtgggcaggactggggcaggctagggaaaggtcatttatggctgattaaatctttctctcctgtctcaatctcttgattacctttcctcttgcttcccctacttcatttttggtggggagtggggagggaagaagtccctactttttatttatatatatttaaatttgtattatcttaagagttattgttttttcccctttatttctcccacctgttctttctctcttcttctttctttcctctccttctcctctcctctcctcccctctcctttttcttttcttttctttttccctttcctttcctttccttttctcttctcttttctctctctctttctttctgtacctctctttcctttttctttttttttcttttttgagacaggaggattgcttgaagccaggagtttggaaccagcccggtcaacatagcaagactccatctctaccaaaaaaaaa

SEQ ID NO: 243270 - DNA, 450 bp, Homo sapiens
catgaagcatgcccacttgcagaagccctcagggatttaggaacctgccttctgtcccattagatgctattagggtgaatccgaaggatgtgagagtgagtgggctaagtagctaagctatttagagtgagtgagttaaatagctaagcagtactccattgccattctcttccctctctactcacacccctgcctgggcttctcacagctctgagaagctctggagtactccttttcctcctcacttgagactatctcaagaaatcatggtgtagagacactagcagcgtaatctgtggactcttacattgtcttggtgtttttttccttattaattccatggccacagttttctcacctgtagcatggcggatgatactgccttcttcataagattagtcctttgaattttttagaatttgcatttcatagatgcaacaacaggaccca

SEQ ID NO: 243271 - DNA, 200 bp, Homo sapiens
ttaatcatatcgtcgggaaaatgtactgaagcactacttcctgtggtattttttttacaaaatgataacatagtttattgcctataggttgattatgacctaaaattatatttttgcattttattgtgccattatatattttaaaatgtgaggttcacatggttgcatttgctctgtgaataaaaatgtctaaaatcata

SEQ ID NO: 243272 - DNA, 526 bp, Homo sapiens
ctcctcaaactttccactccccagtctcaactgtaatcgcctgtcagtgggagtgggaaaagggaaggatggggaggaaatgaagaaaacacaagcaagactcctcttctgaagctgttgaagtaacttcttatcgaacactctaccctagggctgccagttggcagttggaagaaaaggaaaagcgaagggtaaaaagatgacaaggttatcagtccagagatagagtgaagatataaaaaggctactcagtggtagtagtgactctgcgctacctcctaggcagcccagtcccacagagacccagcagttggccagaaggactgtgtattggcagctttcacaaaagtggacttcgtcaagtctgaagagtcttcaagtgtgaaacttggtgcacaagcatttgtatcacaccatttcaacactattcctaatatcataaagctgttcaatgtccaaaaactggtgacttacaatgcacttaaaaggcactcattaataaaagtatcttcaaaaaccacataaa

SEQ ID NO: 243273 - DNA, 288 bp, Homo sapiens
cattgtgtcttcatatggcctttcctctttgcaggtatggagagaaggacacagaccactggagtctctttgtttgctaagggtaccagtcttattggattagtaccctacccttctgacctcatttaacctcaactacctccctagcggccctatatccaagtacagtgacattgggggctaggtttcaacgaatgaatgaatttggggagggatacaattcagttcgtaacaataaccaatggcgagtgagaaaagtgtctctttataaaattattccagttaaaa

SEQ ID NO: 243274 - DNA, 441 bp, Homo sapiens
ataataaaaactcacaaaaaaacacaaccacaaccttgcacaaaggccatcacagccttacacagaaaatactggcagtaagtgcctctccatcctgagactggcatcacccttgttactgattttgtggccaatcttatttcaaaacaattatgtaatccttctcatttttttctttaaaaacctctgtctttcctttacgtctcggagaacacacatagtttactttggcatgtacattctcattgcagtgcattatttccatataaacatcttttattttagagagcctctctgttacttaggttgacaggtcctgttttattttaagtctagtatctgttagttatttttcctgatcttcttactcctcccaccctctaccctccagtaggccccagtgtatggacagatagtgttctaaggaaataaagccaaatt

SEQ ID NO: 243275 - DNA, 416 bp, Homo sapiens
tattataacaaatgtaggcagtatgggtcaaatgtagctgtgttataaccataaattcaataaatacactttgaaataatttcattaaatatcaaactgcaataactgtacagactgagaaagtacattataaaagaatatgtttaagcatgaattaatgctcaaacttttaagcttttatatttctaaaaaggagcttggcaatcatttttcaatttagtaacagattggtattggaataaattagaactaactagcaaagaaatgactaaagaagagacaagaagtttcttttctgtgcatttacttattgaatgctcctattagccattctgaccatgctgtattgatagcagttgtctcgctccaattgtgaaatatccatattagagcaatgaataccaattgaatatcaa

SEQ ID NO: 243276 - DNA, 462 bp, Homo sapiens
gagaatatccatgaaatgtgggacagttacaaaaggtgtaacatatgcataatggaaattccagaaggagaagaaagagagaaagaaataaaagaaatatctgaaacaataataattgagaattcccccaaatgaatgtcagataccaaaccacagatccagagagctcagagaacaccgaaaagaataaacacacgcacaaaaaaacgcaaaaatctacacctaagcttataatttttaaactacagaaaatcacaagtaaagggaaaaatcataaaagaagccagaaggaaaaaacaccttacctataaaaaaacaaagataagaattacatgcaacttctcctcagaaaatgtgtagtatatactccacaagtaggttcttgccaagaattgaatttactctaaaatgcaacactttgcttaagtgttgtttgtccagcagatgtcagccttgcacaag

SEQ ID NO: 243277 - DNA, 342 bp, Homo sapiens
gtgctgggttctcaggacatatgcaatgaatccagtataacatccctacttccttgagccttccgaccttttcttcaatatgatatcaaggaagttctgtcatctccacttcatttgatgtggaacattatcagatcaatgcttcaagaagtcatctcattaagttattaggaattctgaatcatggggtctcactatgttgacaaggctggtcttgaactcctggactcaagcaatcctgctgcctcagcctctgaaagtgccgagattacagatcctgacttttcttcttataatgactaataaaaccagtttgccaggctctgtgccaagtgctttaaa

SEQ ID NO: 243278 - DNA, 532 bp, Homo sapiens
gaaagagctatggtctgtgactcgaattcggtgcccccccagcggctactgacattatcaatctgagggaaagggcatgaagcaggtcagaagacacaaagctggaaagggcagccccaaaccagggcaggctggcatggaatccaaaggcagagaaaacatcagggaaaaggaaggtcctgactccctgatggagctctgaaagattcctggacgtggcattgtcacatgtgcagcagtaaagggtgttcactgtgcaagggcagtgggctaaggggcaagcgtgcatggaatccagcctacaggccactccccaaactctggcatggagctacatccacttggagaaaggggaccgttttccttttcacgcaaaggtggcttaagggctagtggtggcccgggaagtgtgctgagaatgggtggatttcactaagcaaagacatggcaagcaatgtcttggacagccgatgctgcccagacaaaggcctggttgtcgggcatgagctgaggtgtgacaaggagatagaag

SEQ ID NO: 243279 - DNA, 551 bp, Homo sapiens
gtgctgtacctcctgaaggaacaacattagtggctaaacacagtttggagaaaagggacttcactaaaataatccagtcgtttactacataaataagcacattataataagctccagagaaggggggaccagcaaccagagttactacaatatatgattttcaatatctagttttaaaccaaaaattacaaagcacaaggaaacaggaaagtacaacccaaacagcagaaaaaaagcagacaacagaaattgacagtaagaggaaccagatgttgcatttatcagaaaagactttaaagtagccattatgaacctgttcagagaactaaaaggagccatgattaaagaagtaattgaaggtaggatgacaatgtcacatcaagtaagacaatatcaacaaaaaaattgagattattaaaggagccaaatggaaattatggagttgaaaagcacaataaccaaaaaattcaccaaagggctcaacaataggtttgaactgacagaggaaagaataacagactaatagagattagacacactgaaaaacagag

SEQ ID NO: 243280 - DNA, 437 bp, Homo sapiens
agtaaccttgtcctagaccttgggggagtagtccatggcttgagtccaggtattacccatttctctttgttcccacagctaagcgagggccactcaaatgtcagtttttgataacagttcatccaacattttatatgcagctattttaatggaatttactcaaagctcatgacaggtttttgttggggaaaaaaaatgattgtcttctatttccatttccctccacctaggcaccctgtcctttcgaagtttttaaatcatttccctaagattcatatccttattctctgagaagtattaaatatattaagttatccagcgtgcattatgttatatatttgtgtgatcttggtcataggtaataaaaccacattttggagatgatcataaagttggtctttgctttttgttttatatttactttcacctaaatgcaa

SEQ ID NO: 243281 - DNA, 211 bp, Homo sapiens
gaggagggattcgagaagtggacaattgtattgtgcccttgattaggaagcagaaatagaattagaaatagaattctaattaatagaattagaatagaaatagaaagggtgccctagtatggagtactgcagacataagttgctggggagagggagctaaacgctccgttggtgtacaagcaaggtttaaattaaaatcctctgtgcgtat

SEQ ID NO: 243282 - DNA, 886 bp, Homo sapiens
  misc_feature (790)..(790): n is a, c, g, or t
  misc_feature (799)..(800): n is a, c, g, or t
  misc_feature (834)..(834): n is a, c, g, or t
  misc_feature (849)..(849): n is a, c, g, or t
aacccagttatttctgactgggaaacataaaaatctcaaccattaaactgtatatccatgtattgagcacccactatacacaaagcactatgctagacaatgaatcccttgcctaactggtccttaaactcttcaggatcacaggtactttgaaaacactgatgaaagctatgcatgctcttttcaaaaaatgtacccaatgcacaaaccttggcataccttttcagtggattcaagaaatttctgaacccatctcatcttaagaactcctactttaaagaattgcacagaattcagttggtgaagaagatatgatagaagaagaaatgtagccagcaatgacttggccttcaagttgcagcaaagttcctcccacaggaaaaggggaggtggtcatgatttattctacaagtacttattgggtgcctcccttgtgaggccctgggaatacaacaggagattgtacaaagtccagtcttcatggagaatactgcccaggaaaggatgtaggtaagtgagcaggcatttgatttggagtcctcattctgcatttttgtattctttgatgcttctaagagtatccgaaaaactagctaattcgatattgggtgtttatagtaaagatattgctattgcataatttctgtccccatgtgtgaagttgaagatataatgaacatttctgttaacaaaaatattttccctattccctttggtgaaaaggaagcaaatacacctgttctttcaaacaccgttccaaccattctttttcttttccaaaaaattgggntatttaaanngggaatggaaaatggtcctttttttgggggcccnggcccgctttcttcnaaaaaatttttttaaaaaccacccccctttttttttg

SEQ ID NO: 243283 - DNA, 256 bp, Homo sapiens
acatgtattgtcaaagctaattgttttaaacaaggtgttttatctttgattaaagtgatcaatgcctataagtataaaagaaatgatagtagagtttcatggtctctttcataacacagtcccatacttaacactttgatgtgctgacactgataatgaagatacaaggcctgacttaagcaatagttagccttcaaaatagaaaggtgaatggtacattcatttctgaaattcctgaggtttttccttgctctac

SEQ ID NO: 243284 - DNA, 517 bp, Homo sapiens
aagtggcaagattgattggaaatattgataatgaggtttatggaatatatcatattgttgctgttatactaccacttatactttttgtttttcccaattggtttcttatagagtttgatgctatttcctcaaattcatttgcttgtattattttacataaagatacatatggaactttataaactatattgtatatatattatgtgtatatatatttttatttatgcgtgtatatgaacatatgtgtgtgtgggtgtgtgtgtgtgtgtttgtatgtatttaaagaatgagggaggctcaaagaaatcttgagaaatccagtccttgattccaggcatattctttcaggaatgaaaatattctatccattttcctcttctaaatgtccagatatatttaatcacatagttttgccttaaattcccaaaacaaataaaatgattaggtaaaatcacattagctttaagtgccattttataaggaggttttaaaacatgttatgcattgaaaaaaaaga

SEQ ID NO: 243285 - DNA, 554 bp, Homo sapiens
atctccctgcagaagaaaacccagggcccagagctaggctttttccaagtgagatctcctaagaccccttcatcctccttgccccttaagatggcccattgcctctttagcctttggaccaaataatagctgctcacattgcaaccccatattctgataattgcagggaagcagattcttactcaaattcaccattcacatctccatcattaaatcaacctttttatgttatatttgcaaagaagtggcttcaaacagatctggaaacacaagcccccagtgagcgagcactcacacagctctgcccagtacctgaatttatgtacaccttgtatatctgtgtgcacagatatattcacacactcacacaaatgcaaagacatctgaagtcattcaaatgtatatttatgtacccctttatgcatatatttttgtgtttttatatctatatccatttgagtgagagctagagaaatgtacacagcaatgcaatatttagcctacattccactttccctcctaatgtaaatgtcttaaaaaaaagttggcggccg

SEQ ID NO: 243286 - DNA, 362 bp, Homo sapiens
cagaagaattatctgagacccaagaagatttgctaagcaaataaaatgacaaaatgctaagcaaataagatacaaacccaaacattgtggaaaataataatttgtgggattttaaaagaaatgactgaaatactgtacaaagtagaacgtatatttaagagtgggatgatcagatcttaggttttcaaaagcccttttattatgcaggagaagagagttataatacattgtttagactttgttaaatttttacagtaaaatttaagggtatcattaaaagaatacacaaatctaaaacctgtgaggataaaataatgaagtaagaagaggatgagccaaaaaaaatcaatacaagaaaatgc

SEQ ID NO: 243287 - DNA, 512 bp, Homo sapiens
ggtggtccgagatccgaggcaacggtggctcctcgaggtccacggtcccggccggtgaactcgataccttgcaagcctgtagccccagctcacacgcctctgggcgtccgcctggatctgtctggtgaatggaactaggatggcctgtgagcccacagaacgtctagaaaagtcagctttacattgggaccaacagaaaattacagggaattatctacatcatccacaggcatcccatttacttaaaaataatcatttttattttgtgacacttaatacggagaatattgtaaatactgtacacccatcaccctaaattgactactggcattatgatttatttgcttattttttaaaagctagataatacaataaaagttaaacttacctgttttttctactctcaagcctattaccctctcatcctctccagaagcaactattatgaattagaattagcttgtgttctcccagtccatttttaataattatatgtagccatgactatatag

SEQ ID NO: 243288 - DNA, 594 bp, Homo sapiens
gttacaccatgttggccaggatggtctcaatcccttgacctcgtgatccacctgccttggcctcccaaaatgctgggattacaggcgttagctaccatgcccggcctgagttatacttttttagtattggagaaaaaaatctttgaagctagaatcttgcactcatccggattggcatttaaatatgaaaagtgcaatagaaataatctcagccgtataaaacctcagaaaggttgccacacaaagaccctattgaaaatattggctacaataatagtaggagactttaataccacattctcaatggcaaatattacaagtagacagaaaataaataaataacacaaacaacactgtagacaaattggactaacagacatatagagaatactatgcccaacaacagcagaatatatatttttctcaactgcacagggagcattctccagggtagaccatatgttaggtcacaaaacaagcctgaataaattttaaaagattgaaatcatactgtgtatctttcccaatcaaaatggaatgaaactagaaatcaacagcagaagaaaaaaataaaaattcacaaattgtggaaag

SEQ ID NO: 243289 - DNA, 609 bp, Homo sapiens
gttgctttcccagtccacgttacagcctgttacccgacggccttgacagaccaaactcttccttcacactggacagtttaggacaagctcatacgtcttccagcctctccaggtcaaagctcctgcctcacactggcctctataggcccaggtgctgaatcgcaatggtctgtttaggtccatctcatgcctttctcagactctccaagcgacgatctggcctgacacttgcttctgtgggccatgtgatcactcacactggcctctttaggatcaggggatgcctctccacaggccgagatcctgcctgttgtaggccccttcaggatgcgccgctgcctgacagtggaccctccaggcctagatgttacgtgatcatggcctctgcaggtcaagaatttaaattttcgcagcctctataggccaggctactgcctcctgataatggcttctgcaggcccaaatcgtcctgaaataagcctcgccaggaacagcacgtgtgttggatgcccgaacaaccatagcttctcccgcacagtggcccatgggggccgggctcttgcctcagcctggccacctcaggcccagttcttgcctgttggcggccgc

SEQ ID NO: 243290 - DNA, 483 bp, Homo sapiens
cctgctcagtcaaggccatgatgggcccagactgtctgcaagctggccgcagctctttaggccatacctggagcaaatcaggagactttcctatctggattctcctgcagtggctctgttatactgagaagcttctgttgtcatgtcacctgcctgtagtcctgtccctttcaagcctgggagggagggggcagctcttgtcccttagggctgaacatgcctctgagcccctgccaaccctccatctcatcttcttctttcttcttttggaggagacacaacacttcctgtggtgctttattgcagtggactctaggtgctgactttccatatttatacaaaagagtctaaaatcagaaacactaaaaccaattagaaataccttttttgatctcttaagcttgctaacaaaagccagggcctctgagattaaagacaaaataaagcaatatattcaacatttgtcctaagctgtctccacta

SEQ ID NO: 243291 - DNA, 370 bp, Homo sapiens
ggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagaga

SEQ ID NO: 243292 - DNA, 783 bp, Homo sapiens
caaaagatccctgagtatagggctatttagttttttttttagtatctgaaggaaatgagcctggctcaggaagaggggttcagaagcgtttcattccgctctcattcctgggactccaccaaaaacaaccaccaaaaagataaaatattgttttaattgctgaagcaaggaaactagcaaatgtctccaaacaataaattattaattatatctgccaaatgctgtcttgatggagatgtgagaaccaggtgggagaccgcatttactgcctccggtatctggaagggtgaggatttccctaggggaagtgtccttgtcccaaagttgatacccagggattctctgagtggagtggcagtgtctggcatcatctacaagctacaagagaggtggacatacattgtagagaacaagttcatgtggaatggagaagagtggctttaggagtaatgatggtaatacatatttttagatatccagataatgaataaatgacaatatagcataaagataaaaaataagattgtacaatattgaaggagaacaaagttggagatgctacctgattttaagacttactatcaagctacaataatcaagactgcatggtactagggaagaaagagacaaatggatccatggaacagaatagagggcccggaaatagacctacaaaaataatagcctgctgatctttgacaacggagcaaaagcaataaaatggaggaaaaaaaagtcttttcaacaaatacagctggaacaactgaacatgcacatgcaaga

SEQ ID NO: 243293 - DNA, 474 bp, Homo sapiens
actgcacgttgagggcaaggccatctcggactgcagaccctcacggccttcccacactttgtcctcacttgcaacgggggcttcgcgtgggcctcccctttctaaagcacccactatggatgcacagcaggacagacccaagtcccaagactgcctaggcctagtggcccccctagcatctgctgcagaggtctcctctacagctcccgtgtctgggaagaagcacagaccaccaggacccctgttctcctcctcagatccccttcctgccacctcttcccactccggggactcagcccaggacacctcgctgattcctgcccccctcacacctgcaagcagggatgccggcgtgagaagaatgttttgtgttcgaaattgtttgaggggtttgggtttatttttgttggttttttcttttttgtttttgcttacatgggcatccttcagcttttaataatctgaaaagctcta

SEQ ID NO: 243294 - DNA, 438 bp, Homo sapiens
ttttctgtgcttttcgctggtatgataaaaataattacactggtactctggtgaagatgagaagcatggattagccattatctgtgtctgattaatttttaaattccattaattacttattaatgcaatttggaagaaaaatctttcatcccatgatatgggcagaggagggagaaataataaaaggctgggattcccttgtttgtgaaaaggttggaaaataccacccaagtggacattggaatgtagaatgtgagcacgatgctgggcaggtgcactgtagcacatgatgtgccctgaaccagtggaaagggaccgtgtgatgctgtgcattctctgaacctgtatcctcttgaaaccaacaaacagaaggcatttttgttgtggagccctctgtacaatgtacagcaaaataactcagaaccagagatgttgctc

SEQ ID NO: 243295 - DNA, 376 bp, Homo sapiens
acataaatcgctgggcagagccgcctctcctgtcccttctcattttttgtttacttacgagcagctgagcagcccaagctttcccctacaccgacaggcacgtccaagcctcttcccccttccctcgggggcctggagcacctgcttgaagagtcagcctccctttgagaatagtttaacatatgaatttgaaactagttgaagaagaaactcaatccctgaatcattagcctaagtatctggcatgacagaatgggtctgttctagcagtgagaaatgaccttgactgtccttggatggtaagggcagaaaattgaaaataaaactcttttgatttttaaaaatataataaagtcctcaaaatagctatatcctt

SEQ ID NO: 243296 - DNA, 407 bp, Homo sapiens
caatttaaaggattcttaaataaacatttagaggaagaagaaaaaggtttctgactacttggggaagatgatgcagttgttaggtaacagaaaactgatctgtattttgtttttgttgtttgtttgtttcgctttctaataagaggataggtctgcctataagaaagagtagaacaaataatgtaattatgaaattgaagttcaaattagatgagaaaaataaaaaaattcctcatcgatttaagtgaattcaggtttcaggtgcagaagttgacagcccagagtacacttataagtatgtgagtatgattataaaagcacagttgatcatctttgagaactaatgggagaaatgaaaattggttatagatggatacatattccacttttgtataaaggatctaact

SEQ ID NO: 243297 - DNA, 171 bp, Homo sapiens
ataactacagtacagtataaaaatgaggaaagtcaatgaaatgttaaactaagaggtaaaaatcattggaaatgagaagacagtttgtaggtagtatgacttctagtttgacaaccgtaagaaaatcaataaaatatttaaaataaatgagacttaaggttgccatacaaa

SEQ ID NO: 243298 - DNA, 688 bp, Homo sapiens
gcttctccatcagcacttgctattccataaaataaaagtttgcactttgtctttccttaaatgtcatgaaccaacctctgctagctttcaacttttcttctgtagcttcctctcctccctcagcttcacaaaattgaagagagggagggacttgctctgaattaggctttggcttaaggaaatgttgtggctggtttgatcttctatccagagtactcagactttctccatgtcagcaataaagctgttttgcttttttatcattaatgtgttcacttgagtaatacttttaatgtccctcaggaatttttccttttaattcacaacttggccagctagcacaacttttgccctagctcgactttttacatgtctttttcacaaagcttaatcatttctaggttttatgtgaagtgagagacatgcaagtcttcctttcacttgaacacctagaggccactatagagttatttattagttggcctaatttcaatattgtcaatgcctcagggaataggaaggtctgaggagagggagagagactggggaatggctggtcaatagagcagtcacagcatacacaacgttgattgattgattgattgattgattgattgattgcaagtataaccaaaagacgacacagaaacatgaagcaagtgcatgctgttggaaaaatggtgccaat

SEQ ID NO: 243299 - DNA, 586 bp, Homo sapiens
gtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttcca

SEQ ID NO: 243300 - DNA, 379 bp, Homo sapiens
gcatttggttatagtcacttactggtctttattttctattttatttatttagctatttttttgcacaagactgtggtattagttatacatttgacatctttgatgtatattttattggaaacattttctcacaccattaaaaaattatcaaagtactgcatgatctcacttatatgtggaatttgtaagagttgatctcatagaagtagtgagtagcatcatggttaccagaggcttgagtggtcaggggagatgagggacggggagatattggtcaaagaatatataattacagttaggaagaatgtctgaaaatatccataagaggcaaatacatagaggtggaaagtaggggtgattgcccagggtggggagaaga

SEQ ID NO: 243301 - DNA, 582 bp, Homo sapiens
tttgagacggaatcttgctctgtccccaggttggagtgcagtggcgagatcttggctcagtgcaagctccccctcctgggttcacgtcattctcctgcctcagcctccagagtaactgggactacaggcacccgacaccatgcccggctaattttttgtatttttagtagagacagggtttcactctgttagccaggatggtctcgatctcctgacctcgtgatcttcccacctcggcctcccaaagtgttgggattacaggcgtgggccactgcgcccggccgaagctgtgtgtttttaagatgaaaaaaccagacacacagttgacgtcaactctttctgggaattactctcttgaagcccagaatgtgttttcatattagatctaaacaaattataggttcaaaatattaaatgtttacatacacaagagaacagaagcactcaaccaactctcactagtgatttgtcggagcacaagccgctctctgttcccccagtaaaacacactgctggcgcccacagccagggggctctctggcagtcctgtaactcttctactcccactggattaattgaatt

SEQ ID NO: 243302 - DNA, 441 bp, Homo sapiens
tgtgtttccatagcaacaagggcagctatatggagccattactcttctctgtggcttcagaggtcaggggccgtgttgtaggacattggatatgctttcagattaaggccttgggaatgagctttaagcagaagcaacatgttgcagaaacaatttggggcattggttgaatgatgcatttgatcattcgactgatcaaagtaaccaggacccatttacccatggaggagctgagtttggggtccagcccttctggaaacatccatgccatgcgtggtctccagaatgactcctgatctttgtcttgaccccaaatgacttcatcacttctgttccatgtacacacatgaagagccaaactcaagcacaagagtgtcgcaagtttgctttgctccaggacttagtgtaaagtttattctacaagggctgcattcctcttaa

SEQ ID NO: 243303 - DNA, 984 bp, Homo sapiens
ccacaattaaatttttcagatacatgaattatatttcatttataactaaaacgactaaccaaaccaaaaagacaatttctaaaatgtgtatttctattacttggtttctctaaagagagtaatggaccttatttacagcagattattaatgacttaaggccatgattccaaacatcagttaatgggctacacctgtggagtataatgaaccccctccgggtttttttttttttttttttttttttttttggtggtgggggttgggctttgggaattctgaaggctcattgccttgatagttgagactgtcaaattgtgtcttttattacgttgttttgtaattgctaatcttcctatgactaaatagtaccttaaaagcaaggattatgcctgattcttctctattccccacttttctgttggtgcttagaacaatgccagtaaaagttccgtaaatatttggttgatttctaaagatagcacaattctcttaacgttggctaaaaccacattagcttttttttgttttttgtttgtttgtttttttggcagacatctgtgttactcaggttgggcttagtgtcagaactcttttctttttcacatgaattgctgttttgccccaattggtgcttttttggactgttacctgaattgaagtaggtatttacatttatccctaagacttcacaaaagctaccactgtcacttttccccccataggaaatttcttagaaatgctgcctaattaggttaattttagcccattgtgctaatctgtcacaggttttttggggatcttgattcactattccaaaatatgcactgccttctttaatgtcaaatttggaaaaccttattttcctctagtttaagatggtaatacaaattaaaatattgtatagaaaatgtccaaggaaggtcagagctgtaaaggctgaatctcaacgctctcctccaggttgataatctatagatcatcag

SEQ ID NO: 243304 - DNA, 616 bp, Homo sapiens
gttttcactccatcagctaccaatgttaatacttccttgtacatctttccagaggtactttattatgtttataggtaataaaactgattaaacgtggagaacattacatatggactttaagttcactacagatatactcagaaaaggaaaaatggtccttattttaggtgccatattgtctgtgagaaacaaaatacagcaaaatgtgtcttttatttaaatacatcatatgcagacatttaagaagctcttttttcattactttgtagtatttttaaagctaggtacaaggaattttctggaccaaagttaccagggacctttgccccacagcatccaaccgcgatgaagtgcagaactcttgctgatagaacacctactattcccttgctccaggctttataatggcttctcctgatcttaagggacccttaaggcttggccgggcaaggtggctcccacccataattccaatactttgggaggccaaggcaggaggattgcttgaggtcaggagtttcagtccagcctgggcaacatagtgagatccctgtctctacaaaaaatttaaaaattagctgggcatagtggtgcatgcctgtagtcccagttactc

SEQ ID NO: 243305 - DNA, 402 bp, Homo sapiens
gacatgaatcaaataactgcagacaatatgaccacctccttctttcagttttggagtcatggattagtgattatatacagggctcaacataacccatcaaccatataaacaagaatctagtactccttcaggccagaagcctctctggcttataaaaccttagcaagctgagagataacccacaaatttatatgggaagataaccataatagtgtttgaaatgaaataactgctttcttagtggtaaggatattttaaccccaagaagataaagttaaaaaaaactaaagaaaggcacatgttattaatatatttctttatgaatgtatatgtaaatattttctctgggtaaaaaaacttccctaaagaagattaaaaacacttatatataacaggaaaaca

SEQ ID NO: 243306 - DNA, 247 bp, Homo sapiens
ccagcagtttcctctgcctggaacactttccgcagcgctggattacaactgctggtctccctgcctgccttccctgcttcccagagcacgaagaagcttgcctccgcaacccactatttgtgtgaccttggtccaggaactggactgggctctcctcctgaaagtgggtaaataatgtcaccgacctaatgaggctgttgaggcatggaatctgatcaggcagataaagtgcccctggcaaacctca

SEQ ID NO: 243307 - DNA, 475 bp, Homo sapiens
ggtctcactatgtttcccaggctggtcatgaactcttgggctgaagtgatcctcctgcctcagcctcccaaagtgttaggattacaggtgtgagctactgtgcccagctggctttcatctttagatattatttctttgggcttgaaggcttttataaaatagacctctctctacaagaggtaaatcttatgtctcactcagcagatggttgaactctaggtcagctactgaggaggaaatagaagaaggagtgtccctaacacattaatcccataaatatctagtgagcatctactatgtgttaggcacaggggcatggacatgaacaagacccagtcactgccctcaaggcttttaatctaatgaaggaccaaggctaggaaacaggtgattacaagtcccatgtgatgtatgctaatccaggaaggaattatgggagcacagaggagggacactgaactaagactcagagcat

SEQ ID NO: 243308 - DNA, 628 bp, Homo sapiens
atcacttctttacttcttttatttcacttctggctttctgtcctcccacgctgaggaagactgatttggtggacatgtatttattctgctgagtaccagttgatgtggaagtagttgttttatagtcaacatgtttttatgactaatgatctgtcttatgacagtttcacctataagaggaaatatacttatgtctaggtggactccaatgtgtctgtttactgatacttatttattcattattttcaagtaaaatgtagaagtgaataacttaagagaataactatttttatgagagaaaaatacccactttcttttttattactttgttcctctagaggttcatgaataatatattgaacatgtgaggagtgaggcctgtctagctcttttcctaacatcttccactcctgtggcctcttattaggtacctttctcagtgaagatatacaataagaattttgcatgcttattgggaatttatctgtgaaaaatcactcaaatgtcattaagtcttttctgataaaccttaatcatccaacaaccagagtttttatggcagtcaaggatcctggttccaagtatgagctctgaagaagatagactatgttcaccgcttactatagct

SEQ ID NO: 243309 - DNA, 574 bp, Homo sapiens
atcacttctttacttcttttatttcacttctggctttctgtcctcccacgctgaggaagactgatttggtggacatgtatttattctgctgagtaccagttgatgtggaagtagttgttttatagtcaacatgtttttatgactaatgatctgtcttatgacagtttcacctataagaggaaatatacttatgtctaggtggactccaatgtgtctgtttactgatacttatttattcattattttcaagtaaaatgtagaagtgaataacttaagagaataactatttttatgagagaatattgaacatgtgaggagtgaggcctgtctagctcttttcctaacatcttccactcctgtggcctcttattaggtacctttctcagtgaagatatacaataagaattttgcatgcttattgggaatttatctgtgaaaaatcactcaaatgtcattaagtcttttctgataaaccttaatcatccaacaaccagagtttttatggcagtcaaggatcctggttccaagtatgagctctgaagaagatagactatgttcaccgcttactatagct

SEQ ID NO: 243310 - DNA, 705 bp, Homo sapiens
tggggaacaacattgtcttcaaagacattttttctatcaacccaataaaattcaaaatgagaaaaaaagttgcattcactgttacgatttccctctactaccagataaaattccttattcattcattattttatgacatttaaataagttaaactagaaaatgacttttaaaaaaaaacagtattaatccatgctagggatgacacttgcttttagtgacagatgtatgtttcgttgagaaaatgaaggatattgaaaccatgttagaatacctcagataaagtgttcaccacagatgctttgtcagcctttcagactggctgaaatgaatctttcagaaaagaagccaaagaagatatttttaaaaattctgtaggtgacacaactgaagcgagaggttaggtcatttttaatgacctaactaggtaggaccatagagaaattgggggcacttactctgaactattcacagtgcttacaaggcagagatctgaaattgtgaaggacttcaactgctctgtgttgaatgcttttattatgtttggtttatgtagtttgtttcatctcccaacttgagatcagataaagtcatttatattttgtcatattttcttccagctttattgaggtataattgacaaagttatatatatttaaagtatgaataccacatttggggaatgaacctgtccatcacctcacgta

SEQ ID NO: 243311 - DNA, 425 bp, Homo sapiens
attttgtatcaagtgccaaaccttaaaaatagagagatttcaagtgctctctttttctggtttctcttgaaaaaacttgggggtgggcaatggggagggaaacatggcaggtgctgttagcccaagaaaatcagaaaaagaagtcatggtggctcacatctgtaatcccaacactttgggaggccaaggtggtaggatcatttgaggccaggagtttgagactagcctgagcagcatagggagaccccatctctacaaaaactttcaaaaaattagccaggtgtggtggccacatagctgcagtcctagctactcaggaggatgaggcaggaggatcgcttgagcccaggagtttgaaattacaatgagctatgatggcgccactacactccagtctggacaacagcaatacagtatgaccctgt

SEQ ID NO: 243312 - DNA, 398 bp, Homo sapiens
gtgatgctgatgacctggacagccaatcatcccccacatctgctttgtagtgttcctgtacggatgatataatatattggtgatctatagtttagtatcatagcaggatcacaaggaaagttacattggaaaggtaaattttaaactttgacgttggttttgcttgcattttttggtggactccagacgttgaatgcctgacatattctccagcatgattctctaccaaatcacttttgcaaatgttgaacttcaagaattttacctctaaaaaaacaaatacatttcactgaagtaaaaacgtattctagccaccaccacctaaaaatagttatttgaagttcttgctaagtagttctgaactaagtgaatcctcggagtagaaatacttaacttta

SEQ ID NO: 243313 - DNA, 402 bp, Homo sapiens
ctcagctactcaggaggctgagacaggagaattgcttgaacccagaagactgcggttgcggttagtggagatcgtgccgctgcactccagcctgggcgacagagcgagactccgtctcaaagaaacaaaaaaaacaaaaactgagtatccatgagccacgggaaccccctctctgtttacttatcattcatccattctgctgctttctcttggacacctgctacgtaccaggcctgctatgtaccaggccgcctgtgcgggctcaggacagaagatgagttagcacaatggcctcacctttcttttattttattttatatttttttaagacagagtcttgctctgtcacgccactgtactccagcctgggtgacaaagcaacactgcatctcaaaaacagaa

SEQ ID NO: 243314 - DNA, 591 bp, Homo sapiens
gtgaattaagcttgataattgaatatgtcagatgctttcattttaattttcatgtgaggctgaaaaagattttatatgaagaaagaggttctgctttttctttcttaatcagcctaccttttcccttgacattttacttacttcaaaagtacagtgtgggccgggcatggtggctcacacctgtaaacccagtactttgggaggctgaggcaggaggatcattttagctcaggagtttaaggctgcagtgagctgtgattgtactgctgcactccagcctgagtgacagagcaagactctatctcaaaaaaacatgctttagaaacaaaaataaggccgggcacggtagctcacacctgtaattccagcactttgggaggccaaggtgggcggatcatctgaggtcaggagttcaagacccgcttggccaacagtgaaaccccatctctactaaaaatacaaaaaaattaagccgggcttagtggctcatgcctgtaatcccagcactttgggaggctgaggcaggcagatcacttaaggtcaggagttcaagaccagcctggccaacatggtgaaaccccatctcaacta

SEQ ID NO: 243315 - DNA, 413 bp, Homo sapiens
aggaagtcttttttgcagtgatttatgtgctctgttcccagagcctgcccatactctcgaagagcaacacaatctgccgatcataggagcagggaacgttgaccttgctgcagggtttggacactccggaagccagacaggatgtgggagctccaaaggtgcagaaaaaggactccagaatgttgacttttacctctgtcctcgaaatcaccctaactctagttgtcgagattcttaccagtttttctgccctgactggacatgtgtaactttggccacctactctgggggatcaacccgatcttcaaccctttccatagcttgtgcttcctgtcctaaactgtggactaagagaaattgtaatccccttactataactgttcataatcctaatttagctcaatggaattaaa

SEQ ID NO: 243316 - DNA, 475 bp, Homo sapiens
ctcttaacgatgtaagcacggaattaattttcctcttatattattgcaagagtttatctgaataaatatcattaatgctaatctctggattaatctggccaaattccttatatagtgattttccttaatgaatattttcctattggccatactgtgttttattcccaaaggttatgtatggttaagtcggcatggagcagggataggaaggcatgttggcatgtgtttgtgcttttgaaaaaagccttcaacaaacacatgagaaacactattttcacagtgacagaaatggagtgtatctaattacttgtacacgcttaagtgacagtagtcctcctgaaatgttggagcactatatatatgtgtgtatatacatatatatgtatatacacacacacacatatatatatttaaaggaattgtgatgggttgatagctgcagccaacaatcatggcacacatttacctatataaa

SEQ ID NO: 243317 - DNA, 432 bp, Homo sapiens
gcgtggtgaacagaacacccacagccacagccagttcgacaaagcaggttaattacttacagacaggcagcgagggacagcggaagcctaggctgcatgactcactggtcccccgaggctcaggagcacggcccagggcagatagagtctcccgtgcttgccccacttgcaccacagctgaggactcagcagtgagctctgggttttatatgtggtggacacgtcctgggctagtgttacaggagaccccctctggaagggatgggaatgaggccagggctgtcctgggcagtttctctgtagctcaagttgttgcattctctgggaagaatagaaacgaagcccgggcactttcaggcagttcctcctttcttaggatggtgcattctgatatagtttggctctgtgtccccacacaactcttctctcaaa

SEQ ID NO: 243318 - DNA, 476 bp, Homo sapiens
tatcacaattcttcctcatattacctggtcctctccagtccagccagctccattgcacagcaagagggcacacatcatttgactaaaatgcaagagacccttggagtgcaagaaacaccagtaagtaagtggtaggtaaataattccatattcttggctggttgcaatggctcacccctgtaatcccagcaacgctggggttacacgtgggagccactgcaccaggccaagaaaaaaaccattaaaatacttccctctggaactgctccccagactctgttggtctcatgctttggcgtaggcatcgggatagaactggtttcttataaccagcaagcgctgatctttttcttttgtaactaaaacttttcctttaagaaaataaaatatgatggctaggaaatgcccaccagagacttccacccaattaaaacttttcctgtagttgggtagagctcaacttgttctccgtcaaa

SEQ ID NO: 243319 - DNA, 313 bp, Homo sapiens
gaatgttcgtatccctccaaaattcacgttgaaacttaatctccaatgcaacagtattaagtggtggggtctttaggagttgattaggtcatgagggctcctcccttgtgaataggattaggaaagtttttcgatggaggaaactagcttggtctagtttgcccttccagcttctgccatgtgagaacacagcaacaaagcatcatcttagaagcaaagactgggccttcaccaaacatcagacctacttgtgccttaatcttagacttcccagcctcgacactgtgagaaataaatttctattatttataaa

SEQ ID NO: 243320 - DNA, 457 bp, Homo sapiens
aacttgtttggttctgttcctctgagctgccttccatccagatctactgattttctattgttgaatttaaaaggactttttatttatgtacccgtggccaatttaaaggtatgttgaacgagttctttttttgttgtccttttatcttaaatagtcttagactttattattaacagaagtcattttaccttaaatcatagatcaggttactgtggttgcatgaatgggtgtttaaaaccgaggttgtcatgattaaattcccaccttctttccctttacacctcaggaaatgagacaaaaataagtaagccattccctagtgggttactccagtccttacaatcgcaggactatcagtatgccactgtattattcgctgtcctcaaaatggattttaatttgtggagaatattgagtaaacccttatttttccaataaagttttttcactttatcat

SEQ ID NO: 243321 - DNA, 446 bp, Homo sapiens
ctgtggaactaatttttaaatatcatttaagattttctccatactctgggtggtctcttcagagggaggctgataagcatatagttgcacagttattctatcttgatctctgttgatatggctgcagacatccttggggaaaacctacacctgttttggttttagcttttacagcgtttgacagaatcacagaataatcaacccaatgggaattccttaaaaggaatgtagaagagaagaggaggggttatccttaggccaggtctcccacctttgagccggacaaaaccagagtcacctaagactcttaggaaaggtcttttgcaggtcagtgcagtggctcatgcctctactcccaggaggccgaggcgggcagatcacctgaggtcaggagttagagactagcctggccaacatagtgaaaactccatctctactaaaaatac

SEQ ID NO: 243322 - DNA, 459 bp, Homo sapiens
tgtgctgcttggagcatcttctgctatcttgtatccattcagaagctgcgttgaagatggcacagcagaatgatgctccctgagaagaggatcttcaattcatttatgcctcccggagctcctggaacagcactgccttacagatagcagtgtgttatccagggctgacaccagaaccatttacagcaaggctgcctctgtcctcacaatattacttttgaggaagaaatcagaagaaaaatggaagacaaaaagagacagaactctttgcagtaggggcatctttttaaggaagctcagaatagccctccagaaccatttacccagacctcttcaatgttcaaacatgagcctgtgaagctcccagttcctccttttctcaattaagctataattagcagaatagttgttcttagatactttggtgaccttggaaatataagatattccagaaataga

SEQ ID NO: 243323 - DNA, 470 bp, Homo sapiens
agtttactgtggccttttgatgcatcattagtagtcttttggcttggtgaaattgagagagaaggctatcagtcactcagcaaagctgcttatgggacagataggctcataccacctgatatatgaaccactacatgtgattaacttcgacaggtagctcctggccggctggaagctgaagagcattttaagtacaaataatagttctggggtatgtcttgagtgatagaatgatgactgagtggaacagattcccttaattttagctcatgaaaacacatttggtttccttcagaagcggggatcctaccaaaaaatcaattaacaaaacttctcagagatcttccttgatacttggaagtttggcttttattgcacttatattaaatatgggaccaccctggggggccagactcattcatctcagtcttcaaagggcctatcatgatcatttgcaacaatttaataat

SEQ ID NO: 243324 - DNA, 374 bp, Homo sapiens
tttaaactcttaattttgaattgtttgtttggggatctccctctaaccacccatgccctttaagacataccagaaattcttgttaaaggagttggtctatgtatactgtacatttcatacagtgaaaattaatttaaatctatattttgtacgtagttcttatttgaaataaaatcctttaaggattactttcacttgaaaattgaactcataatcatactagaaattttgatgtgaaaaacttaataaatttattttcttcctaagaatttatagcgtttacatatataaaggatcatctgcctaaatgcataagttactgtaatgaaaaaccaaaggaaaatactattgccatgtagccaggcacagtcata

SEQ ID NO: 243325 - DNA, 421 bp, Homo sapiens
tgagagggaccagcaatggtggttatttcctctgtgggccccaagataccagcataagagagtgaggagacaagggtacagcaaggggtgactgagggagttcagctcaaaaatcctgccttcccaagatgccggggagatgaatttaggtctgactccattgagaagacacttggtggtgcctcaatgttcttttctgtaacagatgcattcatttgatatttatctaggacctactatgtagcaggtgccaggctgggtgctggggacacaacagtgattaagacaacagtgaacaatgtagatacttgccctctagctgaaaatataggaataaatgtagatataatacatactatattatatataattgtaatgtataatatcaatattataatatatagtgtcatatctgatatta

SEQ ID NO: 243326 - DNA, 567 bp, Homo sapiens
tagtttgtaatacaattttactcttcagaatatactaaagataatatttacatatgcgctgtatgtcacataatattctattttctcctgttcactttattgaggtataactgacaaaaattttatgtatttatgatgttaaatgtgatgttttgacatatgtatacattgtgaaatgattacatcaagctatctttcttgtggtgaaaacatttaagatctacttttttttttttagcaactttcaagtacacagtacatattttattttattttttatttttgagacagagtctcactctttcgcccaggccagactgcagtagcgctatctcggctcactgcaagctccgcctcccgggttcacaccattctcctgcctcagcccccggagtagctgggactacaggcgcccgccaccacgcctggctaattttttgtatttttagtggagaccgggtttcactgtgttagccaagatggtcttgatctcctgacctcgtgatccgcccacctcggcctcgcaaagtgctgggattacaggcgtgagccaccgcgcccagccta

SEQ ID NO: 243327 - DNA, 373 bp, Homo sapiens
gatttaaatacaccttcactctttatcagtatgtcctcatgaattaactaacagattaagtattgtcaggcgtggtgtgttccatcaggaatatttactggacagttgtagactagaaactgtttagtttatgtacctccttactcttcactgatgctttcttatttccagccaactgttgtctggcagcatgaccttaacagttatccttcatattagaacttgctttttcacggctgggtgtggtggctcacgcctgtaatcccagcactttgggaggctgaggtgggcggatcacctgaggtcaggagttcaagaccatcctggccaacatggtgaaaccccatctctactaaaaatacaaaacaattag

SEQ ID NO: 243328 - DNA, 423 bp, Homo sapiens
gagggtcgcctggtctccgcggcaaccgggtgccttaggattgtgacttcaccaccactgccttcgttggtggggacactccgagggggcggtatctgcctccctctagcccttgccttggtttcccagcctcccagcgccattcctaggcctcctgcctccaagcctctcccaccagcctctgcacctgcctgctggctcctctgagacgtatagagggagataaagtcccaccggcctcaggggagcatgcggcctgtttcaggggagcaggcacagtgctttaatcactcagtcctgacactgtaaaaattgggttttccgatgtcattagtgctttgtgatcggctccatttgtatcatgccagccccgttgcctcatctctgctaattgtttttactcagtcctttcatttttaaact

SEQ ID NO: 243329 - DNA, 217 bp, Homo sapiens
accctggttatgttaacatttccaagcctcgttttctttacctttcaaaaactggggataaaccttctaattctgcagcataatgtcaagaatccatgacatcaagcatgcaaaagtgattgtgctgtactttgcacatggtaggtgtacaataagcattacttctcctaaatgtctgtaactgcatatattaaagacattagatattacttgatct

SEQ ID NO: 243330 - DNA, 491 bp, Homo sapiens
aaaagggatgaggggatgacaaactagggaacttttgttaggatgtgctgctcgtggattctattggaaaggaagtttattgagcggggataattaagacaatcctaaaatgtaattaaatctctacttaaaagtaatagtcttcctatgggaccatgacacatctgacttcccagggaaaaatatctttgggactcaaccttgaaggtttattttcacataatctttaaattctaataagtgcttgattcaaatgtagcatgactctgcttaaagggaatgatactgctatatcagagacagataattacctgtttttcacttcctatgtccttagtaaatctgctttttctgaaccaccaactgtgtcctctgctttccagagagttctgatagccagtggacaaaaggtcatgctgaagttccagtgatggcattacaccgaatcatacaggatggtcagcattcgactattttgtatttgaaatatg

SEQ ID NO: 243331 - DNA, 392 bp, Homo sapiens
ctgtgtgaaaattatggaggcccatatgtgaattaaactttgaagcattttcacattctccatgatccacataattttaaggtaaaatacttttatgtgcaatgaatatgttgtattttttaaagcagatacctcttgttacacattttggtcttctgctatttttggaaattataaagtggattataacaaatactctagtaatggaaatttgtacacatcccaatgtgaagtgaaaggcattcaaattttataatggttaaattatatttaaagctcttgaaatacattgccaacttcactccagaagagttggaccaatttacaattttaatgagagtgccagcttacctaaaccctcattaaccctggttagccattgttaaaaaaaa

SEQ ID NO: 243332 - DNA, 425 bp, Homo sapiens
acgagcatccacctgagtgtgatgtggcacacccagacctgctgctctttggttcttagttctccacgggccccttctagcatcagcatcttcctaggctaagtatgagtctagtgtttaaagacacatattttttatacaacaggaagcctaagtagaaaacattttttttaatctggcaatgctagagggaattttgttcatattcctatttttccttttgtgctgacttttcaatgtgagattgttcaagtatataaagaacaggacaacgaaaacccatttatcaagtatgtagagcaagtgttcacatgttgccatatttgcttcatctctctatgctcatatccattttttattaaactgttacaaagttacagacatcatatcacttcacccttaatgcttcaaaatgtagctccaaa

SEQ ID NO: 243333 - DNA, 274 bp, Homo sapiens
gaccctggcaggtcattaaagattcctcaggagacctaggtattgtggctcagggctgtaattcccgtgctaatgcacgaaggctaatgcaggaggatccctcgaacccaggagttcaggacaagcctgggcagcatagcacgaccccatctctgcaaaaatgaaaataaaaagattgactgacatagtgatgcacttgtagttcccactactcagaaggatgaggcaggaggatcgattgatcctagaacgtcaacactacagtgagttatgg

SEQ ID NO: 243334 - DNA, 661 bp, Homo sapiens
ttttattttcaaacttttgcagtagtgctaggggcaaggtatgttggacataaatttaatttaaaaaataatttagacttctttcaagattcctgttgcaagaaaaagttaagactctaaatgtccactattcttaaaaaaatctaatgagtatgcatttcaaataatggttctgaattcagagcattctttttgacagtgtgtcaaaaaatacagtttttataatgttaatctaattgtatagtctcatgccaattaaaatggtgtagacttggtataggtttcaaagctacttgaaatgtaaaatgttgtctttaaaatgttttaaagataaataactaaaaggaggatattgaatgctctaacaaagaaatgataagtgtttaagatgatagatgtgccagtcaccctgatttaattactatacattgtacgcatcaaaacaccgctatgtatctcataaatatgtacagttatgatatgtcaatttaaaaaataaaatacatttttaaaagtttaaaaaattgagttctgaggctgaggtgggaggatcacttgaagccagcctcagcaacataatgagaccctgtctctataagcaaaatattttaattaagaattaaaaaaattaaaaattaagttctgattacaaaaggtttga

SEQ ID NO: 243335 - DNA, 506 bp, Homo sapiens
tacagggagcctggcactcagcatcctggatttcagaaccagacagaccccctgggtatccctcatcagccccaagggaaacgcatccacattgcaaatcctataaacacaggacaagactctgacccctgcctcagaagaacacttcctttctttagaaaacctcacttcttcagtgtgaaattctgtgaatgctgttactaatcctgtcacgagatgaatctcatttcaccaaaattaaattatgtttttccactaaaatgatgatacaagttgaagacacagcactctgaaattggaagacctcaccacttaaggctccgcagcggcttactcagctgaactccaggttactactctttactttgttcacccattggggagttcagtttgtttttaaacattgggagatggccattctaactactgttcaatgtctctgttttgggaaggcataacaagaaataaaaaggaatatatatgaagggaaaaaaaaaaacctcact

SEQ ID NO: 243336 - DNA, 277 bp, Homo sapiens
atatccacatgcaaaagaattaaatcaaacccttatcatataccatacacaaactcaatgcaaaatggataaaagacctaaatgggatacccaaaaccataaaagtcccagaagaaaacaaagggggaaagattcttgacaatggccttggaaattattctttggatatcacatcaaaagctcagtctataaaagcaaaaataagcccaagcttctgcacagctaaacaaaacaaaacaaaaacccagcaaaaaaaaaaaggcagcctacagattac

SEQ ID NO: 243337 - DNA, 738 bp, Homo sapiens
atgactgagagtttggcaggaaatgggttcgtggacctgtggtacagtcgcactaccacagcagcattggcctagcaaaatgttgagccctctttcccttgcatgctcccctggggcagaagtccagtgctatctccgcttccctgaccctctccactcagagcccagcatgacaagcacacctttaaatgggttcaaggaagggaatagcagaaatgaacgcagcccgacagcctcctttctcttgataacccctgtcactgtggagctggacttctaggctatctcacagaggcccagaggcactggaatcgatctcatttccttacagacatcaccttgtcaattagagaacacataacgttgattgaatttaagattcttatcagtgcctagctctttttctcccaaatccgaaattcagccatggcagatccataatcaagaaatatacttacattcccatcctttgttgttggtttcaaaaatatttcttttttgtgagtatgtatccatgttttacaaaccaaaaaaatgggacatatggtctgacaaagggaaggatatttgaacctggggactgcctgggagagtccggaagcacatggtcactctagagactgtcatcaagggctgctcctgagattaatccactgtcgaaggcattatcccatctcccttacagcagccttttgcaggaaactgtctaagatgttgtgctttttttctcattgactt

SEQ ID NO: 243338 - DNA, 409 bp, Homo sapiens
agtctttaatcagctttacattttaatttaaataaagtaatattttgacacagcatgtagttatgtgatttctgggtgcttttttaattgttgaagtttttgactattaagtactgactgtaaaacatctaatttgtttttggcttctgtgtactcatcttcctaaatctataatatgtatcacagtgtttgccaaagttgtttatagctgtttattaaaatatttattgtctttcttattataaaagcgttatacagaaagtataacaaaatgtaatgaaaaaaataaccttcaggttacagtgacccatgcctgtaatcccagcactttgggaggctgaggtgggaagataccctgagcccaggagttatcagcttgggcaacagagtgagactcccatctctattt

SEQ ID NO: 243339 - DNA, 1052 bp, Homo sapiens
tcagtgcaacatattatgcaatattataatcaactaacctcttcattgataatgacttcatattgagaggttttttaaatctagaaatattcttgttttaaattccaggttaaaatgtaaaggtatttttatttttttaattttaattcttctcaaagctactagtacattataaaacaacaatttcacatttagaatttttatatgtatataaattaggattattttttaatattagccttaactttctttaacttttatgaaaaacaactagtcccaagggtatttttactatttaatatacattattcctgtgattcaaaatcttagcagtagaacctgttgagctacttaactttctgtcttgggactatccaggtgcagttataactggtttcaaagttgtgaccttttccttgcttgtttcaaaatcattccttaaaaaatgttcagtatttttcttttgtcaaaaaataaaaacaggatttgtgggttgttctgttttttaaaattagtttgagaaacttcctttgccacttgttttctgtgcaaatgttgtaagagctcaaattccctgggggtagggaggacttttataaggtttttttggttgaagggtataaaaggcacttaaaaggtatacagttacttttatttcgatatcccagtcattttgacattatgataagctttccccactttataggttatctgaaaatttggtggggggcgggtattttatttatacttaatataacaaaattattttcctatgtgtagtcaatagcacatacaaaaaattatctcctgtttgtagtcagtagcacagtcagtattcaccgtgggttgggtattgtcagtccttctttttcagataactttctaaatggtcattcaatctgtaatcttaaacttttttaatgttataaattcttcaaatcagtatttgtattaaatgcagtgaccagactatgtcactgatacaatgtcatgattagatgtgcagaagactatgttacatggatgataaatgaacttttaacatatagaaa

SEQ ID NO: 243340 - DNA, 669 bp, Homo sapiens
attgtcacaaggaactaaaaacaaggcaaataagtgtttcaacttatgctcttagaaattatttcttaaataccacaaactgatttgggtatatcacaaggaaagatcagataattctaatccatgctgaacatgtgattttgaaacagaaacagtaaagatgaaaggtgaaagctcccatagtaggaccagtactggaagagagagagagtgctttttgactgatgtactctcgccttacctgagtcttttggtgtgaaatcatggtcttttagcactggaacaaaccttagagatcgtcgtgtagtcaaacatcttttttttgtagatgaaggaaactaaggactggaaaggtgaactaagttgcccaggtcaaagagctacttggaggaagaaaatctgaatctcaagaagttggtttgcaaacttctaagtccagtgttctttcttctctttccacacactgtttcttccactgaactcttcctctgaacaacaggagagcagcagcagtaataagtccagcaccatcaggtccgggccacagctgatttttagaggaggccccttgcacacaaaccaagtttgcttctggccaatagacctagaaattacaggctgatcttgctttactcctctatacgtgcttcagaaatgacttctttgcag

SEQ ID NO: 243341 - DNA, 520 bp, Homo sapiens
tgtgacacccaacaagatagacacagatgtatgaaacgctctacagccacccgaaaaaggtagaaattctgcaacaaaattaactggggaaaaaaaaactagggagaaaacgggaaaggaaaggcattgtccggaagaagcctcttgcagtgtggatgggaacctgccacagctgggcttgggcgaggggcccacggtgtcgctggggacttctgctgcccccagccccccttccttccagccagtggctctgtgagccgcctcttgtctgcatttcttgcaggaacatggagggaccggaacatggagggaccagtccagaatggccccacgtcaggagaaagagtccccaatccccagcccctacctcataggccaaatcactccatgtgggaggctgggaggcaaacatttttgtgtgagctagctactctgaacataatcataattgcattggtaaggaagaacaggaagttgtctcaaaataaagggggatcaggtggctggtccacttgttctt

SEQ ID NO: 243342 - DNA, 375 bp, Homo sapiens
cacaacatacagaaagtggccatgaatgtgaaccctcagctacctgccttcagtccagccgtctatgacacgtctcttaaaaaggttatatctggctgggcgcggtggctcacgcttgtaatgccagcactttgggcggccaaggcaggtggatcacctgaggtcaggagtttgagaccagccttgccaacatggtgaaaccccgtctctactaaaaatacaaaaattagctgggtgtggtggcatgtgcctataatcccagctactctggaggctgagacaggagaatcacttgaacctagggatggaggttgcagtgagctgggatcacgccacatcactccagcctgggcaaaagagcaaaactctgtctca

SEQ ID NO: 243343 - DNA, 365 bp, Homo sapiens
agttgtaataaggagcaaaaagcactccaaaatgaaatggccaatactagagagcagcagagctgtgcatcaccaggggtcactatgtcttcccagatcacagaagtttggcagttgtaacaaagcagtctatagacatcagaatttgtgtgaacgagatacagagagagaagaaacctttaaaatataaaaagtgtaatttatctagggtgactatagttacctataatttattgtatatttcaaaatagctagacgaaaaaaaaaaacacataaacacacagcaaaatcagcaaacaaaactaagtagcatttaggcggagaacagtggctcacgcctgtaatcacagcactctgagagcgcg

SEQ ID NO: 243344 - DNA, 468 bp, Homo sapiens
tagcacattgggcatgtggtaaagagataagagatgagggagagaggtagattgaggccatttatggaagtgttattaatttcatcctttctccactctgtgggatagtgggtggttattgcctttttagtgataatctgaggctggtgaataagtgacttgcctcaggccacatggtgagtagcagagccaatgttcaacttataaattctttgtgctctccactataccatgatgccaaatcctagctttttactaataagaagagattactttatatcttaatgtgcctgagccacagattttgatgtgagcattatcgaaactgtgatttttaaaaataggaccaatataacaaagttttactgattattgcatttacttaatcagatatgaatttccattcattcatttatttaaatatttatttccactgcttcacttggctagcctaaaaatatatgtatt

SEQ ID NO: 243345 - DNA, 460 bp, Homo sapiens
agctaagtaaagtcaatgaagggcgagtggccctatggccacctgggcacacacctgccccttggccaccttgcataggcaggctgaggaggtcactaaggcttggttttcctgacctgccctgattccacatgctgtaaggaggacccagaaggctgtgtggctacagaggtgcccagcatggtgggggtcacttcagtgtggacactagactggaccgcgtggaactacaaccagctcagagcgccagccagagtgctgttctggccagaaggaggagccaagacccacacccaggaggacaatgagcccctctctgcagacaggagccagccacacctggggtctggggagactcttcctgattccaaatgggactgaactttaaaccagactgggcatttgagcaattttttaaaagctgtcaaccaaataaaggaatgccattttctttacccag

SEQ ID NO: 243346 - DNA, 360 bp, Homo sapiens
tttcatgacaaaaaaggtcttccatggtgttttagttatgtgtctcagtgatgtggggagatatctcttctagggatgtaacagttttggtctttgatgcctgaattttcctagaaaaaaatgttttagcatttttttctcttttaaactaggagtgggagtcattagtgctcagtaaatatttctggtgaccttgtctgttctcaccttatctttgttggcccagtttggggcagtttacaactttaacagaggaaatctggattagttagagtaggcaaaagacatggaataaagaataaaagaatcaggagttgctgacttttaaaagcaagaaggcactgaaattatctagcatta

SEQ ID NO: 243347 - DNA, 687 bp, Homo sapiens
cggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgagtgagtcccacgggccaggacctc

SEQ ID NO: 243348 - DNA, 486 bp, Homo sapiens
cggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccagacgctgccgaaatgtttccagtgaagtcc

SEQ ID NO: 243349 - DNA, 562 bp, Homo sapiens
tgatttctattttagacccaaggaattaaatggatcaaccggggtgggggggcgttgaattccagtatttcgagttcctgggttttgggaagaggaagaggtagtggaaaaccaggagccaaatgaatatgcttcttataataaaatttgaacagagcagcgggtgggcctagaagcagtgactggggaggttagaattcttgcacgcagagaacccccccaagcccgctcacgcccggcctggctccgaaggtctcagaatccgagcctccaggccagattttccctctagccattcctggccacgcagcgcggagccgcgagcacacagaaaaggatgtcttcatcgccaaccgggatggaacgaacccgcccgctcagggagtactgagaactaaagggtccctccagcgccggccgcagccagcatgccttgactgcctccatcccgcgcggtccccactctccagaagcccccgccctgcccgggtgcgcgcgcgcacgagtcggcgaaccggggagctgtgcgctcggcagcctgcgggcggcggcggcggccgca

SEQ ID NO: 243350 - DNA, 403 bp, Homo sapiens
caccaaggagccggtcagggagtggagacctctcagggcacccctcctctggggaaggcaagtcacagaaaccaagctggaggagcactgtgggttgagcagcgtctccgaagactcatgtccaccagtacctgagaaagtggcctcgctcggaagcaaggtctgtgccgatataatcaaaccaggatgaggcgatactgggttagggttggccctgaatgcagtgtgagcagtgttcttgtaagaaaaggaaaattgtccgggtgcagtgtctcacgcctgcaatcccagcactttgggaggccgaggcgggcagatcacttgaggtcaggagttctagaccagcctggccaacatagtgaaaccccgtctctactaaaaaacacaaaaattagctgggtgt

SEQ ID NO: 243351 - DNA, 447 bp, Homo sapiens
aatgaccattgtagtttagcctacagggaatttaaaattgttcataaggcacttatgaatttaagcgaaagtattctgatttcttttaaatttctctgttggaggatgtcaatgggattttctttggcagatgctatggtctgaacagttgtgtcgcccccaaatttatatgttgaaatggtaatcccgaaggtgatggtattagaagagggggcctttgggaggtgattaggtcttgagggtggagctcttatgattggaattagtactcttataaaagagattcatctcagagagctagctagctcctgccaccacatgaggaaacagtcagaggtgtcatctatgaatcagcaagtgaaccctcattggacatcaaatctattggtgccttgatcttggacttaccagcctcaagaactgtgagaaataaatttctgtagttgg

SEQ ID NO: 243352 - DNA, 371 bp, Homo sapiens
tttccatgggagcaatattgcagtaacattttcagatgagacaaagacttttaataaacatttgttttattttattaaaaaaaagctgaaaggggttgcttaaattcagtgcttgataacaagggaatacatgggaattcttctcttccttttttgaactcttgccaaagagaaaaccttctgtgttaggcaaacgtatcagtagtggggggataccctagattaaagtcactgtcttcaaagttgtacatagttttacaaattaactttttttttctaaatatctcacatattcttagcatgctgaggctataataactcagttctaactgaggccctttctgggtactctttggtcaaccgggaccact

SEQ ID NO: 243353 - DNA, 396 bp, Homo sapiens
ctttctgggaaaggtaaaaccctggagacagtgtaaagatcagtggttgctggggctagggagaagagaggggaatttaagtacggcaccaatttctaaggcagtgaaataattattctgtgattctataatgctggatacatgtcatcatacatttgtcaaaatctatagaatgtacaacaccatgagtgaatcctaatgtaaactatggactttagttaataataatgtattattggctcatcaactctaacaaatataccacaataatgcaagatgttaatagggaattaaaagtgagtaataaagggtatatgggaactctgtacttttagctcagttttttccatttatctaatgctgctaagaaataaagcctattgattaaaaacatta

SEQ ID NO: 243354 - DNA, 301 bp, Homo sapiens
tcatttatctgaaattcaaatttaattgggcatcctgtatttgtgtttgcctcatctggcagccctactatggacacttctctaaattccagactcaagtccagtccacaggttgtccacccttctcagaagtccagggataagggatatggaccaatctctaaagaaaaacctccatttcaggaggagttatgctacaggtgcctgtgactccaggtctagatgctggctttcaccacttgacagggattccctgcaatgggagaggttcagtggcctggggctgactcatatctgagaa

SEQ ID NO: 243355 - DNA, 4326 bp, Homo sapiens
gaattcccaacacccaggtaatttttgtatttttagtagagattgggtttcaccatgttggccaggatggtctccatctcttgacctcgggatcctcctggcttggtctccaaaagtgctgggattacaggcatgagtcaccatatccagccaactgcagtcattcttatggggcaaacacttggctgaacccaggttttctaaagatacaaacccatgggcaacaccaagcattctaatggaataggcacctggctgactccaggcattctaataatagagacacctgggcgaactcagacggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaacttggctgcaattgtggaccttccctaccaaagggagtgttgaaactcaagtcccgccccggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgttttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttt

SEQ ID NO: 243356 - DNA, 1229 bp, Homo sapiens
  misc_feature (56)..(56): n is a, c, g, or t
gcacgagggcccgcacgcgcgggagttgagttttggaaagagcttctgtgccctgnctgctttttaagagtatatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaacttggctgcaattgtggaccttccctaccaaagggagtgttgaaactcaagtcccgccccggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgttttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttt

SEQ ID NO: 243357 - DNA, 473 bp, Homo sapiens
caatttcctggaacaaaaatgtgaaaagctaattccccccaccccctcatcacctgctcctctctctgcttttgccatagcaaagccctataaagaaactggccaccagggtcattatcagtctgagctgaaaatttgattaagctggcctcctagggttagtatgaaaaatgctacatttttgttcttggaccttaattcctctttccctcatttttgtcatgtttgcaaatttcatttgcatttaatttcctgtggtttgccaaagtccagactgagacttgagctgttgtttttattcaggtgagaagtgcaactgctactgaccatctgcactggcatctagtcaagcgattgtctgaggaaaggattttggagattcccatctgatattcttctatttggtctcttgtacccattgtcatcctgtaccacacataataaagtttaagaatgtcaagcaatcaaaaaaa

SEQ ID NO: 243358 - DNA, 3534 bp, Homo sapiens
ggagggagacggagaaaaaatgggaggaaggcggatccggggccgctgagcggtgggttctgccgcagtgttctctcgcctcctgctccagcagcctctgccccatggctcctgagctgcactggggagatgcccttctatcctgtctcagtttcccaatcctaaacgtccttcaaaaatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaacttggctgcaattgtggaccttccctaccaaagggagtgttgaaactcaagtcccgccccggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgttttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttt

SEQ ID NO: 243359 - DNA, 4113 bp, Homo sapiens
gtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaacttggctgcaattgtggaccttccctaccaaagggagtgttgaaactcaagtcccgccccggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgttttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaactttttt

SEQ ID NO: 243360 - DNA, 2714 bp, Homo sapiens
ggagggagacggagaaaaaatgggaggaaggcggatccggggccgctgagcggtgggttctgccgcagtgttctctcgcctcctgctccagcagcctctgccccatggctcctgagctgcactggggagatgcccttctatcctgtctcagtttcccaatcctaaacgtccttcaaaaatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacaatttttttttttggctgtacagtggaacttggattacactttaaattaactttctctaggaatcaaagtaacctctgaggacctcagcttgcacaaagaggattgagataacatttccaaagcttgttcttcttgagctgacccaacacttaggaaaacatgacatggatcagcaactccattttctgtgagaagtgcaactgctactgaccatctgcactggcatctagtcaagcgattgtctgaggaaaggattttggagattcccatctgatattcttctatttggtctcttgtacccattgtcatcctgtaccacacataataaagtttaagaatgtcaagcaatcaaaaaaa

SEQ ID NO: 243361 - DNA, 412 bp, Homo sapiens
gccaggagtggtctgacatgctgttacaggttgaaacccttgtatctgagtttcatacaattatcatcttaggttcagtgctctgatagtgcaagagttcttgaaagtaggaaatgttggctgggcgtggtggctcacgcttgtaatcccagcactttgggaagccaaggcgggtggatcacctgaggtcaggagtttgagaccagcctggccaacatggtgaaacccatctccactaaaaatacaaaatgagccaggcgtggtggcacatgcctgtaatctcagctactccggaggctgaggcaggagaattgcttgaacccgggaggcggaggttgcagtgagccgagatcacgacattgtactccagcctgggcaaaaaagagtgaaactctgtctcaaaaaaaaaaaa

SEQ ID NO: 243362 - DNA, 143 bp, Homo sapiens
atgaggaacttgagattcaagaagaggaagaattgcccaaataacttgttctttgtggctagaaaatgcttacatggaactcaccaggccacattcatattactatgtttgtgatcatccaaacataaaaccagttcctaggc

SEQ ID NO: 243363 - DNA, 470 bp, Homo sapiens
tagatggcattcgatgacctcctaacaaataatctgctacaaccaatagaggagctgtaacactcaccatgaaggtctgcagcttcactcctgaagccagcgagaccacgaacctactggaaggaatgaacaattccagatgcgctgcttttaagagctgtgacattcaccataagggtctgtggcttcattcagcgagaccaagaaccgactgattacggggacactgggtctacaggtgtgcaccaccacacccagctaatttttatattttttagtagatagggggtttcatcatgttgtccaggatggtctcgatctcttgacctcgtgatccaccggcctcggcctcccaaagtgctaggattacaggcgtgagccaagccaccgggcctggccacttacaacatttttataaacaatattttaaagcaataaatctccctttcctcatggaagaaatgtgaaaa

SEQ ID NO: 243364 - DNA, 563 bp, Homo sapiens
ctagaaaaatataaaaccaagtagagtgataaggagcgaatggggtggaatctgttaggttggtgcaaaagtaattgcagctttttgtcattactttgaagtgcaaaaactgcaattatgtttgcaccaacttaatactttatatgggacggtcagggaaggcctcttagagaaggtagtgtttgaactgagacctgaataatgagagaaggtaggcaagtgaacatctggagcaacagtgttctaggcagagggactagccgctgcagaagccctgaggtggagaccgacagaaccacagaatgacagaagattattgaaagaggagcaatgtggagcaagatgcggtctgagatttaggtgagaagcagagtgtgtaagaccttgtagctcctagtgagggatttaggtttatctaaggacccagagaaactacagaaggtgtcaaggaggaagtgagagatgactattttaacaaagatgttctattttcacttttgcaatgagatactgatatttggaataacttaccaaagacactgaaaatattggacaaaaaaaaa

SEQ ID NO: 243365 - DNA, 407 bp, Homo sapiens
tcgtgtgcttaggtgccatatataaaatatatatatatggctcatatataaatatataaatggctcatatatataaatatatatggctcatatatataaaaatatatatggctcatatatataaaaatatatatggctcatatatataaaaatatatatggctcatatatataaaaatatatatggctcatatatataaatatatatatggctcatacatataaatatatatatggctcatatatataaatatatatatggctcatatatataaatatatatatggctcatatatataaatatatatatggctcatatatataaatatatatggctcatatatataaatatatatatggctcatataaatatatatatatagtacgtgtgtgtgtgcgcaaaaaaaa

SEQ ID NO: 243366 - DNA, 318 bp, Homo sapiens
tcaggagactcttgaatcttatggagacatgttagtgagtctatgggccccaggacaagaagtccttaaacctaaacactcaacacactttttttttttttaaaaggcttgtgcttttctgacatttaataaacctaaattcaacatgatggtggcgaagtcataaaatactttgccaccatgctaagtgttcttaaaataagacacattcttctaatgtcacattgagaaatagagaactaacatcatcatatattggctactgcatagtaaataacaaaatgttgtagagcgttaaataaaaatcatcacagtaaa

SEQ ID NO: 243367 - DNA, 446 bp, Homo sapiens
tcgttttatgatttcgattaggcatttcattgctacggtttaataattgaatatacaagaaatactataaaccatcacatccccaacagcccccagccgcccagttcccccatctacttggcaaagattctctttttgaccaaactctaggcggcttcttctgagccctcttctggactaggtggccaccttggtctataaagacctgaacaaacccgaacatagttactaatagccccggtcttctcaagtgcctgcctgagaaaactcaattgatgccgccaaaggaatttactgtttgtttcagtcaacgtctgaagatagggccctcgtctcccaggctctggtaggagtggagcctgattttgatatgtgccagttatgaaacccagatggttccccactgtcagtggttactaaataaaatctgttttcgtcatttaaag

SEQ ID NO: 243368 - DNA, 698 bp, Homo sapiens
actgaccttcctcagattgagaactgtttccagtatatacatcaagtcactgaggtaggacaaaaattgctacagtcctattattttatggttattataagtgtaccaggactctaaaagaaacttgtttgtataatgctatccaaggtatgtagcccagggaataaccaacctgatgtgtgttatgacccattttaagcctcccgtgatcacagtttttaaaataaaattaaggactggtccttttctaggtgacacaagtaaggtaatagctagaacggaaaaaagaggggcccccaaaaatgtaaccttaaaatttggtgcttgtgccgctattgatagtaagcagcatggaataggatgcggttctctaaattggaaaaaaaaagtgacacagtaaaaaaaaaataagtgtatctgtcaagaattgtatttatgtgagatgtgtcaatactggtcttgtgtcatttgggctacttaaaaagaagataaaaaagatcctgtttggcggcttagttgtcttgggcaaaaactgtataatggtaccacaaaaagttacatggtggagttccaattacacagaaagaaatccattcagtaaatttccaaagttgcagactgtttgggcccacccagaactccaccgggactggacagcccccaccgggttatacgcagagcttatgctaagctccctg

SEQ ID NO: 243369 - DNA, 291 bp, Homo sapiens
aatgcaaaagaagagaaaggtgagcctggcagagtggatcagtgttccaggctgagctgtcccacccagtgggaaggttctgcacagcctggtggcaggcctggccatgtgactggccccaaccagtgaatgagggcagaagtgacagccacaactttctaaaggacctttaacatgtgttcctctgtctgtgcccatgactgtcaatttcctgggatagaggctcctcctttagccaaggccctggatggacagtagcacaacgaagaaataaacctttgctacagtaag

SEQ ID NO: 243370 - DNA, 214 bp, Homo sapiens
gcacacatgtgcagaagtagctgaaggctgagggtaaagcagaagcactgaggaatgtcctttggtaacctcaaatcacaaggttatagcagtccactgctggaggaatttgaagcctttgttgatatacaatgaactctaaattcagcccaattcatgactataacgaaaactaatatactaccactcaattaaaaatgtcaggacatacaaa

SEQ ID NO: 243371 - DNA, 597 bp, Homo sapiens
cagagtctcactcagtcacccaggctggagtgcagtggctcgatctctgttcactacaagctccgcctcctgggttcatgccattctcctgcctcagcctcccaagtagctgggactacaggcaaccgccaccacacctggctaatttttttgtatttttttagtagagacggggtttcaccctgttggccaggctgttctcaaactcctggcctcaagtgatccgcccaccttggcctcccaaagtactaggattacaggtgtgtgccactacacatggccaaagaaagtttaaatttaagataatgtagttactatggccagttaaagacataccacacaaccacaacatgcaagacacttccacaataagagaaacagaaataagatgtttaatattaagtagaggagattaagaacaaaacattaatagctgtattcaaaggtaaagtgtatgaaaaaaatttaacaagacagtcatatttgacatgtgctttaaaagaagaacattcaacaggctgaaaatccagggcaaataagggagaacatttcaggaagctaggacagcatgagcaaagggacaggagaaaagctcat

SEQ ID NO: 243372 - DNA, 442 bp, Homo sapiens
cagatcttggagggatggcatttgttcttttgtcacttcaaggatagcaagttcccatccaggaatgttaaggtgaaggtgaagctcactgggtagcttatgcagagtatttatcttccttataaatcacacaccttttctctgctgtgaatggagatttccaactaacatcccaagtgtatgtctcttccctgaccacacaggttgttatttacacagatggcttcccacagtcagacttatttttacctgtacaccatcttcctttttcttcccttacaatcatccagggctcttttccttgctccaatgatgtaattacatctggcttagaaaagtcatgtcctgcttacaaagaaaaaaaggccacttgatatagaaacatactttgctgtcaaaattacaattgtaataaatcaaggatcaaaatgaaaatgaataa

SEQ ID NO: 243373 - DNA, 666 bp, Homo sapiens
aggttaaatctactctaacatgatttacccaggcctcctatgacctacctctctggctgtatctcctgtctccctagttgtaccatttgttctagccttactgaaccacacttctttcccagattgcacagtgtgctgagccttccccacggtatcctcttaagatgtcaccttagataacagttcatccaggaagccttcctgattttctttggcttggttgggtaccttgctttatattccctatatgaatgcttttcctactagctatatgtaaatttttcttacgatagtatcacttgtttagttgtttatcttcttcactgttttttctcaagccttcagcacagggcctggcaaataatagatacccttcaaattttttgagcctatcaactaattggtcaatgtaattttataccgtgttccaataaagatttaaaatggctaacataaatttgtatcatataataatagcagtgccccagcctggttaagatgacgaaaccccatctctactaaaaatacaaaaattagccaagcattgtggcacacacctcttaatcccagatattcgggaggctgaggcacgggaatcgcttgaacctgggaggtggaggttgcagtgagctgagattgcaccactatactccagcctgggtaaca

SEQ ID NO: 243374 - DNA, 421 bp, Homo sapiens
ctgccaccatgcccagttaattttagtatttttactagagatggggttttgccctgttggccaggctggtctcgaacccctgacttcaggtgatctgcccacctcagcctcccagagtgttatgattacaggcatgagccaccgtgcctggcctggatcttctcttttctaaggaaaagccagaaattcgaattatttacttgagatctgtcaattttactttttttttttttaactatatggaccctaaagcaaatgaataaataatatgatatttgaatacgttttccagaacatccattttaagatacgtcatttttttagtttaacattaaaaaaatcgtgtggcccaacattatatgagccaaactcaccatctctgtatactggaattggcctgctataaccatggaaaccctaa

SEQ ID NO: 243375 - DNA, 529 bp, Homo sapiens
ccaagtttctgagatgtaatcagaaagctgtagtggaaggaaatttgaaccagaagactgcagtcctgtctatgaacgttaaacctgtgtggcttaggaaacgagtctaacctcgtctgagcctcagtttgttcacctaaaagatggagatgagagctcatttgtctcattctcaggggttatggtggccatccagacataaagaaattagaacgttcattcatctgcagatgctcacacattcctacaggatgactgaaacccacagcaaacaatcctcatggaatacagctcagctcatcctgaagaataagtgggaggtcagcctcacgggaaattcgatatctccacatgcagctgtcatgccacatggaaacagtcatgcatagggtcctgtcacctggtagactgaccccaggtccactgacccctgacaatcatcaaccgcttctgagggctccatgattgagatttgtccccaggaactcaggggaaactatatattgattaaaatgaactatcaaaatca

SEQ ID NO: 243376 - DNA, 531 bp, Homo sapiens
tctggcagcttaccagggcccgagatatttttagtactcaattttgaagcacagtcctcagctggtttccaaaggagtgtctatgctggcctgacactggcactccagagttctgcattgtgtcagttggaaacatggaatcatttgcaggaaaagccctggccaaccgctggttccaacccctctctatttatgcattctcttccttttttttttttttaaacctgtgattcatatgatttgagatccttttacaaattctatcacatgatgcgcaggggagagctgcctgccacagagctgagcacgagagtctagcacctgcgctgcctcctaggttggggttccaccctgccccgaaggcttttgtgactctgcgtgtcaaaaggggtggcactcagaggcgccacaaggaagcagcaggactatgcattgcagagtatttctcctgtgtgcccctaagcacttagcatgtatacagagtaggtccttggaaagttcttgttgaataaatgaccaacttttccttcc

SEQ ID NO: 243377 - DNA, 786 bp, Homo sapiens
aaaataggcctggcatagtggctcatgtctgtaatcccagcactttgggaggctgaggtgggtggatcacctgaggtcaggagttcgagaccagcctgaccaatatggtgaaaccccgtctctactaaaaatacaaaaattagctggacgtggtggcacgcacctatagttccaactactcaggagcctgagacaggagaattgcttgaacccgggaggcggaggttgcagtgagccgagatcacaccagctgcactccagcctgggtgaaaatgagagtctgtctcaaaaaaaaaaaaagagttcttctggcagggactagaggcaggagactgggtggcaggcagggacctgagcaggaggggaggggccttggccaggatgtggccatggggagagagaaaggtatggtttggagagagatgtgggaggtagagaggctgggatatggggagcgtggtgctgggttttgggaccagggacaagaggagtagaggctgatgttcagattttcaggttacgagagagggacatcattctggaggctttatgggccggtgttccctccccatcctcagcgtgaagctgaccaggggctcagtctgcctcctgggggtttctcctgtacccaggaaaccagatcgggcctcatgtcctgcggcagggcctgacaggaggatggagatctgggcccttgccctggggctgggtagcgaggccggctggctgctgcttctgcctctgtctctctgtcctgccccatcttccatccctacctttgtcatt

SEQ ID NO: 243378 - DNA, 347 bp, Homo sapiens
tacacacacacacacacacacacacgcacacacacacacacacagagtcaaatgtataagtactatataagctaataagctataagctaaaggggaacataaaaatgtatacacaatatctgtattgttttgtcatagaacttcagaaattaaaaaaaaaaaagctagatttattgaaattcatggcaaagatcttttggcttgaccataatggagtagctggtgtagcttttactttctcactataaggtatatacccaaaggactataaatcatgctgctataaagacacatgcacatgtatgtttattgcagcattattcacaatagcaaagacttggaaccaa

SEQ ID NO: 243379 - DNA, 723 bp, Homo sapiens
  misc_feature (723)..(723): n is a, c, g, or t
tactaaattccctgtgagattacagcctgatgggtttcccattctccatatttatttatttaaaatacagacaggcgtctcgatatgttgcccaggctggtcttgaactcttggccacaagcgatcctcccgcctctgcctcccaaaatgctaggattccaggcctgacaccgcgcctgaccccattctcctttttgagattttcttttcgtaacttctaagtctttgatttctgacttatttcgctgcttcagtaacaagccaagaggcctggcgacatctttaggtttgaaggcaatgggaaatagctgatgttctccatttcccatggagggatttcatgtagggattgttcctctcaaaaccaccaaagcaccttcttccaagtgaatcgattgcctcaaacaccaggcttaatgatctccttgcctggataaggtgttccaggtggtactgtaatttccgagttgtggtgcatccatgaggtgcctgcaggttcccacagagacagcagctccaaaatgtgcacgttgaaacttgcaagagactaaccgttgcctctgaaagcagttggcatgtatattcatcgtgactgttttacacatttgataacaaaaacaggagcaaaatacaagataaggcttggcagggtagttttaccaaaaccgaaggacaaatatataataaatattcatgcggccgcatttgagctatttgccattn

SEQ ID NO: 243380 - DNA, 183 bp, Homo sapiens
taggatgctgcctcactgttaggcaccttctttggctgctcacgtatttttcagtcttcaccactcctccctatgtgccatggccctcctcattactctttgctggactcttggaccattttccttgctgttctccataactttgaaaaacttttggctgttcccttctggtatttgcttgtt

SEQ ID NO: 243381 - DNA, 360 bp, Homo sapiens
aaacttgggaaggtttgttcagatttgagtttaaggactggaaggtgagttaggagtacttcttctgaagaagggaccggctaagttaaagcttagcgttcacaatcctgttgtattcatatttgtcttttttttttttaactttgctacctagcctaaaatatttaagtgagtaataagtactgtggctttatataatgtttgagtttagagtaatgataggcacctttttattcattcattaagtattttgagtatccattgagtatcagcaatgtatcaggcattgtgggacattgactcagggagataggcgtggttcctgtcctcaaggaatttttaaaaggtgaatgatcttgg

SEQ ID NO: 243382 - DNA, 463 bp, Homo sapiens
ttacataactatatatgctatgtaataatactcagcaataaaacttgatgcatgaaataaaatggctgaatttcaaaagtatcatgcaaagcaaaagaagttacatacagagactatatgtttccatttatataaaattctagaaaagattaaagtataggagtttacagctccagccaggggctgggggtagaaaagagggcttattttatacaggcataagagaatattttgactaatgaaagtgttatctattttgattgtggtgatggttgtacgactgcataaatctgatgaaactttgaattctgtacacaaaaaagggttaattattgtatgtataattttatctcagcaaacctgccttaaaaactgattgcagggaggccgaggtgggtggatcatgaggtcaggagatcgagaccatcctggctaacaaggtgaaaccccgtctctactaaaa

SEQ ID NO: 243383 - DNA, 394 bp, Homo sapiens
ttgattataaaaattgagtaattcttttcataactaaataaaacagagtggagaatccagtgggaaaacattctgggtacaaagcattgctccaagaatgtaattatctgcaagcctggctgctgaaactgcctgttgtaaccagaaaccagttttatctgtagcttctgaagtagcttactgcaactctagaactaatgtttgctcacactgttgtcacgcaaaaatcggagcttgccagctcaccaaatccttacaaatatcaatgaactttctcaaaaagcaatatgtaaaacctctaaccttctctttgctctttggagataccgaagaccacgtgtatgccctgaactgcaattctttcttcccaaataaaacactacatttagagatt

SEQ ID NO: 243384 - DNA, 495 bp, Homo sapiens
agggtcatctctgtgcccatgcggtcaggttggggctgaggcactttgatcattgctcctcctcagagtgttcttttcctcccctctcagattataataacgaggtagttacagagtgagctccagcctagatcgtctgggtttgaatccagctccatgactgtggccgtgttgcctaatctctctgagtctcagcttccttttctgtaaagtgggtataatagtagagtctacactgtggggctgtggtgggattcattgtgttcacacgtgtgcagggctgagaacagggccccaaacagggtaggcacaatgaagcatgagtcagaataataatacagatgacagtttctctatcactaatttgaacattgcagacagtgcaaagaagaaaattagaaactgggaggatcacttgagcacaggagttcaagtccagcctgggcaacatagtgagacccctgtctctttttaaaaaatttagcacaatttatt

SEQ ID NO: 243385 - DNA, 458 bp, Homo sapiens
ggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggggtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttata

SEQ ID NO: 243386 - DNA, 450 bp, Homo sapiens
aaaagaggaccaaacaaattctggagctgaagaatacaatgtcagacattgtattcaatagagagcttcaatagaagatgtgatgaagtggaaaaaataattaatgaactcggccaggggtggtggctcatgcctataatctcaacacttttggggggccaaggtgggaggatcacttgagttcagaaatttgagaccagcctgggcaacatggcaaaaaccctgtttctacaaaaagtacaaaaattagctgggcatggtggcacagcctttagtcccagctatgtgggaggctgaggtgggagaatcatttgagcctgggaggtcaagggtgcagtgatccccgactgtgccactgcaccccagcaagggtgagagagtaaggccctgacttttaaaaatacaaactcaaagatagatcattggaaattatccaggcagagtaacaaa

SEQ ID NO: 243387 - DNA, 521 bp, Homo sapiens
cagcgcagtggtgtgatcttggctcactgcagctttgaactcgtgtgctcaagcagttctccccacctcagcctcccaagtagccaggactacaggcaagctaataaatgcctggctaatttatcttttctagagatggggcctcactgtgttgcccaggctggtcttgaactcgtggcctcacgtgatcttcccacctgggctttccaaagtgccaggattacaggcgtgagtcgccatacctggccctattctttcttctgttcttttccacaagactgttaacttcagtggcttttttcctgttggaaaactttctacctttgatgatttaattttatcagctttttaactgttttaactgttcttaattctgtcttgtcaaccactggtatgtcaaaggaggcctcaaaaggctgaagcgattttcctcaaaaattacaactcttttttttcctgatattgtatataatgtataattaacactgttcactattaaatctttgcttagcaaaagagaa

SEQ ID NO: 243388 - DNA, 411 bp, Homo sapiens
aaaggtccattctcagtcctcatccgatttgacccttcagcagcattggaaaagatttattgagtgcttccaactccttgaaacattttctgcatttggcttctaggacaccacacactgctttgttttctctgtcacctttgccagtttctcctttgtccatgaccttgtaatgtcagctctttgtcttctttttaaagacactcccctttgatgaccccattttgtctcatagctttaaataccattggtatgctataacttccatgtttatatttttaacctaaatcttttcctaaattccagatttatatacccaactgcctactcaacctttccacttggatgcctaagcacatctcaaggtgatcatagctaacacagaactcttgggttttagcctgagcctgt

SEQ ID NO: 243389 - DNA, 260 bp, Homo sapiens
caaattcaaaattattctaaaatgcaaagttgatttaagaaaaaaaactaaattaccagaaaaaaataaagcaagaaaaagccaaactgttatgatatgttaatgtaggttcatcaaaggtactgctgtggtaggggatattgataattggggagactgtgcatgtgtggggacaaggaggtatctgggaaatctctgtaccttcctctcagttatgctgtgaacctaaaactgctttaaaagataaagtccttaattta

SEQ ID NO: 243390 - DNA, 413 bp, Homo sapiens
cagtggccctgggggtctcctccagctccacctcatgacaccccgtgctgctgcgtgactgctcctggtgccaaggccaccgctgccatgagtctgaatggctaatgctgagattagcagggcctcccttctactggcctgtcctcctggctctcctcccttttgcctcttctggatttcagggagcttttctgtgccaaaccaggaatcacagacatgcaggggcaagagggtctactctagcacggattaagacgacctcctaaagccatcttatgcccaagtaaataagtatccaataaacagacaatatctcaacagaaaaacagcacccactgaactcaagtgacctgcaactttcctgaagacctatatggcaaggacagacaataaagccagctagagaatgaaaa

SEQ ID NO: 243391 - DNA, 429 bp, Homo sapiens
cagtggccctgggggtctcctccagctccacctcatgacaccccgtgctgctgcgtgactgctcctggtgccaaggccaccgctgccatgagtctgaatggctaatgctgagattagcagggcctcccttctactggcctgtcctcctggctctcctcccttttgcctcttctggatttcagccattgcaggggaaatcctcatctttcccactcactgctacactcactgtgatgtgtttatagaccttcggggaccacacctcctccagctgtctgccttactcgaaaattagacccagcttgtccctgacttctagtagccagaaagtcttccacaagatccagccgcatgatacggagtacacacataaatgtgaaaacaaacccctccatcctttcccactgtaaatcaacagcacatgccctc

SEQ ID NO: 243392 - DNA, 330 bp, Homo sapiens
cactggtgtagtggaagcagcacccttggcgtgcacacaggtgtatccccagagggcagcctgagagcgcagcgcagagcatccgcaggacttgagtgggatcggaggtcaggaaccagtgacgttctggacacacccattattttcaactggttggtaccaggttgggccagtaggacctgcaaatactccagttgtggaagttaacagagtgtcctctctaggcgctttaattgccaccttcataacagccttgaaaaattccacccgccccccaaccttttaaatttcttttcttttcttttttgtcttttgaaacggagtctcact

SEQ ID NO: 243393 - DNA, 542 bp, Homo sapiens
agatcccacttcttaatacacttcgtaatcccacttcttaatatatgatagctgcttaatgtccttgtctactgattcttttgtcttggtaacttctgagcctgtttctactgactaatttttatcctggtcataggtcaaattttcatgcttttttatatgtctagtaatttttgattggatattgtatattgtgaatgcagtgtgattgggtgctagattttgttacatttctttaaagagtgttggaatttttttttttctcctggcgtacagttaagctacttaaagattactttggtcctttttagctttgtttttaagctctttttgagtagtttagagtaccttttactctagaaccaatttagctccattcctaaagcatggtctttttgagttcccttctaaattccatgcagatttagggaggtctctttattctggctggagggaagttgaatgattccataacctgtgtgaactctgggaattgtttatttactgctcccggctgataatagttctttccttagatcgtt

SEQ ID NO: 243394 - DNA, 547 bp, Homo sapiens
atcattttgtggttcacttaaatttgttggctttattaatagtcattacagcacagtaaaaataactatttctgatctatttccattatttttaaatcagccgttagataactagatactcagaccaagctttttgaagttagtttggttacaagattacacgttattcatccataagttcagtgagggccccaattaactctgtctcagattcaaatatggaagatacagcaaaacaaaccagaaaagctatgcagaaaatgacttaatacatacaacctagatcaaaacatcataattcatttataggattataataaacatcagttaaaaaccacatggaaaagaaaaccacattctaaaatttatcggttttgcatcattcattattccataatgccaaactatttcaagaaatcatttaattctggaagactagatatcagtctgcttcaatactggtgaattggttatcaattttttttcacatagtcctttggtgtggattttataaatgatctcagaaagagatctaagagatcaccta

SEQ ID NO: 243395 - DNA, 169 bp, Homo sapiens
caccttttaaggttagcaatacctgccaactaaaccatcctatagtatgccttaatattgtagggatctggtcactgatcaaaataatggtcactgtagagtaagaggtaggtgtgatctcataaatcattagaggatttggacagatgcaaccaggccgtggctaaca

SEQ ID NO: 243396 - DNA, 508 bp, Homo sapiens
ggcacgtgcaaccatgcccagctaattttttgtatttttagtagagacgaggttccaccatgttggccaggttggtctcaaactcctgacctcaactgatcctcccatcttgacctcccaaagtgctgggattaaaggcgtgagccaccatgcccaaaagttcttattgcctgcctagaacttccagaaccatggtgaataaaagcagtgataatagatgtgtttgtcttagtcttgattttaaagcaaatatacttaacgtttctccgttaagtataaaagttttctatgggcttttcatggatactttttctcagcctaaggatatttttttctcttcctagttggctttgagtttttatcctgaaagaaagttgaatgttatcaaatacattttctgtatctgttaagatgatcatttttttcttttaactgttaagatagtgaattttactgctccatctagtattaactcatttttttttcctgcagtaaactcaacttggtc

SEQ ID NO: 243397 - DNA, 388 bp, Homo sapiens
agctcaggtgactctgtttggaggccttcttatgaggagatgggggagttggctgaggcacttcccaggtacctccactgaggcttccttttggaggctttgactaaggtatttctgtcttatctgactcagtacttttctgcttctagcccttcctcctcttcctccccgtgggcccctgggttcatgaagatgcagagaggcagcagccttcttcagggcttctcagcagtgagacagtgtgccccaccccgacaacccagcagtgcatatttatctcaccctttcctagggaagtaatgaaacactggagaactagcacctctcattttgccccttgcttatactgtggcaagaagtgaataaaaacttgatggttacttttaat

SEQ ID NO: 243398 - DNA, 312 bp, Homo sapiens
cagctacagttacatgaaatatacatacacggacatacatgtttttactcaataatttatgaccagcccgactttgaggaaactgaggcctaaagaattcaagtggcttgtcataggtcacaccatcaggaagtggtagagccatgactccaaatcagacctatcagactcaaagtccacctcagccaccatcaccttgtcaacaacaacaaaggcctcgatgtgttgagcactttctgttgaccagacatcttctatgtaatatttcatttaccataacaagcccacaataaagatgtcattaacatcaaa

SEQ ID NO: 243399 - DNA, 302 bp, Homo sapiens
ggctaattttttatatttttagtagagatggggtttcaccatgttggtcaggctgatcttgaactcctgacctcaagtgatccacccaccttggcctcccaaagtgcaggaattacagatgtgagccaccatgcccagcctaaatcatactttttaatgttgaacttaaatgtagttaaatcgatgcactttgaatttgttacccataacgtatgttttaggataataggagaatttcccggttttcagcattagttcctggtatttacaatagttcctgtaataaaaagctgaattatgta

SEQ ID NO: 243400 - DNA, 404 bp, Homo sapiens
ctgtttaccagtgtttaaattacaagtgagaaatgtctgagagccagttctgtataagggtatgggcttaaaggtatggattttgtcatctttattttggctgcaaagcagggattcgagaggttgccttatagtcaacacatgatgaatggtgtgcttttcctgcttttttggtgcttgctatgtaagtagattagggtaaagtagggtaaatgagagttataaaagaacatttcgaatttaatagatttaaaaggaaatattactgctaattcttcaattctagctgctcctacccccatcccaaccttacaactatcttctctggtgagccataaactcttaatcctcattttaacctttcttttaatctggcattttgctgtcacatgtggtctccctat

SEQ ID NO: 243401 - DNA, 383 bp, Homo sapiens
  misc_feature (1)..(1): n is a, c, g, or t
  misc_feature (20)..(20): n is a, c, g, or t
  misc_feature (22)..(22): n is a, c, g, or t
ncccctggggtgcatggaantntggcacgagggctaacacggtgaaaccccatctctactaaaaatacaaaaaattagccgggcatggtggtggaagatgcctgtagctgaggcaggagaatggcgtgaacccgggaggcagagcttgcagtgagccgagatcgcaccactgcactccagcctgggcgacagagcgagactgtgtctcaataaaaacaaaacaaaaacaaaaacaaaaccaaaacagaacctcaatagaaagaaatccaattcccataatgttctccatgttttcagggtgggagagacagtgagcactggagcacctatttagccatgcaacaggggagctctttaactgtaaaggtcactttgctatggat

SEQ ID NO: 243402 - DNA, 1173 bp, Homo sapiens
taatgtagagatgaggtcttaccacatctctacataaaaggtggttatggagacccaaggtggtctcaatctcctggccacaggcgatcctctaaccccagcctcccaaagtgctgggattacaaacatgagccactgggtcccagccctggcttctttttcgtagatattattttaggagtcattttattgtaatatcagaagtattcatcatctctgtactataccgttctattgcatgactctccaccatatacttatccatcctgcttgctcagggacactggattgttttccattttaacttgctatgaacagtcctgcagtgaatactcttatacagaggagcaggcatggggtatgtactaatgaatgggactgctggctcagcggcccgcctggctttccactctattaaattgttttccaaagttatactggtttatgcgctcgctcaccgctcaccagcagggtagaagaattcctgatgtttgcaccctgcccaaagctggtgggtgtagcgtggtatcctaaggtagttttagtttggatttctccagacttctctaacttgaggaccttttcatattcactggccgctgtgattgtgcttttgtaatgtacctgctcaagtctttcactcttttctcattgcaaacgtacatcctaggtttccagcaggagaaacaggcctgtccatttctgacacaagatgggtgaatcggtaacttttctggtctgttttcccactgcttgttatccttctgttttctttaatggctttctgcctagatcaggagggacagactttcttttgaaacccaataacacaactgttatttcagtacagagctaagacagaaatagcagacatagttcaatggtccctgcacctagagagtgccgtggaaacagggcccagtcaccctccaactgcacagtcccatgaagccaaaaagacaatccaggttggagaatgtcacctttcatttaaggccaagttttgcagagtctgttttatttgtttttaagtctgctgcctaacttcttttgggtttttgtgaacttagaggacacataatctcactcttctagcagtttctctaggaggtgataacaatgcggacaaataattagccataaaacatcttggccaggcgcagtggcccacgt

SEQ ID NO: 243403 - DNA, 249 bp, Homo sapiens
gtaatatttatttcttataaataaatacatatatacacatagcagtcatgtgctgcataacgatgattcagttagtgacagaccccatataggacagggtcccatatgattataatggagtatatttgagccaggcatgatggctcattcctataatcccagttacttggcaggcagaggtgggaggattgttcaagaccagcctgggcaacattgtgagaccctgtctctaaacaaaaaaaaaaccca

SEQ ID NO: 243404 - DNA, 358 bp, Homo sapiens
aataccagcatatagtatctgacggagactcctgagccttccctgaaatttctacttcattaaaagtggacacttgctcaccctgggtaacatctacttgggtctcatgaactctaagagaataaagtgggtgagaaaactggaggaaaaaaaatgtttggggaagcaaggctgctttagaatcagctacactgagaggcctctaaacctttcagagtgcccagcttctctactcatcctttattggtgactggtgggggaggatgttaggggacaaaagcaactgattacgggaatgggttttttattttattttgttttgagatggagtcttgctctgtcgcccaggctggagtgc

SEQ ID NO: 243405 - DNA, 448 bp, Homo sapiens
gagtctcattctgtcacccaggctggagtgcagtggtgtgatcttggctcctgcaacctctgcctcctgggttgaagcagttcttgtggctcagcctcccaagaagctgggattacaggtgtgtgccaccatgcctggctaatgtttttgtatttttagtagagacagggtttcgccatgttggccaggctggtctcaaactcctggcttccagtaatccacccgccttggcctcccaaagtgctgggattacagacgtgagccaccacatctgggcctcccatcaatatttattctcagaaagaaatagtcacacttgtcaggtcatgtttacctggtcacccccagacactcatattttaatttttacccactggataattttcatattgcttccccaatttgtactgcctgtttctgtcccctccaaattcacacattgaagctc

SEQ ID NO: 243406 - DNA, 484 bp, Homo sapiens
gacacattatatattcatgcactgcatcatgatgcattagtcaatgatgagctgcctatatgacagtgctcccataagattataaaaaagttgaaaaattcgtatcacctagtgacatcacagtcattgtaactgcctagggcaacacattgctgatgtgtttgtggtaatgctggtgtaaacaaacctgctgctctgccagtcatttaaaaagccaaaaaaaaatttaaaaccataggaaaagcttataaaagaggaattaaacaaaatatttttggacagctgtacaatgtgtgttttaagctaaatgttattacaaaatagtcaaaaagttaaaaaattaaaagcatataaagaaaactattccagtatgctaaagtttatttattattacagaaataatattaattttataaatttagtgtagcctaagtttaagcgtttataaaatctgaagtagtgtacagtaatatcataggccttc

SEQ ID NO: 243407 - DNA, 950 bp, Homo sapiens
ggtttttttggtagattccttgaacatttctacatgaataattatgttgtctgtgaataggaaaaattgtattttttccattttgtatacattttattggtcttgctttgttgtatttgccagaattcatgatgttgaatagaagtataaaaagtaaacatgcttgcttgctcctcaacttaagggaagagcattaagttcgatgtcatctatatgaatttttgagtctccttttatcagattaaggcaattttctcttatttgtagtctgctgggggtttttattatataaatatattagtctttttcaaacgtatttatacatctgttgagatacttatgtggtttttcttttcaatctgttaatatagtgagttacattgattgcttttcttgggaaattgaccctttatcattatgtaatgtctcttgttttccttagcagtttttctacttcttaagtctactttttttggtattaatataactacccttgttttatttgatttagtgttttaattgcatctctttttgttctgtttttacaatatatctatatcataatacttaaagaaggcctctgataggatttcttgaatatagtggatggttttctttgtttgttttggtttaaattcaatatagttgatgtgtttaaactctttatttacattaagtataattattagcattgttaaattttgttctaatattttattattttgtttgatttctttgtttttctttcatctatttttctttccattatgtcatttgtatttcttgaatattatgcactattccatttaaatttatctattggctatttgtatctttttgtgcaatatttttagtgattgattacaatttgcaacttaacttttcaaagtttgcctagaagtaatatttactgcttcaagtgcaatgcagaaccttgaaaacatatgggt

SEQ ID NO: 243408 - DNA, 152 bp, Homo sapiens
gcctggagcctgcatattttgggtattgtgacatattgctgagctgaacacccaagggatgagagacttttcctgggccctgtctacagtagcccttgtgacatatgtctgcatccatcaccttggggatgtgatttccctctttttcatgc

SEQ ID NO: 243409 - DNA, 440 bp, Homo sapiens
cattgccttctctcatggtcatgttaagtaattattctcatgtgaggttactctgctaaccctcggcatttggctcacagcacagttattcccgcgtcagtgatgggggatggaaaccgtccatcactgcaagactgttcccatggctgaggagggagagatggtttcagtcctgttcttgttagtaacgtgttgagatgtaaatagattcatggctgatgatgttcccccatcaaagagttcatttagctcataggaagagtttgctatattctaaatttaacataaaataatgatgcaggaaagttttaggtttaagaaaataattttcacatgatacattgtgtatgcgtgtgtgtgcttgtgtgtgtgtgtaaatgttgctctggttccagcattctgatcaataaaagcagaagttcaggccattttatcctgaa

SEQ ID NO: 243410 - DNA, 650 bp, Homo sapiens
tagctcgtgagcgctggaagcatagtttggtgtctgacttggccaattccaaagcttgtgtgatttgcaccagcactcagatgcattcttccctctccctccctacccaagaaaaatgctatccctcccttttcctctaattagaaaattattttgtatagtaggagattattaggaaataatcatttctctccaaaagtaacacactgaggaggcagtatctgagggttttgcccaaatatggcctttcaacctctgaattcatgcctacagaaattccaagatgtttgtcatagcatttttattctaaccctccttaatgagtgatacagtttgcctgtgtccccacccaaatctcatcttgaattgtagctcccataatccccatgtgtcatgggagggaccccatgggtggtagtttattcatgggggcagttaccctcatgctgttttgctaatagtgagtgagttctcatgagatctgatggttttataaggggcttttcccccttttgctgggcacttctccttgctgccgccacgtgaagaaggatgtgtttgcttccccttctgccatgattgtaagtttcctgtggcctccccatccctgaggaactgtgagtcaattaaagctcttttctttataaatt

SEQ ID NO: 243411 - DNA, 478 bp, Homo sapiens
cgtgaaagaggacatcaagtgaagggaaaaatcatggtaggaaagaaagatgaagccagcagtccccactcactgagctagaagacctggaacactagacagaggtggttctgagcttcctagtggctgaggagaggagtgaaagcggaccccagcccctgatccagcatgggaggatgaaagcacagccattgttctggagacactttctggttgtcattatacaggctccctggaggatgtgcctcctcccccttcaggatttagctcctctacttcccctgggctggtgtgggcacattgtctgtgctttgacagtccctagatcccatgtgttctagaaccttctctcccaaagcagaacttttttttttttcctgttttctgttttttaaatctatctcagcctcctgacaagcaataagatttggaatatttgttgaggggataaataaatgaactccttagtcagtgcaga

SEQ ID NO: 243412 - DNA, 428 bp, Homo sapiens
acagcccgagggtacccaggccaggagggccctgtttatccccatttgaaatgggaaaaagcctctgattaaaccgcttgcccaagtctcctggcagtaagtggtggagcaggatttcgtcccagcctcatgctgtttccacatccccacagtggccccgggctgtgctccttccctggacctgagcttcactattggaccagatgagcctctcggatccatcccagcctggcacgtctagatcctgcctcccaacgcaggctgctgagatgttcacttgaatctctcaccatggacattacccaaacattacctaatgttttccagagagaagaatcctatttctttctgtgttttagattccaaaccaaaaagggacataattgtgtggtgaaaataacaagggacttcaaatcagaaaacccaaa

SEQ ID NO: 243413 - DNA, 451 bp, Homo sapiens
catgtaataaactttttatgaatgaaagtcaaatgatcaaatatttttctatatgccttgttaaaattataaacaataggcaatcataaaaccataaaaggttttggcagaagatataatctgattactatttgaaaaatatcattctggcagctggacaggctggaaaatatcattctggcagctggacattctggtaggggacaggctggaagttggggagactatgtaggaggatggtataatacatagtcaaagtagaggtgatgacagctttgattagtctgctgagaagggggttctgaaatcatatttcctttttaacttgtttatctcctttcgaatgtacgttccatgagagtaaggactttttgttatttacagatatatccctggtacctaaaaatgtacgtggcatatagtagactctcaataaatatttgttaatgaa

SEQ ID NO: 243414 - DNA, 319 bp, Homo sapiens
gcaggagaattgcttgaacccgggagccggaggttgcagtgagccgagatcacaccattgtactccagcctgggcgacaagagtgagactttgcctaaaaaaacaaaacaaaacaaaaaagtatgtagaatggaactggcatgtagaaagttctcaataaatgatggtttcattaaaagtttatgtaaatctgtctctaattttcttttgagagagtaccagtgaaagggtagggtactcattcacttacatagcacaaaaccgcttgtattgggacttttttggttgcaaatgacagaaacccagtttaagccatctt

SEQ ID NO: 243415 - DNA, 335 bp, Homo sapiens
cattgatcttttctaaataactccaatctgcctccctttggattttaaaaaatatatatatatataaatatacatatatatagcatattgttttacacactgacgaagtatgtttctcctaaagtgtaagtaattctaaatatgaaaaacaaccacagactacaaaaggaaaagatattaatgcagaagtttacttctcaactccttagtattcctaacaaaagccttatatcatacacagatatgtgtctggtacttgcttagtcaaattcctaccatctctcatacagcctaagggaaaagttaaagaaattcatttgccatttaaatgtttt

SEQ ID NO: 243416 - DNA, 386 bp, Homo sapiens
ccaaaaaaaaaaaaaaaaaaagagaaaaagaaaagaaaagaaaaaagagtaagcactcattgatagatgttattaatacatgtggagaatatataaaaactggaggtatcattgaaaactatactccttgggataaaaattagtataagtcacagagttaacaatcttaggaaactagctacagataaaaatttttgtgtattttaattatttaaaaaagcataccattaatgattctatttcccatttggcaaaaattatttatcttaaatatattgtgggttactttcctattgcacatgaattactgaaattgatttctaaaatattttttctatttttctattaccatgagttgggtctttttgtttccagtatatatttca

SEQ ID NO: 243417 - DNA, 477 bp, Homo sapiens
ccctcacaccgtaactttgagcaaagcatttagccctgcctgtgtctctttaactataaaggagaaacaataatacctaccaaagacattttcagaagaatgcagtatccttggatgaatggcactgcactgaatgatattacaatgctatgttttcagcatctttaaatcatctttaaaatcatgtgctcttggccgggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcaggagagtcgcttgaacctgggaggcagaggttgcagtgagctgagatcgtggcactgcactccagcctggacgacagtgtgagactccatctcaa

SEQ ID NO: 243418 - DNA, 315 bp, Homo sapiens
cagacaacactcaattccttgtagtcgcaggatttgtggacttgcttcttcaaagccagccacagagaaagaacagcagggaagattgagaaagtcagtctcgtgaaggacatgtttactttcctttctgccatgattgaaagtttcctgaagccttcccagccctgtagaactggtttggacagtgccttgcatagaggagatagtgtatctctgtcttttcaggatcctgtattatggcttggcaaactacatctcacagaccaagctggcccaccatttatttttgttaataaagctttattggaacacagc

SEQ ID NO: 243419 - DNA, 559 bp, Homo sapiens
agggctttggttgatggaccttgcactcaagtgaggagacagaccatgcctttcaagtgcatgcagctcactgatttcaacctcaagtttccacacagagcccaccagaagtatgtcagacaagcctggcagaaggcaaacatcaatacaaaatgggcagccacacgatgggccaagaagattgaagccagagaaaggaaagccaagatgacagattttgatcattttaaagttatgaaggcaatgaggaacagaataatcaagaatgaagttaagaagcttcaaaaggcagctctccaaaagcttctcccaaaaaagcacctgctgcgaagcgtgctactgctgctgcagctgctgctaaagttctagcaaaaagatgaccgctgcaggcaagaaggctccagcttagaagcttcctgcccagaaagccacaggccagaaggcagcgcctcctccaaaagctcagaagggtcaaaaagctccagcccagaaagcacctgctccaaaagcgtttggcaagaaagaggtgattagaaaagtaataaaagttctatttggg

SEQ ID NO: 243420 - DNA, 577 bp, Homo sapiens
acattttctatgaaagccgaatctatacataacttatgactcagcaataccatttctaggtacatacttagtgttcagtagcattattcatactagctacagagtaaaaacaaccaaatgtgcatcatagtaaaactgattaaatatatttaggcatctggaatatgatgcaatcatacggatgactgatttatggctacacataaaaacacagatgattcttacagtgttgagccaaagaagtcaaatactaaagaatgaatattgtgtaattgcattcatataaattttttaaggcagaaaaaggatagtttttagagatggatgcttatgcagtaaaacttatgagaagtaaagaagtgttaccatatatggacggcagttacctttcttggggttggagggtgtcctgattggaaggggacactaatgggatttctagggtcttgctactattctgtctctttgcctgagtggtgaatgggtgtatttcatttatgagaattcattatctgtacatttgttttctgtacttcactgtattttatacttcggaataaaaaggattcaaaataaa

SEQ ID NO: 243421 - DNA, 459 bp, Homo sapiens
aaatgcttctcccttccctgttgcttttttatagcatcctgttcttgtttcttgggtgcaatcatttctcttgtctctgatttgagtgtcacccggcaagatctgactgagccattctgctgggactctctcaggctaatgagattactcaaagaatattttaatctcatgcctaaagatgtgaactcctggcaccctggagacagggagttcctaaatccttcactgaacccatttgttttcaatacaggacacctgcctcaactgtgtcagtgaacttccagttcagagacgctatcctttcttggccaggtgtagtggctcaacacctgtaattccagcactttagggggccaaggcaagagcattgcttgaggccaggaggttgagaccagcctgggcaacatgatgagaccacatatctacaaaaactttaaaatacacatacacacactaatt

SEQ ID NO: 243422 - DNA, 1060 bp, Homo sapiens
tcagcctcccaaagtgctgagattacaggcatgagccaccatgcccagccatgaatttttttttaagacccaacagtatgctgcctacaagagtcacctcacttttaaggacacccatagactgaaagtgaaaagttggaaaaagatactccatgcaaatagaaaccaaaagaaagcagggatagctaaacttatatcagacaaaatagactttaagtcaaaaactgtaaaaagagacattatataatgataagagcatcaattcatcaagaggatataacagttatatatgcacccaacattgaaacacctaaatacataaaatattgaaggatctgaagggagggataaattgcaatacaataatagtaggagactttaatactctacagataatccagacagaaaattaataaacattgggcttgaacaatactgtagaccaaatggacctaactgacgtttcatccaacagcaactgtatacacatccttctcaagcatacatggaacattctccaggatagatcaaatgttaaggcacaacacaagcctcagcaaattttagaagcctgaaattatatcaagtatcttttcagaccacagtgttaagaaactagaaatcaatgccagaaggaattttggaaaattcacgaatacatggaaataaaaaacatacttctgaacaacaaatgggtcagtgaagaaattaaatggaaattaaaaaatattttgaggcaaatggaaacacaacttattaaaatgtatgggatacggccaggcacagtggctcacacctgtaatcccagcactttgggaggctgaggtgagcagatcatgaggtcaagagatggagaccatcctggctaatagggtaaaaccccttctctactaaaaatacaaaaaattagctgggtgtggtgacgggtgcctgtagtcccaggtactcgggaggctgaggcaggagaatggtgtgaacccaggaggcggagcttgcagtgagccaagatcatgccactgcagtctagcctgggtgacagagtgagactccttctaaaaaa

SEQ ID NO: 243423 - DNA, 831 bp, Homo sapiens
atttcttttctgtgtgtaaatagttgttttgttctttgggacagggtcttgctttgtcacccaggcttgactatagtgccataatcatgactcactgtagccttgacctcacaggctcaaactaccctcctacttcagcttcccgagtagctgggattatgagtgtgcaccaccacacccagctaatttttttctttttttggatagagacagggtgttgcccaggctggtctctacctcctggcctcaagcaatcctcctgcattggcttcttaaattactggcatgagccaccatgccttactttggctagtcctatattctctagaattctctttactttgtgctagccaatctctcatgctgttcccctgttataatgaataattatctatattaaattttagcactttgggcttttgagtggtttatgtctcctgattggaccctgactaatacagagttgatgctgggaagggtcccaggagacagacccacacagatgggatttggggatcagtttggttatcttaggggccgtgctgagctccttgcaatgggaaatgggatgctgttgatttccaggaagtgacctcacaatgactcaagctaccacttagtgttgattgtgatgaaatgccagctgtggcatatgccttgggagctaagtggctgctgcacttgaccactatgaagactggtgtggaagggtccttctggatgtacttgggcagggtccccaacgccggagccatggaactgtaaggagccacacagccggaggtgaatggtgttgaatgagggaagcttcatctgtgtttacagccactc

SEQ ID NO: 243424 - DNA, 443 bp, Homo sapiens
gagacagtcttcctgtgttgcccaggctggagcacagtggtttgatcttggctcactgcagtctcaacctctcaggctcaagctatccttctgcctcagactctggggtagctgggacaacaggtacgagccatcatgcccaactaatttttgtgttttgtagagatgtgtttcatcacattgctctggctggtctcaaactcctgggctcaagccatccacccaccttggacttctaaagttttgagattacaggcaggagccaccatgcccggccctattctcttttacactggtttattgtgagggcctccaattgtcttcctattaggcttgctcacttcggcctgttcactgaagccagaggaattctcctaaaaggcaaatttggatcaaaatagttcttgattaaaacctgctggtgactgcccattgcctttaag

SEQ ID NO: 243425 - DNA, 400 bp, Homo sapiens
aagcccgccagttgaactcttaaaggagccccccggcccgggttacgaaagctttccctttcaaaattttttatcctggttataacgggcacacaagggtttcttttttttttttttttttttttcctgagacagggtcttgctctgttgtccaggctggagtgcggtagtgctatcacagctgactgcatcctcaacctctcaggctcaagcagtcctcccacctcagcctcccaggtggctgagactgtacgtgcttgccacaatgcccaactaataatttggacttttcctatacatgggttccaaagggctgactgcgaaacgtgagtatgcatggattttggtatatgcagagatggggggctggaacgaatcctttctgtatactgacggacga

SEQ ID NO: 243426 - DNA, 360 bp, Homo sapiens
ggctagcctgtagtttcatggccttttttccatttgtggtttttgccaggtggaatttaaatgaccttttatcaagatggataaacgcaagtttcccagtgctggaatacagaaaatggatggacaagtaagtcccactcagcacccatagcccagacatggggacctcaacacacctgggccccagacatcacctttcattgtgagtagctcagagatgacacttcgttgttaagtgcccactggcaatagtttctataacagcaagtgaaggaataaatagtcaccaaaacattttctgttcccaattccaacattaattggatgagataattattttatgaaaattttcatatagca

SEQ ID NO: 243427 - DNA, 746 bp, Homo sapiens
gagacagtcttcctgtgttgcccaggctggagcacagtggtttgatcttggctcactgcagtctcaacctctcaggctcaagctatccttctgcctcagactctggggtagctgggacaacagcctcagccaagatgtctcaccctactctctatgatgcaacaagaagcccctggggaatgtttcagtcccagtctgtactattgtcatgtgctcatcacagtctggtggaatttaaatgaccttttatcaagatggataaacgcaagtttcccagtgctggaatacagaaaatggatggacaaacagggtcttgctctgttgtccaggctggagtgcggtagtgctatcacagctgactgcatcctcaacctctcaggctcaagcagtcctcccacctcagcctcccaggtggctgagactgtacgtgcttgccacaatgcccaactaataatttggacttttcctatacatgggttccaaagggctgactgcgaaacgaagtgacctcacaatgactcaagctaccacttagtgttgattgtgatgaaatgccagctgtggcatatgccttgggagctaagtggctgctgcacttgaccactatgaagactggtgtggaagggtccttctggatgtacttgggcagggtccccaacgccggagccatggaactgtaaggagccacacagccggaggtgaatggtgttgaatgagggaagcttcatctgtgtttacagccactc

SEQ ID NO: 243428 - DNA, 360 bp, Homo sapiens
aaaaaaagaaagtaaatggacttgccacagtgtacaggcaagaggaggggaggattatcctaatcaattactgagccaattgatttttttttttgcgttaacgtaggtattttgaccaagatttgtaatgtctagtgtgtgttctttatggcagtgtttcatcttttggcatccttgaaatgtcagttttgtgtaattgtctcatgaacaatgaattatgcacaccctttaataaatgtaaactaacaattggttttgggattgtcttcttacaaaattatttatcctcttaaagtttaaaaaggctttagagactgagaggaaaatgcatttgattaaacagatagtactgatgaactc

SEQ ID NO: 243429 - DNA, 996 bp, Homo sapiens
aaagtagtgcatttttgagatgaagctggctttcagtacaaacatattctaaattatgctggtggctatgcagtttttctctgtgctggtcatcaacaattagatttagatgtgtttgagcacttgaagaagtactatgaaactgaacttaaataaaagtatttagcaattgtgatgccaaaaagctttagcttgtgaagctttatcaatttccaattcttaaaagcaaaggttgtaaagaggaggacattgaaactgatccttgtagaaatggagccaattaaataataaaggcacaaactatgtaaaacatttaatttttaaattatattattggactccagaatatttaaacttgtgagatgtagtctgataaatctcctatttttaattggataaacttgcaatatataccaaaaaggataaaatttacaaaaaaaaaatttgcatgatctccatagtcataaattgagacatctgcaatgacttttgtctgataaaaaaatctaccaaagacaagtactctgaatggaagcaaaaacaagagctcttttaagatatttgaactaaattggacccttatcttgcactatggataaaaatcatctaaaaatggacaaaatacctaagtgtaagacctgaagccatagaactcatggaacataggggaaaaactccacaacattggtcttggcaataatttttttgggatgccataccaaaagctcaggctacaaaagaaaaaataaatcacatcacacactgggccctgtcatggggttgggggaggggtagggatagcattaggagatatacctaatgtaaatgacgagttaatgggtgcagcacaccaacatggcacatgtatacatatgtaacaaacctgcacattgtgcacatgtaccctagaacttaaagtataataaaaaaaagaaaaaataaaccaatgggaatacatcacactaaaaaccttctacacagcaaagaaaacaattt

SEQ ID NO: 243430 - DNA, 431 bp, Homo sapiens
ccaaatccaacagatgcctgagaggcaaatgtgcatttggattggaaaccactctctctgagaaagaaacaaaaggtgatccttgaatctgaaaacaattccttgttttaagagcaactatcattctttatattgattgtgccttatttttaaaaaatgctcatgttattagaacctttgtaaaaatgcttatcttactattttaagtgaaagggaaaatttaaattgcagatacagtatgacaacaattatggaaaattatgcccagaaaaaaaaaattggcagaaaacacacaaaatgtcaaaaactttaacgggaaagatctttaaggttatggtgagctttttcttttactttcacgtacttttcttctatatcaagttttacatttataattggggaaaaataaactgtttgtttctttggacatg

SEQ ID NO: 243431 - DNA, 475 bp, Homo sapiens
gggcctgggaatttttaatttctgacagttcctcgaatacgctgctgctgctggagtccgttttgagatagggtgcctttgagaattcccaggtggcccagatgggagaatcgctgctgggcttcagaggatgtcccagcagttagaatgttgtaaggacacgtcgcagaaagccttgaaagcaaagtggccaggttgtgactctggtaggcaaaacaggcaggttcatcctcctggtatgcagctactgagatgcaaggtgctttttaaacattgtgcagctcttagattggtgccccagggaaggacaggccccatcaaggctagccaagagcagattgattacatctgtggccaaagtgtaggcgataaaatgtcatccatcagattctctaatcaccggtgaacatgaaataaggcaaatcagctgaagagtctttcagtaagtaaaaataataaaatgcctaaactgctt

SEQ ID NO: 243432 - DNA, 558 bp, Homo sapiens
cctccagaagttctccatcctaaaaatcctttcctctggttatttctactggtaggacagaaggaaacttaattttaaagaagctcagccctggtgcagtggtctgtgcctgtaatcccagcattttgggaggccgaggcagacagattgcttgagcttaggagtttgggaccagcctgggcaacatggtgaaacctcatctctacaaaaaatacaaaaaattagctaggcgttgtggtgcacaacacctagggtagttagtcctggctaccctggaggctgaggtgggaggattgcttgagcccaggaggtcacagctgtagggagctgtgatagcgccactgtactccagtctgggtggtagagtaagaccatgtctcaagaaaaaaataaaataaaaagtatcctcagttgcttaactcagttgcaacttgtaactccggtagcttttcactgtttatacctaacactttgtctcctcatacttgttcttttattttttgtttaacagctttattgagatataatccacataccatataattcacccagtttact

SEQ ID NO: 243433 - DNA, 720 bp, Homo sapiens
gagggggctatgttgggcaccagtggagtgagagtgtatggaaatgaattgggcagaaagaaggcaactgacaattgttgaggatttattgtatatcaataagctgccctaaggcttcacgtatgttatttaatcctaacaggagggctgaaatgcatacatttcccccattttatacatgaagaatctgaggcacaaaatggttatattacttacctatgattacacagcccttaaatagtagctctgggattggaaccaagatctgtctgaatcccagagccagttctttcttctgatgtggagttgagaggagttgaagcagtgagggtggacttccacatggtggactgcccgtgttttcttagtcctcctccctggacaaaatgtggcattgtatgtgagcgtatgttctctggagtcagctgggctgggttgataaaaatcctgggtctgccacttttacctgtgttgccttgggcatattacctaacctctgtgagctttagtatcttcatctgtgatgtggagtaacaataccaagttctcagagttgtttggaagtttaaatgaaataatatctaaagctttaaaacatattactttctttctcttcttactttgagactcatcttgttacttctggattgtaacatttagtgttatatagatccctttagagtaggattggtctggattcaggactagatccacagataa

SEQ ID NO: 243434 - DNA, 490 bp, Homo sapiens
caatgctttcttctggaatatctccctaaggaaccagcctgaggatcttttacacttaactttatttttattttttaagtagaaggaatacctaaaataactataaaagtatagtagagtaaatacataaaccagtaacatggtagtttataatcattattaagtattacatactatacataattatatgtgctatacatttatgaaggtaggttcatttacaccagcatcaccacaaacatgtaagtaatgtgtcgtcctatgaagttgtgatggctacagcatcactagagggcagaaattttacagctccattacaatcttatggaaccaccatcctatatgcagtggattattgactgaaacttcattacgtgctatgtgactgtaatgtacattaactgtcttaaataaaaatctaaaagtttttaaccttttatttcttgccttactgctgttctttttaaaattattcgttttaaataactag

SEQ ID NO: 243435 - DNA, 1252 bp, Homo sapiens
aacctcaaatgttttaatggtgggatcttattcactgtgtacaggattctctaaagagaccacctggctgggtgctcaaaccacacgggctgacccaaaagacaccaaaaccaagagttgctcgggaggcactaaatgttgacggtcttggccagcttcacatcctcaatttcagcagacagccagcagtaagtgtgatgaagccgcagcacctcaatggccttgagttccagtggtgttgcctgaataccaaggtcttctaagctgggcaggtgagacaaggtcatgtctgtgatgtgaatacgctccactttatcccttgttgtccaggactcaaatgggcttatttcaaagtctcttgctacccactgataggcaaaaggtggcaaggggtacgggaggaagtacccctttgctgtgagccacagcaaagatgtacttcaccaggtcaaagaggagatatcgatttggcccaacgaaagcaaaggttttcccattggcatcaggatccttaactgcattaacaattcctttggatacatctacgacgtatactggttgtttaactgccttccagcccaaggaaacaaggggtatagcaccaaaccaacacatatttgcaaaataattaaggaatctatcctctcttccaaagatgtccaacagctttacgataatggcttctggaaatgtgtctctcactgctttctctccaacagccttctttctcaaatatctagaagagcttttaatattcacattcagatgtgcaacatgaatgaattttccaacttcagcttccttggacacctgagcaattgcttggggaatcttcacaaaaacatcctcaaaatcaaagtttttggtttcccagtctcgtccaacaagatttatgaccacattgctgtgttccactactcgtcagatagaatctttatctctcgcgtcccattccagaaacagaagctagcccaggtctcccatgggacgaaggtgcatgatgtcacatgtatcacaccgatagggtatgatcacctgtgaccccacgcgtccaaggtggttgacaacacatcggcccaggaatcctgttgctccaaacccagtggccacaatcccactgacttgaggaacattcacctttcccatgaggtatgagggcatgatgaagctggcaatggagtgggctgtgacacacggatgtggctattgcagtaatggcagaatgtgacattggcagggcccagacaacccg

SEQ ID NO: 243436 - DNA, 365 bp, Homo sapiens
aacttttgatgttatttatatctgaatatacagaattaacactataaagagcctgctaagactagacttccaggctgagcacggtgactcatgcctgtagtcccagcattttgggaggctgaggcaggtggatagcctgagctcaggagtttgagaccagcctgggcaacatagtgaaaccccatctctatcaaaaatacaaaaaattagctgggtgtggtggcacatgcctgtggtccccactacttgggaggctggggtgggaggatcacttgaacctgggcggtggaggtttcagtaagccgagattgcaccactgtactccaacctggatgacggagtgagacctcatctccccacccccc

SEQ ID NO: 243437 - DNA, 421 bp, Homo sapiens
caaggtttgttcatgctcccatactgagctggttataagtgggtcacccctcatggtagcactttaagaggatctccggctttccaagatgaatctagagctatctgaattttagaattcaagaaaatgatcttcatttccccaggattacttcctagagaagtactcaggcagctactaagtgttgcatgaatgcttgaggagctccaggtacccccaagtcctgtgcctctttgggattccgtgatctaagccagttgcctctgttttctccctgaatggcttatgattcagctttcttaggtctgctaagatatttatcactgctgacaaaatatattcttcagaaatagaagacagattcaaccttttataaaaataatagagatttataaaacaaagaatgtgctgcaaatataaa

SEQ ID NO: 243438 - DNA, 254 bp, Homo sapiens
gaagctagccatgttatgaaaacactcaagcagccctatggagagatccacgtgacagagaactgagacattctgctaacagccaatgcaagtgagtcatcttggaagagggtcttctaatctcatttaagcctccagatgactgcaacctcatgagacccccctgaaccaaaacaacctatctaagctgctcctgaattcctggccaatacaaattgagtgacataataaaggcttatgttacaagatgctaa

SEQ ID NO: 243439 - DNA, 529 bp, Homo sapiens
gacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataatttt

SEQ ID NO: 243440 - DNA, 448 bp, Homo sapiens
gtgcctggcagatatataacaggctaggagatgtgaaaggaaagaggaagagggggaattggcataaactggagaccttgcatctcatataaagggggcactgcttctcaggtccagccagctgttgtcagaatgagccataggcccagtgcgtcagagctttgattttttttttaagagacatatgaaattctgatttttatatgcaatctcccaatttttatgtgttggcgagtcgatcaaaccctcaaacattctgcaggctaaattcagccagcaggtgtccagtttgcaaactgtgctctaaggatttataaggccattatggaaatctctaaatggagtcatcaggagagtggcctcaaagaaaaggaaaaacttgagattggccttaatagtacgtagagaggagagaggcaaggtaaatttctttaatcttccagaaggg

SEQ ID NO: 243441 - DNA, 107 bp, Homo sapiens
agatccccattgctatagaaaagagaaaaaagcatgcggaatagaacgctgtttcttggagatttctcctgaaaaagtcacgttatttcttctcacctccattggca

SEQ ID NO: 243442 - DNA, 407 bp, Homo sapiens
atcatggtaggctttcttttagtagctgtatagttttagcttttacatctataattcattttgtattaatttttgtgattggtgtgagggaggagtcagagttttttttgcttttgttttttttcctatatgtatatgcaattgttctagcaccatttgttgagaatgctttacttgttttggggccgttgttgaaaactattcaaccttattattgtgggtttatttctggactctctactgttctatagatctgtttgtctattcttgtgccaataacaagctttcttggttactgtagctttacagtaggtcttgagaggtcaggtttcttgtatttccttatgaattttagaatcagtttgttaatttctgcaaaaaaaataaagcctgctaagattttcatt

SEQ ID NO: 243443 - DNA, 340 bp, Homo sapiens
cattaactgagataggggaaactcaaggagtagcaaatttgagaggtagaggggattgaagagttggatttgaacatgttaactttgatatgctctttagacatataattggtgttattgaataagcagttcagtataggagtctgagttcaagggagtctggaggtacaaatttgggagctgtcagcatcttgattgtatttaaagacataaggctggtagaaatcacttagtatatgagcatagatagagaagaaaagaaaagcgagcattagaccttccagcatgtagaagtggccaagatgagtaggactcagtagaagagactttgaaggagtgc

SEQ ID NO: 243444 - DNA, 333 bp, Homo sapiens
atgtagcaataaaagagaatgaagcagatctgtatatgctaatatagaaacatttgcaagatatattggtaagagaaaaaagccaagtgcagcagacttttaaaaaagatgtctgtacatacatttgtttatgcataaaaaaattctgaaaggctatccaaggaattgttaacattctcttctgaggaattagacttggatccaaggtaggatggaaaataactttctcccatttaatcttttctatcatttatttttttaactatgtgtgtatattacttttataattttttgagagttaattaaagtaactaaattctcattatacccact

SEQ ID NO: 243445 - DNA, 571 bp, Homo sapiens
  misc_feature (504)..(504): n is a, c, g, or t
  misc_feature (508)..(508): n is a, c, g, or t
taatttttgtatttttagtggagatggggttttactatgtgagccaggctggtctcaaactcctggcctcaagcaatccacctgccttggcctcccaattttgccattttatattaaacctgtgtgtgtcccttggaaagttgatcacttagatttgtttagcagtcacttacatcagtggtagatctgaaatttcctagataccaaatgtctctttcttccttgagtttctagtaagccatttgaaagttcatgtttcccgtaaagtttatttttgaatacaagaatttatgggaatgcaggctttttaatttttaagcattctaacactgtcatcaggttgtcgtcacaaaaatcctttgaaatgcctgaatgacatctccaggaaaatcactaattgtccagtgatgattaatgtttttgtattacactaatactgtaatacttagtccttttctaggagattgtgagaatttactctaataaatgaacagagcagtgccntcanacctaccaggtgctttcagagtcacagaatcctctagaggaagtgtttactcgtgccgaattc

SEQ ID NO: 243446 - DNA, 542 bp, Homo sapiens
  misc_feature (475)..(475): n is a, c, g, or t
  misc_feature (479)..(479): n is a, c, g, or t
tacctaatgctcgacaggtagtaaagagtagattattcggcgggcacagggctcacaccgtactcccaattttgccattttatattaaacctgtgtgtgtcccttggaaagttgatcacttagatttgtttagcagtcacttacatcagtggtagatctgaaatttcctagataccaaatgtctctttcttccttgagtttctagtaagccatttgaaagttcatgtttcccgtaaagtttatttttgaatacaagaatttatgggaatgcaggctttttaatttttaagcattctaacactgtcatcaggttgtcgtcacaaaaatcctttgaaatgcctgaatgacatctccaggaaaatcactaattgtccagtgatgattaatgtttttgtattacactaatactgtaatacttagtccttttctaggagattgtgagaatttactctaataaatgaacagagcagtgccntcanacctaccaggtgctttcagagtcacagaatcctctagaggaagtgtttactcgtgccgaattc

SEQ ID NO: 243447 - DNA, 180 bp, Homo sapiens
agctgcctggggcacaggcaggtgagcaggaacgaagctgctgtgagccaggcaggagtccaggtcacctgtgaagttgtgggacctgcagcaaagcactgcctttccccagactcaggtcatccatctgtggaacaaggtctccaatttccctttcaagccagaggcctacactggctg

SEQ ID NO: 243448 - DNA, 381 bp, Homo sapiens
tagtagaaatataaaaacatgtgtaagaatgaaaattctgggcaggcaaggtggctcatgccagtaatctcaggactttgggaggccaagataaagacatagtggtagtagtacagcaactgagaaccaagagaactctttcacaccaaatcactgccaggtggagcacattcctaaatgtaagagacatactgtactattttccttctgtaaaaacagtaaaacacaatttataacagaatttttataatacgacagcaggaaaggatttcttacacaaaagactgaaagcattaactatttaaaaagattaataaattggactacattaaaatcaagagcttttactcatcacaaagtacaataaaaaacgtttaaagt

SEQ ID NO: 243449 - DNA, 437 bp, Homo sapiens
aggcttaggttgaagaccatccagaagcaggtggtgtgctagatttggcccatagtccaactgtactttctgtgatgatggaaatgttcaatatttcctcaattgtctaatatggtaaccactagccacatgtggctactgatcatttgaaaggtggttacatggactgagaaactgttttttttttttttttttgagatggagttttagtttgggaagaagaagtagttctggaaaagggtagtgatggttgcacaatcatgtgaatgtacttaatgctactgaactttacaaataaaatgatcaaaatggtcaggtgtggtggctcatgcctgtaatcctagcactttgggaggtaagattggacgattgcttgaggccaggagtttaagactggcctaggaaacatagccagtccccatctctaccaaaaaaaa

SEQ ID NO: 243450 - DNA, 279 bp, Homo sapiens
aattctaatttttatgatttaattttaactctcttcttagtaacagaataattttgtatgtgttgttttataatgaccatcaaattattatatgatctttgtatatttatatttctcttgcaaaggtaaaatgtggacacaacagcactgattccaaaagagatatgcttttcaaattcaaaattgctgcttttgagaccaaaattatcaccctttgatttgaatgatagattatctatgtggaatggatttgacctaaggcaattaaagatacttttg

SEQ ID NO: 243451 - DNA, 345 bp, Homo sapiens
atggccactgcaggaccccatcctccactcgaccacacttctccaggggccagaccacacccaaaggcctggagatcccctaagggagcacaagcatcaggggaggactatgcagcttcagaggcatttccaagagggctcaatgtgagggtgggaaaagagcctgggggaagggttgagggagttggaaagtccctggccctcatcagatgaagactcttgacccatcttcctgcaacggctggcccccccatgcacacaagacagtcactagggctctggccaagaactaggggcttgtgatactgatcctaccacatgctctggaatgaatttggaatagaa

SEQ ID NO: 243452 - DNA, 567 bp, Homo sapiens
actgccagttgccaccttgaatagagctgacggcttctgcctcgctttcttggagccctaagctgccacgtagaaattccaacgacttcactggagggaccactcagagaagtgttgaagctgcatgagagaaggctcaactgagcccagacttccagccacccccgactgcatggtgtagacacatgagtgaagccttcttagagcctccacaccagaccaccctccacctgtatgccactgagcaaccccacggggagcagaagaaacactcaacctgccgcaattcctgagttctgtggattatgagcataacaacatgactgttgatttaatctacatttggggtggtttgttatggggtaatagatatctgggacacattcacacatatacatcctagctgtgtgacctcgaacatgttacttaaggtctctgacatcagtatttttatcaacaaaattgtaataatagtgtctacctactatgggtgttaaatatatgtaagaatatatgtaaaataatatatataaaagtaaaagcagctagcatatgtttggatcttaa

SEQ ID NO: 243453 - DNA, 592 bp, Homo sapiens
gatctactaacactattgtgtttaaccaagggagaaatgctgaaagcctgaagaagtggtaggagtagaaaagaggggccgatgtgaggaatgtcatagattcaacagctgattgcttccttggctgacagcatacaggagatgaaggagagaaaggagttgacagtcgtctcagggtctctggccggttgtctgagagaatgaggtatactgaaggagaagctgacaggaagggagaagaggggagatgatgagctcgattttatagtttagagcaaaggaatcattggataacccggaggtagctgaatgtagagatctggggattgtttgcttggatggtggctctgggtatggggatgaataagatgccttggtagggtgggaccagcaatacagctatgggcagaatcctaggaaacgggcagagttgagggataagctgaggaacaagagggtgtgaagagccgagaggaagcagtatgtgataaaggaggacctgtggagagttgtgtgaagtggggagagaactttcctggccctgccatttatttacctgccttgccatcggcaagtagactaagctcttggg

SEQ ID NO: 243454 - DNA, 398 bp, Homo sapiens
cacgcctggctaattctttttctttttttgtattttttagtaaagacggggtttcaacatgttagccaggatggtctcgatctcctgaccttgtgatccgccttcctcagcctcctgaagtgctgggattacaggtgtgagccactgcgcccggcctctgcttgtttatttatggataataatcaatacaatctggttttgtagatgacgattaacataaaagataaacattgatggatcatgtgctattatatctgcatttctttgcaatactatcagtcattcactcaatatacaattctcagctgtactttaaaaaggatatttaagttactgaagaaagagatggtacctcagattcatcagggcactgtgctaagcccaaacacaccaaaaaa

SEQ ID NO: 243455 - DNA, 422 bp, Homo sapiens
tgagacagagtctcgctctgttgcccaggctggagtgcagtggcgcgatctcggctcactgtaacctccgcctcctgggttcaagtgattctccctgcctcagcctccccaagtcgttaatacttttataacttagttgcagaagagaaatataaatttatttagttttcagaattattcatagatttataatctggcaaaatataaggaaattataagtatattgataaatcatgacataactggcaagaattggtatgaagacaagatggttataacttgaaatagggttgttatttattctatgcctatcatttttccatgagataaaccaaatatttaattgtttagactgattccacaaatgacatgggaaggcagagtgtttataaagagttttggaagtgatataggacactata

SEQ ID NO: 243456 - DNA, 309 bp, Homo sapiens
ttaagggtttttgtgactctgataggtagtaaatccattcaccatggaaagctgaaatcaaaatcattgtcaaggtgcaggtcaaattcatactaggccacagacacttgatggtggctttcttatctctttgttgccacttctaggcttagcagggtaaagctagacaggctgttgcatggcccagtggccaaattatgatgtaaagttacttcgcccccttaacatactgatctatatgtggaggaatagacaatcaagcaattttttttttctgtctaacctaacaaactgggatactaacaaggg

SEQ ID NO: 243457 - DNA, 305 bp, Homo sapiens
tacacaatgcacctaagactccataaaaaatagtcactaatgtcagttctaggggcatcaatgcttacaggggatttgttccccttttgacaagaagggaacattatcagattgaaataaatccgaggcacatggagtgtggaaatgatatttacatttactcagtaaattaattgaggtaagaaaggtataattaaatgaggaaaattgtcatgcaaaaatcagcccaactcataagctcaataaaggtgtttgaattttggttcatcactcacataacaaataatgatctgcattctcgtttc

SEQ ID NO: 243458 - DNA, 437 bp, Homo sapiens
tctgtagcctcatcttgagtcctcctagaagagagggtagagacagacctgtgaccccagcaccaagcaacagtgaagaatcccctcattatcgttgaggttgatcagcatcagggccctgggggaataaaacaagaggtatcccaagattaattttgctggatagagcaagtacaaataaggacacatatgaacacacacaggcacacccaggtcacttgtactaaacatttttttgttgttgttcctttatcattttagtcagggtgagtaatggcattgttttgttttgtaacttttaagttcagggatacatgtgcaggtttgttaaatagataaacgtgtatcatgagggtttgttgtacagattatttcatcacccaggtattaagcctagtacccattagttatttttcctgatcttctccctccccgca

SEQ ID NO: 243459 - DNA, 424 bp, Homo sapiens
atggatatcccaattaccctgatcattacacattgtatgcacatatcaaaatatcacatgtatgccataaatatgtacaactattatatatcaataagaaagtaagccacagataccattaaggcacaagataataatttcaatgtataaacccagatgaagttatccataagatatatttttcttacttgtgggtgtttcagccttgagttattttgtggttttctcttagagttattttcagtgtctctgtgcagttttaaaagaaactatggagtttgagattgagttactatattcaatgctgtttttttgcattataattttatttctacagtcttaaatttttaaaaggcagagagatacttgagacatgccactggactccagcctgggtgacagagtgaggttctgtctcaaaaaa

SEQ ID NO: 243460 - DNA, 665 bp, Homo sapiens
ttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgac

SEQ ID NO: 243461 - DNA, 506 bp, Homo sapiens
ccgatggctgctgcaccaggttcccaggcacgtgaggctgggtgtccccctcgtcccagaggctctgtggtgccggcttgcttacccaaggtcacaaggtgagtcagtggggcccccctggcattggccctggtctcaagccagtgagactagcaggaagaggcctgcagacttctcacttgcagagatgtttttaaaatatcttacttacggctgggcacggtggctcacgcctgtaatcccaacactttgggaggccgaggcaggcggatcacgaggtcaggagatcgagaccatcctggctaacatggtgaaaccccgtctctactaaaaatacaaaaaattagccaggcgtggtggcgggcgcctgtagtcccagctactcgggaggctgaggcaggagaatggcgtgaacccgggaggtggagcttgcagtgagctgagatagtgccactgcagtccagcctgggcgaaagagcgagactctgtctcaaaaacaaaaccaa

SEQ ID NO: 243462 - DNA, 586 bp, Homo sapiens
cctgcctgaggcttttaactggatccatttcagttaattatcagatctgatttgctcctggacccagtcctacttgacccagtctaagaattgttcaaataaacttggagaacacaaaacacaaattcctgaagcttggaatctgagatagaactcacccatgacctccagttgctacaagagaacaattggcacagtgtgccctgtcaggtacccttacttggtcactaaatgctcctgagggtcactggagttctacttccgatcccacttctgacaccaatctgttaaaagaaaagctttaggccgggcacggtggctcacgcctgttatcccagcactttgggaggccgaggtgggtggatcacctgaggtcaggagttcaagaccagcctggcctacatggtgaaaccccatctctactaaaaatacaaaaattagtcaggcatggtggtgggcgcctgtagtccaagctactcaggaggctaaggcaggagaattgcttgaagctgggaggtggtggttgcagtgaaccgagatcacgccattacactccagcgtgggggccaagagcgagactgtctca

SEQ ID NO: 243463 - DNA, 424 bp, Homo sapiens
gactcatacactggaaataaagcaggcagcaaaaactgcctgtgagagtgatcagatgtcagatttaaccaaaaattaaagtacccattataaataaatatattcacagaactaaacaaaagattaaagaagtaaacattatgacagtgtctcatcaaataaagaatatctcctaagcaaactaacaggaacagaaaaccaaataccgcatgttctcacttataagggggtgttcaacattgagcacacatggacataaacatgggaacaatagacactgtggactgctggggtgaggaggtgggagtgggttgaaaaactacctattgggtactgtgctcgctacctgggtgcaatatacccatgtaacaaacccacacatgtgtaccccgtatatctaaaataaaagttgaaattatgtgtg

SEQ ID NO: 243464 - DNA, 405 bp, Homo sapiens
aaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactacca

SEQ ID NO: 243465 - DNA, 482 bp, Homo sapiens
atgttcaggtgcagggatcaagtgtcttttacataatccttccaccagaagacatcaagtttaactgaaattcaaatctgaacaataggacaaccatctggaaaataacgctgcaaaactactacacagcaagtaagtcaatctgcaaagctgcaatgaagtaaaaccgactgaagagtatgttatgtactgtaggctataccaatctgtgcatgtgaataactgtcaatatcccaacctaaaataattttaatgatgggaataaacattaaatatttaccagctggtgcaccactagatcaatgggctcatctccctcccctgagtacacacaataataaatgaatagacttgggcttccaacagcaagaaaaagattgcctcaaaattggaaatcaatgataccactatggttacatcaataggtgaagcgataaatggaggctgctgtcatttaaaaaaatatattgtaataacagaga

SEQ ID NO: 243466 - DNA, 480 bp, Homo sapiens
gcacgagcctacagacaatttagtatagtattcacaatagttactggccttcattcgcattcttctgctccccttaaatttaggagtagatctggaatgaaaataagtattctgagtatttcaggtatttgcaaggttcattagggccgaaacaccatatcctgtaattgcctgatgtttaagttgtggaactttatagtaaacagtgattaaggtgactaaatttcagacaagactgtgtagtataggaagagcgtggatggtatcagcctccttctgcactctcaagtgaggtttccagggatgaacatacattctggcagagcatagataagctcctgagtgggtagtgctgggtggggttacaggcatgagccaccgagcttatatgcgttaaagtgtttgtgccacactctcttagactttgcttatcaaaatgtatttcattttgaaattattaaaaaccaacatagataacaa

SEQ ID NO: 243467 - DNA, 91 bp, Homo sapiens
ttaatcatgaaaattaagttgaaaatgaaatattcttatttgatcttttcaaaaagtgaaatatgtaaaaataaagtgtttttgtttttca

SEQ ID NO: 243468 - DNA, 498 bp, Homo sapiens
agatggaatattcccaaactcattttacaaggccagcattaccctgataccaaagccagtcaaggaaactactagaaaagaaaatggctggctaacatccctgatgaacatagacacagatatcctcaacatagtactgaaagtctcctatataagagaccgacatctcttccctcaataagaacaatactgccagtttttgtcctccagtgtttctatggttgagaaccaaatgaaacagttggtttggataaggatcgccttgtacaaaagtttgtctcttcaagcaccagatatagatgcacacactactggaggcatacggaaactaagatggccttcagagatagcagattcatgtctcctatcacatgaaatggtggatagaatcgccaattctttatatttacttttttccctctcttgtttgcccttttgttttttgctaatgttttgttaatatatgtaaaataaatacgcaaatgacatgctttcagt

SEQ ID NO: 243469 - DNA, 452 bp, Homo sapiens
cattgactctaaatcattgacttagatatctagaagatatttcatctctagaagatatttcatgcatattcttttgccctctgaattggtagaataataaatactggaaataagtattggcagttggcagttcctcttctattcttttttattgtaaattggttcaagaacaagactcacacagatagccgtatctctgggaagaagtctaggactagtgtaaatgttaaaggattaggagatatgtttctgtctgggagatgacctacttttttctaggacatagaaagctggaaagagccttgatctcatcctaacaacaacaaaaaaagagttgcttggaatctaaggaaagacagacacttgtgaggggaggtaggatacaagaattggctcacatgtggtaggaaaaagggagatagagattctaggtgacgtaacagcaggtaaga

SEQ ID NO: 243470 - DNA, 373 bp, Homo sapiens
agctggggctttgctcttcaaatccttgcctctgggacagatgtgcacatgcgtgtttctgtttcacacaaaagctacagtatcagctagcagcacatagcattgaaatgtagtgaaagtatgcaggcccttttatctctcttagcctgtttcctcacctgctaaatgaatttgtggtattgcaaattcttaacccaaattctcaaatgcatgtattacagttgctggaatatttgacattatgttattatatgtgtcatttagtgatgatctttttgttgttatttacactttagaagaatcttgtatcctattgtttcctatgttatttctacctcttttgatgtatattctctaaaaaattattttttaa

SEQ ID NO: 243471 - DNA, 432 bp, Homo sapiens
ccaaatactccatgttctcacttataagtgggagctgaacaatgagaacacatggatgcattggggagttaatccaccattaactatcagtatgggctttagtctctctgagactcggcacttcccctattaaatctctctgcttaaaatgcttatttgggagatacaagtccagctggtcccactaatcacatgattgctccagcggatgatcactcgagcatccaagctcacctaagacccaggcctgttaccttgtaaatgatccaccaagccacagggaagtgggaattgcttgaaggaatcgttaagccctttggagcatttgtttattcaatctgttaaaatcaagcttagaatttgtaccatgtgtaatgctaaacatggatcacttgtttggaacttaacaccgcacataaaagtgcttctgag

SEQ ID NO: 243472 - DNA, 530 bp, Homo sapiens
atttttaatctgagcacatacaaagtaacttattcgtcagttaactggaagtgtggctatgcaggtattttagtctcagaccagatgtttgaataccttttcttgaatggggtagggacctccacagccagaattctgaaaagtacctcagcagtaggcactggaattatgctgtccacctgctgcaggactggggcaggaagagagctgctacagctatggtttctcctgggtaacaagactggtaaccagagccagttgacaagctggaactggcctttgtgtgtcactgctgggtgcctcagcctgcaactctgagattgtggtgcagggaaccctttctgcctcaatccaggtcagaactccaggcattcagagcattcgctttcatggaccagcagcctgagccaccccacccttcttgtgcatagatcatggtgcagtggggccctcttcatgtcatgcccaggatagatccaggcattcagagcacctgcttgcttggtttggcagcctgagttgtcccatcc

SEQ ID NO: 243473 - DNA, 455 bp, Homo sapiens
tatacaattagaaattattatgataaagaataagacatttatttactggttcaaagaacatactgtgtgctttgtattctgacatatgtgtgttaaattgaatttatgatcaatttgttatgattgagagagtaataggagttatagttgttttaataatcaaaccttcggctcattaaaattatataaaggtgaaaagcctgaggttgttatggattgcatgacttctttttttttcttttttttttttttgagatggaatctcactctgttgcccaggctggagtgcaatggcatgttctcggctcactgcaacctccatctcccgggttcaagtgattctcttgcctcagcctctagagtagctgggactacaggcatgcgccaccaaacaggctaatttttgtatttttagtaaagacagggcttcaccatgttggccaggttggtctcga

SEQ ID NO: 243474 - DNA, 467 bp, Homo sapiens
aaaaataaacaacatcaatgtggtaaaatacctaagaagataatgtctgtaaatctttgagaactgatgagagaaagactctaaagtttcaggaaaaatatatcaggaagcctgatatatcctgcaggaacaaggaaaaataaaaagaaacctatgcttactacatcatagcagaactgcaaaatggcaaaggcaaagagaagatcttaaaagtgctcagagcaaaaaagacagatcatcagaaaggaaagaagaaaattgattgacagttgaataacagcagcagtggacaccagaagatagttcaaatactttcaaagtgcttagaaaaaacaaaagccagtccaaaattgtgtatccagcaaaagtatctttcaagaataaggatgaggaccaagatgaggttaacagggatccacctgaaaaaactaaagactaaaaataaataaaaataaaggataatgaaa

SEQ ID NO: 243475 - DNA, 161 bp, Homo sapiens
taagatctaagatctccataagggtaagtgataattgggttttgataaatcataaggaatcttctactagaaatatgtctgtttatttattgtacatcaggaaaagattagtttactttatgccagaagataatgtttgggcctaaatcttaatttttcta

SEQ ID NO: 243476 - DNA, 485 bp, Homo sapiens
aactttaacaattcaataagaagaattttttaaatgggcaaaacatttcaacagatgctttgtcaatatcttccacagatgattagatatattaggatgtcttcagttttaaaactaacataccaagtgctggtgaggatgtggagccattggaagtctcatatcctgcttccaggaatgtaaaggagtgcaaccagtttggaaactagtttgacagtgtcttaagaaattaaacacacttacataaaacccagccatcactttcctatgtatttacccaaaagaaataaaaacataaacatatatcacaaaaagacttgtatacaaatgttgaatgcacctttgtttataatggcaaaaagcctgaaacaacctaaatgtctgtcaacaggtgaatgaatgaaaaaaattgcagtaaacccatgcaatgggctactagtcatcaataagagcaaactactgaagcacacaatggataaatctta

SEQ ID NO: 243477 - DNA, 452 bp, Homo sapiens
cacagagacaatcttgctctattccttatttatgtatacccctacctcctggaaaggaatcaggacagctcacactgggaaagattcagagcatacatacaaaagccttgagactggaaagattatttggaagttgggcagaagagcaggtcacaaatagaatcactgaatttttctgcagcaaattgaagaccaaatgggaatttctgcctcaatcagcatccattgggaatcaacttgatgtgaggcgttatgctaaataaggcaagttaaagagatatatacagatgacatgagccctgcttccaggttgctgagaaggagcacctcacagagatcaaacagaacatttacgtacgaaaaagagttcaataatggcatgaggaggcaatgtgaataatttcaggctggagagtaggaaagtcattaaaatatattgattgcaagcccta

SEQ ID NO: 243478 - DNA, 310 bp, Homo sapiens
taaaaaatgcaaagctctacaaatcattctgatattggccccaaaaccacctcttggcacctcctttgcttctctgcagttttaggatccccttgtctgatttcttattcaactctgtaagatcatatcaccagtctagcaacatcctgtcccatgccattttataatttcctgtttaattgcctgttttgtacccctagactgtgaattacctgatggcagcaactgtgtttcatttgccatagtgttccaagtgttttgtcaagggcttaaaacatagtcattgttcattaaatgcttttgtggatta

SEQ ID NO: 243479 - DNA, 609 bp, Homo sapiens
ttagctgggaaaaatctgtacattggttttcaagccataatcttacgttcagattttgtatgctggtccgttgtgtaaatatgaatttttaagcaatttagcatttcatcaaagtaacacggcacttgattttcattcatccatatgaaaacaattaggaaaaaatgccacttatcttaaatagtatttgtcagattttcttcatcaaacttggtaaatacagatctcttgacattttgatgaattttcatcactctgtggtaaacctaagtgactaggctgtggcccgtgaacagcttttgtttctatgcgacattaaaatgtattttttaaaaaacatgattataatgaatattcaaaattagattcattctctagcatgtgcacaataggtcacaagtcatggctggagaagaacacttactagtcaatctcaaggttttattatttcttatgaatcacaatttttttcagagatataactatcaaagaggaaagccagctaaacatacaccattttgagtttgcctagacaactctgaaaattcatttcatatgtagttaacttaaaagttactgtatttccctagctgtgtattgtcttgactc

SEQ ID NO: 243480 - DNA, 423 bp, Homo sapiens
ctaggattccatattcagtgaaattaaccttcaaatatgaaagagaaagattttcttagacaatgtgaagtggtatagtgttatctgaaggttaaaatgcatattggaaactctaggacaatcactgaatttcaaaaggaagtatatatgtaaagagaggagataaaatggaacaaaataaaatgctcagctgaaaccagagaagacagaaaagagggatttaaaagaaataatgagtgcaacataaagcagctagaaacatggtagatgttaattcatgtatattaatttagtaggtgattggggctggacatggtggtgcacatcagtagtcccagctttttgggaggctgaggcaggaggattgcttgatcatgctcacatcactgcactccagcctgcgcaagagtgagaccctgtctc

SEQ ID NO: 243481 - DNA, 297 bp, Homo sapiens
ggctcacaagaatcctgggtttaaaacaaaccttaacagtcatctagccagtgcctgtgtctctctgctccccgcccccacccagtgtttcagtctggaagccctggcatttctattcatgtccacagcatggacatgaggaactcaggagtcaccagagcaagcttggatgctgcccagaggccacttctaagcaaccttccattgattgctgttcttgtgttccctggctggggaccagcctggcttgacccagcacgataatggacatgcacaagtgaagctgggtactgaagg

SEQ ID NO: 243482 - DNA, 514 bp, Homo sapiens
ccgctcgtggcaagtgttgactgcgtgtaggagactcccgtcctatctcccagtaccaagtctcggggaaaaggagtgcgacgagggtggagaagaccaagtttcgcttctcggccccaggctgttgcgcagtttccctggaatctttttgatcgactgctacgttgaccatgtccttcccagtgtccttagcaggagtgatggccagagagagaacttttgcacatgccatgttttcgtggcaaaaattttagtttcaagtaccttatgagggcggttacctagttttgaattttgtcacttgttgagggtgtacaaaatcctatctagagtcatactcgttggatgtattttcttttccgaaatgtacccataggacacataaccttattcctggtctttaatatttctcggttttataccaagcagcagtgttcggaagaccatgttagtgctacattgtgcacagtgagaaatgaacaagttttttaattaaagacagcactgtaatttt

SEQ ID NO: 243483 - DNA, 339 bp, Homo sapiens
ttcaactgtactgagaaatggaaaaagtcagttggccaagcaaaagtgctaagagcagagaggagtcaagaatcctcatgggcttccagtgcctggttcaaggtgtcaggatctatacagcctggcttctctactgcctgaagggaaatgagacaagcaggactaagtggaaacccagataagagacccgatgctctgaaatgtgtctgaagcccccaatctggcattctgaccccaaagcatataccttttcaccatctaagcatttgttatggctgccaagcactgtccaccaaactcagactctgggctgaccaataaaactgctaaccccaaggg

SEQ ID NO: 243484 - DNA, 372 bp, Homo sapiens
gggtccttaaaagtccatgtagataataattgggagtccattaattgacattaagatttcaaaatgcttcttaaaaattgtagctttcggccaggcacagtggcctgtaatcctagcactttgggaggccgaggcgggcagatcacctgaggtcgggagcccgagaccagcctgaccaacatggtgaaactccgtctctactaaaaatacaaaaaaaaattagagggacatggtggcacatgcctgtaatcccagctattcgggaagctgaggcaggtgaatcgcttgaacctgggaggcgctggctgcggtgagccgagatcacaccattgccctccagcctgggcaacaacagggaaactctgtctcaaa

SEQ ID NO: 243485 - DNA, 374 bp, Homo sapiens
cactggggttctcagtttccagcttttcgtcagagggcaggccccattccatgtcctgggccgcggctaaaattcagatagatcctatactgtgtaactgcgttggagaaccaaaggacacagcagctgcaaaaggagggtgttatctcagaaaggagtgagcagtagaggagagctccaggccctgtgcatgaactctgcccaaacctctggccgacttctgtagggaaggctctgagcagcccattacaggctgaaaaaactgggcagcgagttctgctgctgcccaccacagtaaagaagacagagtttgcagtctgaatcaagccaaaataactacttgcttaaaaataaaacttttcagaggcaaaaaa

SEQ ID NO: 243486 - DNA, 206 bp, Homo sapiens
aatcagcctgtttcatagaagcctttgttgtttgttctgatgagatttttacctgctgtacttgagacatcagtaaaaagtgaagtagaggttcctcttcagagactttccttcccatctaattaggaataaatagtaacttctcttagaagcaaaatttattcaaagacctgtgctaacattcttaaatatctgctatccataat

SEQ ID NO: 243487 - DNA, 818 bp, Homo sapiens
gaaggcatcgctgctggaggtgtgatggccattaatgccactttatggaggtgctggagacctcctcctccacaacctagcacgtggaattcgcaaaactgccaaaggtggagccaagcaccaagctcaccttcctgtgcttgcacccaaatgcaacgagccactcatgccagctgggggaggccctttgtgtagaacactaagtctacctctttagggttgatgacaacaagaaacccaggaacggacaggcctctcagactgacaatcagagaacgcccgtcaggcggggctgcagctgtgtggtagttaaggactatggcaaagaatctcagggcaaggatgtcatcaaagagaacttcaaatgcaagaaatgagcaaataaaaacttagctctcaaatataaggctcccgcagaagtcaaagcagttggagtaaagaggctggacaggcacgggcggcccaagagtgaggaggcaggcgctggggccaaaggcccaccaggcctgggctagaagggtgacagcagagggatggggccagatggggtaaaaaggaatggcacaggccaggtgtggtggctcacccctgtaatcccggcactttgggaggccgaggtgggtggatcacctgaggtcaggagttcgagaccagcctgaccaacacggcaaaaccctgtctctactaaatatacaaaaattagccgggcgtggtagcgtgcacctgtaatcccagctacttggggaggctgaagcaggagaatcacttgaacctggaggcagaggttgcagtgagccgagatcgtgccactgcacacc

SEQ ID NO: 243488 - DNA, 604 bp, Homo sapiens
gagacagagtctcactctgtcacccaggctagagtgcagtgacacaatctcggctcactgcaacctccgcctcctgggttcaagcgattctcccacctcagtagtccctgagtacctgggactacaggcatgcaccaacatgcctggctatttttgtctttttagtagagacagtgagaacacagagtttgtgagggagttcaatttcttaagtgagtggcaggactagtatgagagccccatcttggtgaaggcagagaacgacaataacactatttcagctccttccacccatttctctaatgaggaaactgaggctgggaggtggcccaaggtcacatgggtggagtgtctgcattgggcaagaacaccatgtcctgacctcagtcaggggccggggtgagggtggcacctgaggagaacatggtgacattgacaaagattgagcctccaatgaagtcctctcctgggccttggaatgcggccatgagcgtgtccttctggagggagacgtggcccaggccttcagagatctgttcttagggtaagatagaggaagaggatatggttttttggggagcgttagagctcgtgccgaatcctg

SEQ ID NO: 243489 - DNA, 251 bp, Homo sapiens
gatctatgatggtcagagtcggaaaaattatttactccttcattttattcattcattcaatgtttacattgagtgagcatctcctacgtgcaagaccctgagctaaactaccagcattccaacataaaagggattcttggggatagaagagcctctctctgtaaagtcttagtccccaagtcctaagtccttagtcttacttaggagtaagttttcacgaattcaaataaaaaatttcaatgagtacaatt

SEQ ID NO: 243490 - DNA, 420 bp, Homo sapiens
cagtaaaattctattttcccactctcagatgcctgtatgtttttaaaaatgtttcatatctgcatatgttataaacttaacactggaatgttattttttattcaaatagtagtttgccttttaaagaaatttaaaaaggccaggcgcggtggctcacgcctgtaatcccagcactttgggaggccgaggtgggcagatcacaaggtcgagatttcgagaccagcctggccaatatggtgaaaccccatctctactaaaaatacaaaaattagccaggcatggagatgggtgcctgtagtcccagctattcaggaggctgaggcaagagaattgcttgaacctgggaggtggaggttgcagtgagcccagattgcgccactgcactccatcctgggcgacagagcgagactccatctcaaa

SEQ ID NO: 243491 - DNA, 230 bp, Homo sapiens
aagattcttttgggtatactgggatcccattggtggttctgtagatcaatttagggaatattgccattttaacagtgttacatcttctaatccattctcatccatgaacataggatgtctttccttttttttttttttttttttgagacacagttttgctctgtcatccaggctggagtgaagtacagtagtgcaatcacagctcactgcagccttaagtaggttcaagt

SEQ ID NO: 243492 - DNA, 470 bp, Homo sapiens
catatgacatttctggtgctttcttttatcatgctgaagagaaattatctgcaattccttctcagtggttatgatgtcttttaaaaaagttactaaggaaaggtgttgaaaatctggtcaaggatatggcaggagtagtactaaattatgggcaattggatatggattcttagttataatgcttggaacctcaacagattagtaaaatttaacattgcaaggtcctttgactcttctattttcctaggtttagctttaggaggttattaaagtatgtccatttctttaatgtaaagttttgttaaaagcacagacttctgagcaccaccaaacctagcgtgtgtgcaccatgacacacgcggatgtgacactgcaccagcccactcctaccatgtctcctcttgctcttcttatgaactgaatttgtgccatcaatttaggcttaaaaaagataaatgcaaaacagaaaa

SEQ ID NO: 243493 - DNA, 259 bp, Homo sapiens
ccttattaaaattccacttcctccgtaattaaaaaaaactaattacttctagtagttggaccagaaatgacattttcagttcattaatattcagcaaattgttgttgaagatgttcttggcaccctgcactgtcaggctatatcatttctgtttgtttcttatttaaaagtcatctggaaataatagtttgcattttaacaagatgtgtatccatgaattgattttataaataaagtttttaattgctaaaaaatgtgt

SEQ ID NO: 243494 - DNA, 311 bp, Homo sapiens
attccagtcaatatctccccttctccgcctgtgacaaccactgatcgccttgctgtcacagtcaatccgtgaaaggacctgctcctgaacatgcaatcgagccgtgcaggaggtcatcttctgtgcctggtttggagatttctgcaacatggttgcatccctccatgaggctttcttgctgctgagtgggattccaatgtcccagtgtccacatagactccagctggttgacccattcactacgatggacactgggttatttccatggtggggtaactattgataaagccactgcagatgtgtttacacaa

SEQ ID NO: 243495 - DNA, 348 bp, Homo sapiens
gtgtgctatatttagccttcaaaatgtctagcatgcgtggggtgtgtcattttacagaagcttttaaaactgttttcagaaatgttttaaatttcagaaatctaatttagtcaggtacttttatttgaaattaaagatatctattctggattttattccctctctcagtagaggaaataggtttagagttgcaagctcatgatctttgtcttctttctcaactttaaagaggggttctgtgaccataacccactctttgtagggtctcagtttattaacctgtaaaacagtagcaacgattgcataaaaataatgaaagtttttgctgtgggggaggttttatgcttc

SEQ ID NO: 243496 - DNA, 543 bp, Homo sapiens
gatactataaggcatatttttattttccataattttttctaaaaaaaattagtgttggttttccatataacttttaactttataagtaaatatttgtctctttcagctccagtttcatgtgaaatagagtttccagatttatgtagcatggaaagttttaatacgtcagttactgatttttgccagtcattttctcaattatttacttcttttatctttagttgattttttttgtagtgacaagttttgtttctattctcatttccttttgtgtatattctatgtagatttcgtttttggttactatgaaaattacatataacatcctggagttataacattctgatttgaatttatttcaacttaacttcaatcacataccaaaattctactgctatataggtctactctttttaggttattgatgtaacaaattgtatctttattcattgtacaccacctaacagatttataattacattttatgcatttgtcttttaaatcctgtagaaaataaaaagcggagttacaaaccaaaattac

SEQ ID NO: 243497 - DNA, 588 bp, Homo sapiens
tagagatggggtttcaccatgttggtcaggctggtcttgaactcctgacctcaggtgatccacctgcctcggccttccaaagtgctgggattacatgtgtgagctaccatgcccggcctgtgtctgttttttaaaaaacatgttagtgagaatcgtgaacactgctgaatatagttgtagttcattcatcttcattgctgtggactattccattgtatgaatacactatcatttatccatttcactattgatggatattttggttgtttcctatttggactattaaaaaataatactgctgtgaacactcttgttcatacttttggtatacaaatacagtcatgtaccatgtaatgacttctcagtcaacaagattgcaatatacaaaggtggcccccataaaattataacactgtatttttgctgtacctttcctgtgtttagatagatacatgaatacatattattgggtttcaactgcctacagtaattgcaggaattctagtgggcacggggaatgcagcaactgtattcactacagtataacatgcagtacaggtttgtagcctaggagccatagtctagacc

SEQ ID NO: 243498 - DNA, 337 bp, Homo sapiens
ctgaagtcacaattgtcaaacattttaaacgtcagtaccatttatacgtatgcattagcaaacacatataaacaatgtttttatttaaaaaatgaatcgagtggagcagattgtgccttctctgaacataaataaactatccactcaagaaggaattgttattaatcattctgccacaaagaaacatgcactattcacaacagcaatgacatagagtcaacttaaatgtccatcaccgatagactggataaagaaaacgtggcgcatatacacgatggaatactatgcagacataaaaagaatgaaactatgtcctttgcggcaaaatggatggagc

SEQ ID NO: 243499 - DNA, 411 bp, Homo sapiens
ctgcttcaggtccccaagtcaggcacactcatgagccacactccgtggggttcaggcagcaattctgcttactgggggcttcctgcagttgcagtaatgaacaatgtctcagagccttttgcaaggccctgggatggcggtggggtggcctctggtcctttgtgtgaagttctgtgtggatctttggaatacagttctgtcttactaccaagaaggttcagtgcccgattttcttactcagctcctcaccaacgtaagcattcatttttctaagaaacaacacagttcagtctcataggaggagggacatttcctccatttagcatggctttgactttgcagtttttagaataggtccaattgttatggccctttcctgctctcctgagccaggcttgttttagaaagaaa

SEQ ID NO: 243500 - DNA, 473 bp, Homo sapiens
atgagggaatttggggttatttaaaacttgcatacatactattatatatacagttaaattacatgcatataatagcattttatgtcattagcttgacacaagtttaaagtatttccttatttcttccaaacattttctggtttactctcttttaattcagtagtttctatcctagctcttaaccacaggatccctgtctttttatgtcacttcattatctaaatctaggatgagctccctaggtttctgaataaaccagattctttctgtttattctgtttaccacatcatctccttccgttcaaaattgtactcataaaagttaccagaactctggtggactggaatcccccaaacaactcctggaaattcttcttgctttcctctattcagcctttgagctcagtctctgagctttaaaaaattacagtgtattaactgcataagtaatattaatacacctttgttgtaga

SEQ ID NO: 243501 - DNA, 468 bp, Homo sapiens
atgaatatttaaatacaatgtaaataaaacactttatcaattatatttttgtattctaaattagtgacttcacttagcatgtctgccttgcacagcaccacactatttttcaattaaaggtccagatgtttcaaaggctccagtaggcaacggcagttatgagaaatgctttatctgcattgtaatcatcaccaccacatcagctccaggctgcattaacatactcatgttttattccagctccccttctaccagagcaggtaattatacaacacagcagagaaacacaatcctaagagctgcacaatttccttacaagcattcacctgagcaacacattttcatacatgatttcaaattcttctagaaaacatttcattacatagttaaacttgctttagcaggaacactgataatttcaataatatgttgttaataaagaatgaataacagcacagatgtaccaaa

SEQ ID NO: 243502 - DNA, 322 bp, Homo sapiens
ggtcagtaggcactagcaccgtcattgtacaggtcgttaagatacttgcctcttccttggttatctagccgctgaagggataattatgtttggcacaaagaggatggtgctgcagcagagcctagctctggcattttttctgattgatcggcatctattctatacctgctgttaaatattttgactctcactccagatcatcaaattgttttgagagtaaatgagttgaagcatgcatactgcctagctagaccagtgtctgagataaatataatacagagtttgctattataatttagaatttttattgagtatactctgc

SEQ ID NO: 243503 - DNA, 696 bp, Homo sapiens
gagacagggtttcattcccagagcccaggcaggctagaatgcaatggcgcaatctcggctcacagcaacctctgcctcccaagctcaagtgattctccagcgtcagcctcccgagtagctgggactacaggcgcacaccaccacacccagctaatttttgtagaggtggggttttgccatgttgcccaggctggtccagaactcctgagctgaagcgatccacccacctcagcctcccaaagtgctgggattacaagcaggagccactgcacttggccttgcctgtgttaattggggttcctctaacttaggtccttaccaatgctaggaaggcataatccccataagtttggatcaacataccacatacccagaacacacagtttaatatatgtgagagagacaaaagaatcgggaggtagatgcaggcaagggaaaactgaataggagcaaatggattgctagggaaaaaacaaaaaacaaaaacaaaaccagaaacaacaaatgtagaagttaaaatcgatatataatatgggaatggtctttctgttgtttataaaatgtctacacaatttattaatttctagaaaattattttttagaaaagttctgtgaacttcagtggactcttaaaaattggagtttagcattagctagaaactggcatatttgttttagtagcacattcttattctg

SEQ ID NO: 243504 - DNA, 360 bp, Homo sapiens
aaaagatagaactccaggaaatccaacccaaagaagctaagcacattgcagaagaggcagataggaagtatgaagaggtggcttgtaagtgggtgatcactgaaggagacttggaacgcacagagaatgagctgagctggcagagccccattgccgagagatggatgagcagatcagactgatggaccagaacctgaagtgtctgagtgctgctgaagaaaactactctcaagacctgtgctgagtttgctgagagatcggtagccaagctggaaatgacttggaagataaactgaaatgcaccaaagaggagtattctgtacacagaggttgctggaccagactctgctgacctgaatg

SEQ ID NO: 243505 - DNA, 655 bp, Homo sapiens
tcccacggctgcagcctccaggggtacctctccccacaggccctacctccggtccaggctgtccctccctctcaccatagtgcaaaaatgcactaggctccccagtcttttaaaaaaattagactttttaaagaacaatttaaggtttacagcaaaattgagaggaaggtacagggagttcccgtcccccttggaacccccctgccaccaacaccctgcatgggggcacattagtcaccacccaggaacctgcactgacatcacctccaccgagtccagagcggatgtcaggtcgccctggtggcacagccacaggtggacaaacagcagcatcgccgcccaggagccctgtgcccgcccactcctactaccctcctcaagcccctgcagcctccggatggttctgccttttccagtgcgccatgctgcagagctggagtcgcacggcctacagccttttcagaggggcttctctacttagtaacagggacttgatgtttctcccatgtgcctgctcttggcccgactgctcatttcttttcagtactggataatagtccagtatggatgcaccacggtttatttttccacttatctactgaagggcatcttggtcgcttccaggttttggtaattatgaagaaagatgctatca

SEQ ID NO: 243506 - DNA, 239 bp, Homo sapiens
tgcctgttctggacattcatacaaatgacatcatacggtatgtggtctttggggctggcttctttcactgagcttgttttgaagattcattcgtactgcaacatgtacaagtacttaattttttttttttttttttttgagacggagtttctcttttgtcgcccaggctggaggttgtagtgagccgagatggtgccactgcactctagccagggtgacggagtgagactctttctcaa

SEQ ID NO: 243507 - DNA, 394 bp, Homo sapiens
gggatttcaggtgcacaccaccatgcccgactaatttttgtatttttagtagaaacaggttttcaccacgttggccaggctggtcttgaactcctgacattgtgatccgcccgcctcggcctctcaaagtgctgggtttacaggcgtgagccaccgtgcccggtcttcatcatattattaactaaatgcatttgacaaagcttatatctttttggaagaaactgaaaaatgtgggttgagtgatagattaggtggataatttatgtattatcctcagtgttaaccttttaatactttattatcttggcttcataacactttatatagcacttaaatttacattgtaagtgactagattgtccttgagtgtagaaaggctggattcatctttgtt

SEQ ID NO: 243508 - DNA, 303 bp, Homo sapiens
atgaagaagttgcattttgaaagataccagggaaaaacatgggtgtcactttcccgaccgtagtgtagagcatttggtagttaagtctaacgtttaagattccatttatctccctccagaattgcacagtatacctctcactgactttggcagcagtgccctctgatgtgaagaatgtgggctgtggaatcagcttgatttgaatgccactctgccacttacgtaactttaggcaagtcacataatccctcttaactgtttacttatctgtaaaatggagacatattgaggatcagtaagatt

SEQ ID NO: 243509 - DNA, 362 bp, Homo sapiens
tgcgtttcgcacctgggcgcaagctggttactgggcacgcgctgacaacccacatctggaaaacccggtcctaactggagaataaaacttaaatgcacgtgaactcaccggcagctgaacatttccgtgagaaaacccctaaaagccggcaccggctccggtggggccacagagtctctggagcgaggctctctccaatgcctgggccctgggaccgagcaactgtcccagtagaatccctttcgggctttgttgcagggataggggattctttttaacgtgttccttggcttgcacaggcatttactggtcctctggagatcacatataacaggaagtctctaaattcagtatttctttta

SEQ ID NO: 243510 - DNA, 435 bp, Homo sapiens
acttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccag

SEQ ID NO: 243511 - DNA, 416 bp, Homo sapiens
agtggttcgagactggcagcatatcccaataccattcagaataaaattaaaatattttctgtagataaaaatatagtcaatcaaagtcattcaggattcccatatggtatgctgctaggtatgaattcacaatgtaaagtcaccaaatatgggaggaaaagacatcattgtaattgaaaagtaccagcagaaagcaaagctgagatttacctccacctccccaaactaatttagttcagtaaacttcaaaatatcaaagatgaagagaacatttaaaagaagccagagaggaaagacagatcatctacaagaaagtatcacttaaaaacagattttcttatgtccataatgacattggcaatgtaatattattttcagcgtgctgagaggaagttacctttctagactgacgaact

SEQ ID NO: 243512 - DNA, 573 bp, Homo sapiens
aagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccttgttgttccaagtgcagaagagaaagcttcttcctgctttcagctgcgtgactgacaagggaagctggaattcagagaatcagtggcagcctctgtctctccaggccccaaccctgcaggtttaaggaatggacttaggtctctggcactttgttctcaacacacattttccttcactcattcagaaaaa

SEQ ID NO: 243513 - DNA, 396 bp, Homo sapiens
cagttcaggtttgagcccagtccaacaattttttgctttatttttaagtgacctcttaccattttcaggcttcctcccctctcaccttgacctctaactccaaatttatgtctccttgtcattgtggggaacttcttggagaaaaggttaaagctaagttggagctctgtctcgggcctttcatagcaacactgactcttattattagcggtgcactccaggctgctagagttcatattttggcagtagaccatcaaacaccctatttttaagagcctttaacttcgttgtaaacatgtgctgtgactgggagcttattttctttactcatatttaccaaaagcaatttagctgttgaaaagttgctataaggaaaaaaacaacaacaacaacaac

SEQ ID NO: 243514 - DNA, 550 bp, Homo sapiens
aggtaaaaaagaaagaggaatcaaagaaaacaaaggaagggcagaaaataaaagaaagaaaagtgagaacaaggaaaagagagagcaagattcagaggcagggaagacctgagtctgggaagagggcaggaatgtaccctgtggggctgaggcgtgtcccttcatgtcacatcctggtgctggtggtgacctgattttgactcatccaaaaaatgatcaaaagagagggaaacaaagactaggacatctagcacaatgttgaaaagtatggcccagaccctatcagaataatcccagcccatcatagcaaaattggtgaaaacaaaaaaaagggaaaaatgacaaaacagccagaggaaaaagacatctattttcaaaagattaataataaggcaaatggctgacttttcaacagaagcaatagaaaccaaagacaatagagtgacatattgaaattgctgaaagaaaattactgccaatctagggttctgtatctagagaaaatatctttcaaaaatgaaaacaaaataaatatgtttttggatgaaca

SEQ ID NO: 243515 - DNA, 371 bp, Homo sapiens
cagacatgaaaagatatccaaaagataaagaaaagtgcaagttataaaataatacagagtattataaaaattttagctcaaacacacatatacactcacattgaccctcaacttcctcataaaaacaaatctgaggctgggtacagtggctgaagcctgtaatcccagcactttgggaggtcgaggtaggcagatcacctgaggtcaggagtttgagaccaccctggccaacatggtgagacccttgtctctactaaaaatacaaaaatcagctgggcatggtggcgcatgcctgtagtcctagctaaggaggctgcagtgaaccgagaccacaccactgcactccagcctgtgtgacagggcaagaccct

SEQ ID NO: 243516 - DNA, 421 bp, Homo sapiens
cgcctactgtgttctggctgtgctggcagcagattggatggtgcccacccacattgagggtaggtcttcctttctcagtccactgactcaactgtcaatctcctctggcaacaccttcacagacacacccagaaacaatactttatcagctatctaagcatccttcaatccaataaagttgacacctttattaaccatcacacctaccctataagtgagcatatttgctcctgggtattttttctcaagaaatatgaaaacaaatgttgacacaaagacttgtataaaatgtttttatgccaggcatggtggctcttgcctgtaatcccagcactttgggaggccaaggaggaaggatcacttgagtccaggaattcaagaccagcctgagcaagacagtaagaccttgtctctacaaaaa

SEQ ID NO: 243517 - DNA, 497 bp, Homo sapiens
atttccaaacctgagaaaactgagaaatacccacataagtacttcctaccaccaaactgccgggatgccagcaaaaggctccatatcgtccccatcggggtccacagcctgcgcgtcagccgtgagattggaagaagctggggttgataagcagccctgtgggaaccagctataaacgcacacatggagacagaggagcacacaggaaaatggaagaacttcacggccagtttatttgtaaccagagccaaagccttgagccagccacgccggtcaccggtcagctgcagtcggcctcactgcccggcaggagctgtggccaccacgtcatggaggagtgggagggcaagggatgaagagggggaagatgagaatcagagccaaatccccgtggctcccccaggctgtgaggacgcatccctgtgggtcagttccaggcccgagcattcccatgtgtgggaatcacatgtttattaaaacgtcaagtcacccagaaa

SEQ ID NO: 243518 - DNA, 541 bp, Homo sapiens
cagaaagagcgatcctccagaattcctccctttctgctacagcacagaaaacgatttcacgaagtcattgttgcctttccaggagaaaaggtttcacatttgacattgacagtccattaactgtgttaacagcagtaattgctttagagcagtttaatggaagatgtttatgtgtggctaataaggtttgttttcccccccccaacaccaatgtagaaatgaaagcagagaggaattggaaaggtgtggagaagctctgaagaatcagaaggttaatggaatcacggaaccctaaatgaatagaactccccgtctgtttcccctcccttttccattactacgtcatttactttcctagccttgctaggacggatgccagaaagtgagcttccagcttagaatagttattaaaaagggatgtgctaaggttataatcttattttttatttagttttattttttcttatacatattattactgttacagtgaactttttttggtaataagccaaaatcaataaaaatattttatgaaaagaaa

SEQ ID NO: 243519 - DNA, 124 bp, Homo sapiens
tattagaatggtgcttcttcccaatttattggggacttttcctttgactaaacttggttgtacctccctatatccagattcttagccaaatttttctaataaatagcttgtttcatatgtctct

SEQ ID NO: 243520 - DNA, 732 bp, Homo sapiens
actccttatcactggtgcccacggcttcatctgtgccctgaagatactaatgctgcggtgactggtcagattaatggtgatgctttcatggggcgccgtaagacatgtccgcgaggtatttcacccatacaatgggaggcagtgttccagtctgttggagacaggaaagggaggctcagtccctgcgaaggaactttcccgagttcacacagcatttcagcaccgggtggcctggcttcagagtttcagagggaggggtggcccttcctgtcggtcctgggggtctcctggagtcaggacccttgggaaacccaaatccaccaggacgcttgcatcaggagaacctgaccacatgagaagctgcccttttctggttctcctgcttaccctcgacttggggtgtcggcaaatttcagagcttgccaaatctgcatcttcctggcctgtttaaaatgaatgtgtcagccccattctggacagcagctgacacctcttcccccgtgccagccaggacagtgtggttgggcgtaactcagccccggttaaaaatggaaaaaagtacaaagacatgtgttcaaggcctggtgacagaatttgaaaatgtgacaccagcctgttagtaatttgttttcacagaaacctgattcaacactgagcagacaggtggggccagggccttgggatcatctctgtgcttgcccagggacatctgtatgtctggcccaaagcggg

SEQ ID NO: 243521 - DNA, 325 bp, Homo sapiens
catgctgtttttgtgatagtgaataagtctcacaagatctgatgattttataaagggcagttcccctgcacatgctctcttgcctgctgccatgtaggatgtgactttgctcctcctttgccttccaccaggattgtgaggcctccccagccacatcaaactgtgagtccattaaatctctttttctttaaaaattacccagtctcgggtatgtcttttattggcagcggagaatggactaatacagatgccaatatcctaacatcgactgtagtgatggctgcataaagtggagggtatcttaataaaggtgttaccaaaaaca

SEQ ID NO: 243522 - DNA, 893 bp, Homo sapiens
cgcagtttctggagccattcacccacaggctcgcatcacggtggcttcaagttggtggtgcgtcccttgggccctcacccgccggactcctactttcaaatcttaagccccacattgtgggaacctgttcaggtcacttcagtctaggccctggtgtttaggctgggggaagcgggagagctcatgggtgatgaagccgtttctgaaagccagtgtgagtaatgtgacctttgaggaagtggccatgcacttctcctggagggaatggagtctccttgatgatgttccgaaactcctatactgcagtgtgatgctgagaacttttcactgatggcctcaatggggtatcttcttccaaaattggaactgagctacctgatggaaaatgagcaagattattgtgtggtgaagagaggcctctcataaagttcctgtccagatatcccaaatgacccagcaaaagggacatttcgtttgccccctcacagccattgtatgtgagtgtcttgtgatgatgatgatgatgatgatgatgatgatgatgatgatgatgatgataaaaatagccgtaatgcatttcatgagtactgactttgtgccaggtcctgtgcaaagctctattacttcccatgaggaatctccatctcaaggctcagagagatgaactgctggcgcagggatacacagggaggaaagtcaaggcgtgagttgcctggtagagacatttgagagtgggtcattgcctcagataatttccacggaactctgtgtgcctctcctttaagaagaggtgaagccaatccctttcttgggagccttgagaagccgcctcaccgagaacagaaagtgcgctccaggtaccacccggattccgtcaaactacattacccaga

SEQ ID NO: 243523 - DNA, 698 bp, Homo sapiens
atggtgagaagggtacccaaacacttgaatggtactgtaccctctacttgccatctgaatcctcacttgtggaacccaggcactctggctgtattcgcgagtaagcataggtgtgggactgtgtcctgccattgcaccatctttaatctggacttgtggacctcaggctctctgactattcatggacagaagtttctgcaggcacaggtggggtgctgtttcctcccattgtacacctgaattcaggacttgtggaccccaggtgttctggctgtgttcatgaacagaagtgtcccccccaaacaaacccatatatggtgccatctcctcccattacagtcacagatatggcaccagcccctccaacagaaacagatgtgctcaagctgagtggtccaaaggcgtttgacagaagtcatgaacagaagtatcttggggcacatgtttcttctctgttgtgcaggcttctccagcagtaacaggtttgcccaggccatatgggccccaagcgctctgaccagacacaagaagagaagacttgcagtcacagggtatcttcttccaaaattggaactgagctacctgatggaaaatgagcaagattattgtgtggtgaagagaggcctctcataaagttcctgtccagatgtgccttctctctggatccacatttcttctctcatcacagatctttcacc

SEQ ID NO: 243524 - DNA, 335 bp, Homo sapiens
ctgatgtcatctgaaaattactgataggggaaattttaatattatcatattaaataattatcttcattttccttaggaatctccatctcaaggctcagagagatgaactgctggcgcagggatacacagggaggaaagtcaaggcgtgagttgcctggtagagacatttgagagtgggtcattgcctcagataatttccacggaactctgtgtgcctctcctttaagaagaggtgaagccaatccctttcttgggagccttgagaagccgcctcaccgagaacagaaagtgcgctccaggtaccacccggattccgtcaaactacattacccaga

SEQ ID NO: 243525 - DNA, 1164 bp, Homo sapiens
ttattttcttgttttgcttttattattcgtggtttagcattttgttttatgtttattgactgtttgcattttttctgtgaattatctgtttatatgctttgatctctttttactgtatcattaatttttttaattatagaagctttttatatattataggtgacaattctatatatgtcaaaaatatttctccccgtcttctttgtttagaatgtcttttgcactgcagttttaaagttgtatgtagtcaaatctgttttctttcctctttgtagtttgtagcctaagtgaaatgtagagaaaagctctcctcctttagactataaaactattctaattttaaaagattcttttatggttttattttttgcatttgaatctttaatatgtttaaataagtgaaagtaaaaacttagctttgcttttttttcccaaatataatcaaataaatgatcaaacagacccatttattgaataacatatgctttccccactgacttaaaatgccaattttaccataaatgaaattcccatatatacccgggcctgttctgaaactctacattcatatccatgagtgcagatttgtgatatatgttggtatctagtaggataaacagaaacatttcacacaactttattccctgcgagtggcactgttatcaatccgatctagattaggtaaattaacaggacacaagttcagttatccctttgataaattatcaaaaaatttaaatattggcataccaggtattctttcatagtgtgtatatagccatttaatatggagaattgaaatttcaatcatgacattttgtttagttgttacagaacaaaaagttatgtgtaatagtgattctatattgcctataaacatgtacattttaataattgttttctttataaaaactacaaattcaacgtatttaatagatacagaggatgtccagttagctctaacatataaagagcttggaagccatcactcccatccttacaagaaaaagctaagcaaatggaaaaatcaacaattcttttgaacccatcagagaactgaggtctcagggtaaaccaccactccaaaatctggagagagaggtgaatccagagtcacagctgagatttgcttacctggagtgcaagctgctggagccataaact

SEQ ID NO: 243526 - DNA, 1302 bp, Homo sapiens
tcagctttggtggcggctaccggcggagacgggggcggcggccacgccaccgctgctgtcacagaaaggctctggtgggtggggtgggaggcggggaagtgccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagaggacagtccagcttatctgccgaggattccccctggaaaagtacgccgattcgcattttgcattaagaaactggaaaactttcctgtcggtcctggcgtagcgcctcccgtgtccggggtagaccttgtaccggctgaaaccgcatagctcgaccttcatggcggcagctccacgggaggagaaaagatggccccaacctgtattttcgagtaataccctttagaattcataaaagtctaagaacactttgtaaatggaatgtttcatagttcacactaaagtaaacataaactgttaagcaaaactttagatcacttcttctaacaaaggaaatgtacccgagaacccatgagaagtagcttcagagtatttttttttaacagtgaattctctgaggtcttggacttttaaattttatttagtttaattgccaaaagccaaggtggagctgtgtagcattctgaggaaataaaaccacttgaagcagaggtatagtagaataaagccattctgcctccagtatttgggtggatgtatttggtactgtaatcattttacagattgctaattcattgatgtaaaagatactcaatggtaggcatgttggacccattcaatattgttttttgtacctttctgttaacttttgtattattcatatataatatagatttaaccaaatctattttcttaaaattgcatattattgttttatgaaatgttcttttaaattttgttaaaattttgtccgctttttctacagaagtaggaatgaaatatttaacattttctgccagttcttacttatccactgtgttccagagtctttaatttaaatatttttgtttgccaggcttagattttcatgtgtctattaaaagagtaggaacatactcctccatgccagacatctgctatgtataagcattgattattttcccccttatg

SEQ ID NO: 243527 - DNA, 691 bp, Homo sapiens
  misc_feature (691)..(691): n is a, c, g, or t
tcagctttggtggcggctaccggcggagacgggggcggcggccacgccaccgctgctgtcacagaaaggctctggtgggtggggtgggaggcggggaagtgccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttaggtatgatttgaatgaaactctcagatcactgtataaccacccagtaccaaaggcaaatactcctgtcagtctgctttagtaccggattcctactttattgcccctgaggtaactggacttccacn

SEQ ID NO: 243528 - DNA, 972 bp, Homo sapiens
  misc_feature (972)..(972): n is a, c, g, or t
tcagctttggtggcggctaccggcggagacgggggcggcggccacgccaccgctgctgtcacagaaaggctctggtgggtggggtgggaggcggggaagtgccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagaggacagtccagcttatctgccgaggattccccctggaaaagtacgccgattcgcattttgcattaagaaactggaaaactttcctgtcggtcctggcgtagcgcctcccgtgtccggggtagaccttgtaccggctgaaaccgcatagctcgaccttcatggcggcagctccacgggaggagaaaagatggccccaacctgtattttcgaatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttaggtttaccttccctggtttgaagtgtattacaagcttctaaatactcttgcagattacttggctaaggaactgatgatttgaatgaaactctcagatcactgtataaccacccagtaccaaaggcaaatactcctgtcagtctgctttagtaccggattcctactttattgcccctgaggtaactggacttccacn

SEQ ID NO: 243529 - DNA, 463 bp, Homo sapiens
tgtgatctgtggcccccaggtgccctctgctgcccaagggacacccctgctgccaggaccagaggaggggcctatgctctgctcctctgcagtgtttttgaccccatatgaacttggggcccggaagttctccgcaaggtctggccctgttctcccctcccggaaagctcctttgccttagccctaccaccagaagacacggtctactcagtcaactctttcccagagggacagggtgaatggccagtggggggcaggcaggagattctagaactcataaaaatgggttgcttcccagctttgcccaacactggctttgtaactttgggcaagccctcagacttcttggagccttatttcctaacccataacctgggatgataatttttgccatcaagcagaatgtaaggattgagataaaaggaataaattgcccagcactgggactagcatgcagtaggtg

SEQ ID NO: 243530 - DNA, 217 bp, Homo sapiens
cttacaggtctagaagttgctctgggtgagtcagtggtaagtgcatgtgaaggcctaggacattgctttacaccactgtagactttataaacactgtacacttaggctaccctaaatttatttaaatttttttcttcaataataaattaaccttagcctcctgtaattgagtactttaaacttttcagttttttaaaactttctgattcttgtataa

SEQ ID NO: 243531 - DNA, 414 bp, Homo sapiens
tgaggggtggctttcaaagcagtgtttggagctccaaggactcccctgactccctcttctgatccatcagaggcaaagattcatagactagaggcagcttctacatcagactgcctggggcacatccctgctctacttcccagccgggtgaccctgtgccagttcctgctgcctttcagctggctttcttacctgtaacatggagatagtgatacctgcctcatcagctgctgtgaggaccaaggcagcgtgtgcaagctccttggcccaacgcctggtacgtcgcaaatgttacccggtattattacacccactcactcacccacagcacagctgccccatccgcccatgcctgctggtcttctctggcaccctggagaaaggccacaagtaaatctggatttctcaacttga

SEQ ID NO: 243532 - DNA, 464 bp, Homo sapiens
tacaaaatcacatccattagtattgtcctttcaagaatttcatataaatggactcatagtatatactttttttgagagagagagagggtttctgtcatccaggctggagtgcagtggtgccatcttggctcactgcagcctggacctcctgggctcaagtgatcctcctgcctcagccccccaagtaactgggactacaggcacacacaaccacacccagctaatttttgtattttttgtagagatgaggtcttgccatgttgcccaagctgttctccaacacctcagctcatacgatccgcctgcctcggcctcccaaggtgctgggattacaggcttgagccaccaagcccagctcccctttttttttttttaagagacggaccaaggccagagtatagctttaggccagaagttcttgaccagcctgggcaacatggtgatactcctgactcaaaaaaaaa

SEQ ID NO: 243533 - DNA, 386 bp, Homo sapiens
cgcaattaccaaataatatattcttctcactatggtgatttgacagatcaaaagctttctgagggcagagactgcgttatccgtttacgtatctccaatgctttgtatcatgtctggcccattgttagtactcaaaaagtgtttgcggaattaatgaatggttgagtaagttgcttcctataatcaagacttttagttagaatggtggtaaatttagacttagaggattttgtactttgtatcagtggggctgccctaactggtggatttattttttaatgcaatttttttctttttatttaaaatttctttggaagcacagatgatattataaacataataatgtaaataaagtaagaagaaataaattactgattactccacct

SEQ ID NO: 243534 - DNA, 304 bp, Homo sapiens
ggctactggtctccatatctagaggttttctgtggccacagtgtgagtgctcagcctaaaccctccccctgccctttgacacaagctaggtaatgggcactgctaggggacatcagggtagagcagttgggtctcagtcttctcttctgtgaaatgggtagggtgtgagttgaaaagggcaggactgactgggcacggtggcgcacgcctgtaatctcagcactttgggaggctgaggcaggtggatcacgaggtcgggagatcgagatcatcctcgtcaacatggtgaaagcccgtgtttact

SEQ ID NO: 243535 - DNA, 658 bp, Homo sapiens
attcagtcatcgatagtacaagaggggcctttttgtaaacctcctttttaatgtcaaagcaccaatttataaaacactgcagatgcatatagagattgtatataacagatctgtccagcttgtgcatgaaatggatttgataaagtttttgctatgttatttactacatttggggattaatacgtgatttatatgtatgtttttctgtaaatctactttttttgtacgagatgttctacaagatatgaagctaagggaggaaaacaccaaagatatctctagttatgttgaacatagccaatatggtttcaatggatcaataagaaaaaaccatttcagtaaggaatgaaatacgtacttatttgagaaaatgtttcttaacagtaaaaaagtatatatttttctctttggtaaaacgaaaagagaggaaaaatatgtatagtgtaaccccgcaagatgaggctttgcagaaaaacaatgcaatagaacatggcggggcaggcccattataaggccttaggtgagtcatttcccctgttctgagaccttagatgggaaagaaggagaagtggtttccacgtagttactttccaatttacactgttgattattataataattgatattggatgaactgagtaaatataagtccttgtac

SEQ ID NO: 243536 - DNA, 422 bp, Homo sapiens
ctgtcattgttgcttctcatgctgtgtggctgtttcttctttctcagcagaaggctttctcagcccttcagtccacaaatgcgtggaaagtggccacattagaaaccatatcacaaattctagtcactcagtgggactatcaattgcttccaattctagtttctcctagaagacactctggggcaaatgttcactcctggtctgatcagtggtggccagaggaatcaaactgtacaaatatggctgctagaggggctctgtgttttgggggcagttacagaagacggggaataaggataggcacaccagcactttgcagttacagaggcagtctacctggttgtctgtatggggaactgagatcctaactgctagagaagttctagccctgaatttaaattgtgacagcatctcttatttgt

SEQ ID NO: 243537 - DNA, 460 bp, Homo sapiens
gtgggtaaagctgctccagcgttccagtgcctaatttgaaataaaaatgttcagcgaccctctctgttcctactctgtgtactgtacatccttgcccctttgacttttctcatttggagcccagatgacttatatatacacatagtcactggcccctgggaaggacagtgagagtttgaaggattaaagccagcatggtggctcatgcctgtaatcccagcaatttgtgagaccgaggttggcagatcacttgaagtcgggagttcaagaccagcatggccaacatggtgaaacctcatctctactgaaaatataaaaattagccgagtattgcagaatttgcctgtaatcccagctacttgggaggctgagggagaatcacatgaaccgggaggtggaggttgctgagccaagattacaccactgcactacagcctgtgtgacagaacaagactgcctc

SEQ ID NO: 243538 - DNA, 303 bp, Homo sapiens
ggtattcttccagtggactactacatggccatgagaaagagtgaaccactgccacaccagtaacacaggtgaatgttgcagaccgaatgacaaaggataaacgcctgactcaaatacacatcatatgatttcattttcgtaacgctcaagagcaggtaaaacgaatccatggtgatagaagttaggacagtggttctcttttggcatgtggttgagtaatgactggggaaatgaacaagggagccttctggaatactgaaaatattttctatattgatctaggtaatggttatgagggtgtat

SEQ ID NO: 243539 - DNA, 404 bp, Homo sapiens
tacacttcatgtgggcaagggccttgttcacgagtgtagcactagtgcctttaactgctagcaaagtagccactcggatgattataccaaacactttactaaagctggggatctgtctagtggggaagacaaacaataaatatataatatgtcaggtggtattaaatgctatgaaaagaaaggagtagatggactgtaaaggaggatgctatttttttgtggccatcccgcactgagacaggatgcattccacactcaaaatttggttcacatgtccagactgatagccaagttcagtggctcacgcctgtaatcctagtacttagggagaccaaggcaggaggatcacttgaggccaggagttcaaggccagcctgggcaacagagagagacccccatctctg

SEQ ID NO: 243540 - DNA, 694 bp, Homo sapiens
cggtataagcgccaggccccgccgccggcatgctgtccacagccgtggcctccactgcccacatcgccctgacctgtttgcgccctgagagcttatagcttcattccaccacgtgtggcatttggccctgtttggcagtgatgaccgcctttctgttcagtgtctgagtgctatgtagattgcacacaggggtccagatgcattctgttttgagaatgtcagtggatacaccaatagctgctttggatttcaccagaaccgctgtttggaatgcagccaattcaagtgaagaaatatccatatttgtggctctgttacagtggtgaaatctacaaccataagaaggtcttgtacattgaagcacttcaagactccctttttaaaagtggagccctttcttcctggacactatgaagttttgatttaaagccaaatgaccaagttgcatccgtggtaatggttcaatatcatcacctgtcgggatgaacccccaagcgtgctctattacaacgtggaagaaaactcttttccagaggggctgtggactccagctgtgttgctgctaccccttgtttgaagcagctcaaaagaggcccaagtaccagtatcctctccagaccttttgtaacttgggcatggaaggacaggctgattactgggttgttagaaaggggacggtacttttcttttaaca

SEQ ID NO: 243541 - DNA, 370 bp, Homo sapiens
ttagactttcttcaatcacacctgaataaatcacttagagagagcttatagcttcattccaccacgtgtggcatttggccctgtttggcagtgatgaccgcctttctgttcagtgtctgagtgctatgtagattgcacacaggggtccagatgcattctgttttgagaatgtcagtggatacaccaatagctgctttggatttcaccagaaccgctgtttggaatgcagccaattcaagtgaagaaatatccatatttgtggctctgttacagtggtgaaatctacaaccataagaaggtgaggaaagagacaccagatgtctagatgtgattaaacttaagatcttgttggtaatgatgatattatata

SEQ ID NO: 243542 - DNA, 409 bp, Homo sapiens
tctcttaagataaccctttagtgagtatgaaatgctacttccttgtggttttgatttgcatttttctattgtatatgcttttgagcatagtttcatgtgcttattggtcatttgtatgtcttttttggagaaatagtcattcaaatcctttgacaacaatccatttggaaattgaattgttatctttacatcattgagtttatgaattatttatatattctttatatattatgggtataaatcctttatcagacttatgattagcaaatatttttatcactctgtagataatatttttattatcttgatagtgttgaaaagttaaaagattttaattttgataaagttcaatttataattttattgccatgattttgatgacttacctaataaatcattgtctatccca

SEQ ID NO: 243543 - DNA, 489 bp, Homo sapiens
ttagcttttgttttgtcacaccctcctatctcaatctttcaaaaccacatcaaacagatggtgagaggcatcatgaacagaaaaaggaaggcattacttaagaagaaaagattgtagaagagtaccaatgaaactcagttgtgctcaaacctactctccaaatatctagcatactggatttgccaaacaatccagaagcttttgtttacttaaataaagtctattggccattgagtgataagctattaagctcttcctcaattaatatctaacctaactgagaagaataaaaggtatgattcagaaaaataagtcagaatatgaattatacctactttttcagcattatgtaacaaaaaaattttgcccatatactatagccaaacaattacacttatttgctgaagaataaccacattttgatggaaagtaactacatccacaaccgcatggttcacattgataacctaatttctctcgaggggaagg

SEQ ID NO: 243544 - DNA, 578 bp, Homo sapiens
aagtgaatgtaatgtcagtagactcttgaaaatgtcccttaccctctggatctgttaaaaatgttattttatattcaaagttcaggttgttttttggtttcatcctctcttgcttttttaaagttgtatatgtgattatgtcattactggaagagtcttattcctttcccttaatctctcactcttgccccctgcccctgtgtaggactgaatacttcattctgttgtagagggtctttgtacacagtacattattacattatttaatttattcactccccacctgtgaccttcctttctctgatgtctccttactaattccttcactttcacttttcctttcagctgtcatccactctttcctttttacttatctgctgaattaacttgctcacactgattaaccctcttttgtttgttattagtgctgcttagagtctttcttctattttctccatccagctttccttttactctctcattctgactttgcatccccagtcatgctcctagcctttaaagagttatccttagctacaagaaaaactggtaaataaaaatataaaatgaaacaaaac

SEQ ID NO: 243545 - DNA, 278 bp, Homo sapiens
ccgcagcctatcccccagttcgttcccaaacccccaggtagacaggcctgcccctactgagaacttatcctcttttttttttcctttggcctccaaaagatttaaacacgtgctgttgcctcacctaagcttggaacattcctcagtaaaccacacccccactgcccggtttcgctaactccttcctgacctcccttgtctctgcttgaagggatagattaatgttgaaaaaaagatttcccaatcaagaattacaaaggaattagatgcctgcttta

SEQ ID NO: 243546 - DNA, 252 bp, Homo sapiens
agtgtggtattctgtaactccaaactagttcagtactcaaaaggacttgcctgattatatgttgtaagattgatgaatgagtacacattatatgttagaaaaattttaagggaggtttgtatttctcttgatgaaaaatgttatatatatgaaagaaaagagtggtattatcactcaaataagcaataaaagaaaaaaatagatgaattggatttcagaattaaaaacttttatgcttcaaaagacactatc

SEQ ID NO: 243547 - DNA, 325 bp, Homo sapiens
tggccacttccggaattggaaaactttcttaaatcaggcctgggcgcgtggctcaaagctggtaatttcagcactttgggagccgagcaagcggatcactaggtcaagagatcgagaccatcctggccaacatggtgaaaccccgtctctactaaaggtatgaaaattagctgggcatggcggcgcacgtctgtagtcccggctactcgggaggctgaggcaggaaaatcgcttgaacccgggaggcggagtttgcagtgagtggagatcgcgccactgcactccagcctgggcgacaaactgaggctccgtctcaaaaacaaaa

SEQ ID NO: 243548 - DNA, 309 bp, Homo sapiens
agtaaaaagcaaaaatacaagaggatctccagggagaaggaagtctgtcaccctcctagaaggccacctctgttaccaatttcttgtatctttccccagagtctgcacagataggagcacacaagtatttgtatccttcaggtagatttgggctgttaaagcttaagggatgattgtgaaaggatttgaaaaacgctcattgtgttgtggggaaggcactcactatgtaaaagatgaaaaaaaaaaataacaaaaccaacaaaagtatatgaagtatgatcccaaatgaaaaaaaaaactgtccttagg

SEQ ID NO: 243549 - DNA, 741 bp, Homo sapiens
atatactcttttgtttcctagcatcttaggttgtagatgtatgatcattattgccctgtacataacttttttttctttatggaatttttcacttttcctcttcagctttaaatcaattctcgatttttactagccttatttttagcagcaatgtctgtaaaataatggaattgatataataattgtatgtattacacccagacaaatatgtaatggttaaaatgaatactcatccatgtactaagtaaaatcatcatgcaggagcagtggaagcacatagttcagtcatctgtgtctccagttgtccactcagggatgcttctgaacatcttggctttactgctctttctaaaatttcctcgtctttctgcagactgcattgtgctacagctcatagacttgaaataataagaatccctcttgaggggtgccagtgtgataacgaggtattgggactccctttcattcactttttatgaattgtcctgtgcattgtgctacagctcatagacttgaaataataaggatccctcttgaggggtgccagtgtgataacgaggtattgggactccctttcattcactttttatgaattgtcctgtgcagcctctctaagattattccaccaggctctgcaggtgaatatgtgtattagtttgctgccataacaaattaccacagagtgggtggcttaaacaacagaaatttattttctgacagttctgcaagttggaagtccaa

SEQ ID NO: 243550 - DNA, 545 bp, Homo sapiens
ttttaaagaaaaagagctaacttgactttaaagagatgaaatgtacatgtaaaataaaattttgttttctgtgaaattttacttcagaaaatatcctgactaaaataaacaaattaaaaaatgagtactcctaaaaaaaaaaaaagaaaagaaaagaaagaaagaaagtaagaaagccaagagcacagaatcaggatatactggaggaaaacaacttttctaggccttcaagatagaacatttcagtgtcaggccgttaaagcagagttagagctggagaaaaaaagttacagaagatgaaaaagttaaaagagaattatcacctcaccaaacaaaaagatatactgtctcaaggagagaaagtggaagaccaaaaggcagaaatgtctgacctgcaaatcacatgaaacaagatacagcaaaagtttaactactgagatgtgaatctgagaagcttccacaggaaaactctacctcaaaatatgaaattaccattctaaatgaagaagattcattttaaaactgatattagagaaaggaagact

SEQ ID NO: 243551 - DNA, 219 bp, Homo sapiens
gaaaaaaaatcagtttaaagtaaggtgggagaaaatgagggtgatggagtaggggtgagggggatgtctgcaatgtcagcactgattgcagcaccaaactcaaagacaataccactcatgccactgccaacatacccctggcttcctcaacaactttagaattattatattgccctaagtgcatctagaatatgacctttggtccctccctagaaaccc

SEQ ID NO: 243552 - DNA, 1044 bp, Homo sapiens
aaagacgcactgaaaatatgatggaagcacgtccatagtacctgggctacagcttgaaggagctctcagtgaactaatctgggacgagttgagcaatgagataaatagtgatagtaaagtgttacccatatgataaatctacactgatctactatagatctacactgatacaactaaatgattaaataagtaaataaaataaatagaggagaaagggcagttcttgctcacattagaactctaataaatgtagaaggaatgaaaatagaaaattacttttagtcaaacatcacagtaagttataagcaagaattatcaacagatgctaaaaatagtgactgaaaaaattatggaagtatgatgaatctttatttgcatagtcttcaaactgtctcttcaaatggtactttttagtgacaaaatggtacataacactttgtggtagagaaacctggcagagaacaccttaaccaagtgatcaaagttaaggtcacagcaccagaaaaagtcatgtcaacatcatgaatcccttaatacaagacactgaaaatggcagaacatcactttggtgacatttgcaaaaaaaaatgtataacttcaatctaataataaggaaacatcaaaaaacccaaattgagggatattctacaaaatcatagccagtcaacttctaaaatgtcaaagacatgaaagacaaggaaagaataaggaactatcaaagatgcaaggaaaatacagaaacataatgactaaatgcaatgaggaatcctggattgggtcatggagcagaaggacattagtgggaaactggtgaaatgtgaataaggagtgtaaattagttatcactctaccaatgttaaaatccttgttctatggttatggaaaattttaactttaggggaaatgatatatgggaactttccatacccattgtacatcttttctgtaagtgtatttcaaaataaagttatttttaaagaaagccagtgacccaatttgtaagacagccttaaagagaaaccaggctttaaaaaacgtatatga

SEQ ID NO: 243553 - DNA, 385 bp, Homo sapiens
aaaaagagtgcatggggtgtgccagacacggtctcagtccttggtcctggtgcctgtgattgtctgtcacttcgaatgccctccccatagtcttggaagggggcaagtgtcctctccattttagcccagagggctggtgagtggctgattgggaccttctgattcagaagctttactttgctcctccaagccaggtacttgtgcttgatgagaagaaagatgtgtgtggcatcccctgagatggtttccttctcgtttctacaaagtaggtaggccttggtagaaactgctgtttctcagtagttggaccattttatagccagattcttcccactctggaatttggctactgaataagaaatgaaagctgtggccgaacatggtg

SEQ ID NO: 243554 - DNA, 434 bp, Homo sapiens
tgagctgttgagccaatacatctggtttgcctttgaaatataaacccattttctccctgtaaagtctgatatactgggaagtaaattaatgacttaagtttgactacacggaatacttctaggttggtagtatattctgtatactttgtaattaagaacagcaattctgaccatttccagtaaaatgaatcattctaaatgaccagagacttgtgttctagggatgctgtagcttctggatgtgaaattctaaaataccagaacacaaactagggcaacctattctggagcaaacctggagtagttcagcagttgggggaagtaaattcctaccttcagccaatcactaatgggttgagaactcatgaaaagtcatgtgacttctataaagatgttggactagcataatcaataaaagtctgccaactctaaaa

SEQ ID NO: 243555 - DNA, 397 bp, Homo sapiens
tattgtaataaggattaaatagtgactctttatagtacttactataatagcaaaaaattagaaacataatatcctttaacaggggagtagctaagtgagttgtgggatgagggagccagagctagagctacctgcatggataaatctcaagtgagaaaaagactagatgcctgaagtggcccaaacgacagtctctattatttacaccacatataaaaacatgcagagagatgctgatatcattgatggatatatgtgtgtgcagtaaaagaaaaaatgcatgggagtgaaaaaaccagactgaggccagaggtttccttttgggatgggaggggagtggatttgtagcatggtatgcagaagcttcacatttatctgaaatgttttacttcttaaa

SEQ ID NO: 243556 - DNA, 406 bp, Homo sapiens
tggggaattttgaatgactgataatttgctgaattagtagctgttgtgatcagtgaaagagttttagtacacatttttacctaaacattaaaaaaagaaatacaaaatccatggctgggagcagtggctcacgcctgtaatcccagcagtttaggaggccgaggtaggggggggtcacaaggtcaggagttcaagaccagcctggcccacatggtgaaatcccatctctactaaaaatacaaaagttagccagacgtggtggtgggcgcctataatcccagctactcgggaggctgagccaggagaatcgcttgaacccaggaggcggaggttgcagtgagccgagatcatgccacagcactccagcctgggtgacagagcaagactcccatctaggaaaagaaaa

SEQ ID NO: 243557 - DNA, 444 bp, Homo sapiens
gggcagccctggagatggaggccatcctgcaggaatcgggtcgtgatcatggtagaagtgcttcaggccgggaaggaacatctgcctctggggaggtaatcgaatgagaagaaattgcttcctcattaatgagacaattccacatgatcaacccagcaaaggggccatcgatgagactgaacattggccttttgtggcagtagctccaccctctccctgagcaattctcctaaagcccatgcagaccctgcatccctgccctgtggtcactttgaagttggcccagtgggtaagaatcagggtagtgagggaaagacacgggctgatggcccaggaccattgtcttctcccctggtattagagcgtgcctggtgaagggggtctcccaagcacatgggacctgaagatcgctgcactctgcacccatcccaacaattcccagat

SEQ ID NO: 243558 - DNA, 207 bp, Homo sapiens
tgtcccggaaagcctggtgcgcgccaaggtccctgcttcttgcttctgcgtccccagggaagccctagtcccgcccccagcccggtggaaacctcccttcttttacattattaagtttgtttttatttcaattttttaggacattgataaaatcactttcagatttttgagattaaaaattaaataattttcaagtttaccctttta

SEQ ID NO: 243559 - DNA, 217 bp, Homo sapiens
ccatcagaccccgggtctcaggaccccaaagaggccgggggcttggtgaggcaagtgaggccctggcctagggcacaaaatttatgggggtgcctcaattcttagtagttgagataaatgatattttaatgcagtactttaaaaaatgaaaattaatgcaaaaaacccatgaggaacaaaatgtcagagttttaaataaagacaggctcagtattta

SEQ ID NO: 243560 - DNA, 427 bp, Homo sapiens
acaccgcagcaggcagtgcccacagaaatgggcttgaggatggaccacaagaactgctcaaagcacctggactagtaacaagagatgacaagctgaggcctacgatgatttaggctgaggataccatctgcctgagagaaccctcctcttggagtcttgctcctcaaaatgtgacttcagagccagcagcattggcatccctggaagcgtggtaccaatgcattcttggacctcaactcagacctattcaatccaactctccagtttagcaagatccccaggtgatttttatgtacattaaagtttgaaagcaatactctaaagaaccagaaatgccagaccagggtccaacagggaaactgaatgcctaagacattcattcattcatttacccattcaataaatacttaataagcaaatactgggt

SEQ ID NO: 243561 - DNA, 382 bp, Homo sapiens
gggcagtgggtttgtgtgtgtgttaatcctctcacaacccactgaattgaatttcatggcccatggttaagatccacagtgtgaaaacgctgttttaaattatatgagttcgtcatttgtttgctctgtgcagctgagttgtgtccagacttaccagatggtatgttttgccattgaggggccttctacacaatgagtgcatgatatggtccttgatagacttgacttgtagatgttttcagcctacaatgtgatcagctatctgaggaactccagtaagtagataccacttcatttcagtttatatacaagacaatgtagttcaaacattttaataccttgtaaattatgatattcatataaatattagctctatagtctt

SEQ ID NO: 243562 - DNA, 472 bp, Homo sapiens
acagtgccaagcgtaatgccccttgataatttacatatatgtgaacgtggctgtgatagctgctgatgttcacacataggccatcttacatgtaatgatccatgtttggacttaaacagcttcacacatttattgtacagttaggtgtcacatgcttttactttttattttataatctgtatttctgtgaggtagacattattggctccatgttatatacattgatagcccggagctagagattgaacccaggccatcctccccactgcctttcatcatcaacacaaccaccaccaacagtattttaaaagtgttaaatattggcagacgtgtcattgttctgagcactaggactagggcttatgcggctgtctgaggaattccctgtacaaggaaacatcatataccaaaaagttactcatggaaggagtttggagatgatgagctaaaagtattacacatggactattgt

SEQ ID NO: 243563 - DNA, 292 bp, Homo sapiens
aagtttgaggattagttcatgtccttcagttataggagcaactcaattaaaggccaatagcaagctcttcattgtctctcatttggaaattttcaggttcaaattctgacagtattcagaagctacaatacaaaatgtcaatagtttctatttacattaaaattatttttatttctcttattaagtcaaacttctttttttacagaaatgtttcattggaatttttgcagattttgagtcagctgccttggactataactgttaagaatatacagtataaatctcagatttc

SEQ ID NO: 243564 - DNA, 162 bp, Homo sapiens
aggctcaatttttatttcagattcagggagtacaggtgcaggtttgctacatgagtatattgtgtgaagctgaggtttggggtacgatcgaactcgtcactcaggtaatgagcataatatctaataggtagttttctaaccttcgacctgccccctcccttc

SEQ ID NO: 243565 - DNA, 522 bp, Homo sapiens
acttagtttattttcgcaactgtttcagaaccttaaatatttgggcccataataatttagattgttcagaccatcagtttctctcataaaatcaggaagtgccacatatcccaagtgattaccagtctaaatcatagacacagttctctgcattttctgagatcaaacaggtcttcagcagtcagaacttaatttgcttgagaatttgtttgatttttctaggaattcaccattcaagtttctctctgactcatatattacatttctcggtagcataatttataaaatataaaactcatttggttgtgcattgcctaaagttgtaaattttttacctttttaagttccagtcccatcttttctcattactaacagatctaacaagaacaccagtcaaataaaaattgtcataggaagtttccagcatgcatatccccacccccatcaggatgtataggttgcctaggagtagtggctgagaaaatagaggaatcttctctgtacagctctggcttttaccta

SEQ ID NO: 243566 - DNA, 993 bp, Homo sapiens
tggctttaggcatgcgggggcagggcactgcggtgagcagcaaccatgggggatgcgcacacagaactgcaggggctgcccagccagcctggcctaggaggtcctgccagggagggtttaggcaggcagctgtcttcgtgtctggaacaggaagggatcagtgagctgcccattgttgctctgggctgaggaactggggatagagattgccgggggagcctggctttccggtggtctcagcacccactccctgggctccacatcccttcctaccctccacctggccacctcagcagggcgctcctttaagagcttggctgggccgtgcatagagtgggctgcagtggtgggtcaggtggatttcagaagcacaggcagcccacagacagcagaaccagccatgcccaaaatggtggctttcaaactctgacttcagcctacagtaaaatatacattgtacgtcttgacccatctgacaggcatacatttatgtagagggaaaacagaatggaagctttcatgaatgagtacttcctacttagagggcgttcagatctttttttttttttttgagacagagtctcactctgttgctcaggctggagtgcagtggtgctccgcctccagggttcaagtgattctcctgccttagcctcccaagtggagtagctgggattacaggtgcacaccaccacccccggccaatttttgtatttttggtagagacagggtttcaccatgttggccaggttggtcttgaacacctgacctcaggtgatgtgcccgccttggcctcccaaagtgctaagattacaggtgtgagccaccgcacccggccacattcagatcttttctaaagatgctggttgcaggcccctatacaccctcacataatacagcccctttgaggactgtattcccaacactttgggagactgaggtgggaggattgcttgagcccaggagtttgagactagcctgggcaacatagca

SEQ ID NO: 243567 - DNA, 267 bp, Homo sapiens
aatcagagacggggtctcactatgttggtcttgaacacctgacctcaggtgatgtgcccgccttggcctcccaaagtgctaagattacaggtgtgagccaccgcacccggccacattcagatcttttctaaagatgctggttgcaggcccctatacaccctcacataatacagcccctttgaggactgtattcccaacactttgggagactgaggtgggaggattgcttgagcccaggagtttgagactagcctgggcaacatagca

SEQ ID NO: 243568 - DNA, 467 bp, Homo sapiens
agaaggtgaagtgtcaatagatagcagactgcatggacatgaaatgtgatcttcataggaaaaggacgattttcatacccacattgatatgggttaccatcagttccttaatgaggagaaactgaagacaaatatcagaatgctgaatattacatagtttatatagaagtaaaaaatgtacatagttattattatagaatatggatttcatcattatgaataaatcctttagtcagtctcataaatttcctacttaaaagcacatgtaaatattgtatatggcgcttgcattggacagagcatgctctatagacaaaattctggtccttaaattaaccaaaactaagtaagtgaccttttcagaatatgtattttctgcatattgtatgttattctctgagtatttattttaaaacttgacttgttttaaaataaaaattttgatgttttttgcattgtcttaaaat

SEQ ID NO: 243569 - DNA, 598 bp, Homo sapiens
gcctgcactgcccttcttggtgcctcagtttctcgtctgccaaatgagggccgacccccactggcactggatgactctgatgctcctggccacaccctaacacctatttagtacctggatgtggatggaggcccatggcctttggagaattctagaatctcaacaggaaagacctcaaagagcaccaggtccaagacccatgtgtgatgcccactcccagtggtgcctcgggccacttctccacaaccagctgcatgcattccatcaacagttggctctcaggtgacagtctatgctgggcaccagaaaggtcacgtgggccccaccatgcaggtcgttacgggccatttgtttccagctcaagaggcaaaatgaagagcccagactggagccgtcctgggttcaaatcccagctctacctctttgctcaaaatcctcctaggtgagctgggcgtggtggcgggcgtctgtaatcccagctactcaggaggcggaggcaggagaatcgttggaatccgggaggtggaggttgtggtgacccgagaatgcaccattgcactctagcctggacaacggagagaccctgtctcaaaaaaaa

SEQ ID NO: 243570 - DNA, 183 bp, Homo sapiens
tttcagctgctggccatatgttcttactttagaaacatttaccaagtcctcccactacatgcaaggttctgtaataagtacacaccatatgaaaacacctccaatattaaactctaccatatctaatgaaatacttcagttatgagtccctcattctaaaccacccagcctgctacacttccc

SEQ ID NO: 243571 - DNA, 661 bp, Homo sapiens
cagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccctggggttagtgttgctttggttgaaaggaagcatgaaaaagttcttctatgatttcattttttttaatccaactctttaatccatttagaatttattttgatataaagaatgaggtggaacattagcttaatttttctcctgaagtttagccaatgatctgaccatcttttaaatgattttaaatgccaccttgatattatgttaaattatactaaatgctcaagtatactttggtctatgcttgtctggaagagacattccaatgttccctctctcttttagctttagtaataaactttcaaattcatctggactca

SEQ ID NO: 243572 - DNA, 402 bp, Homo sapiens
tctactttatccagtctgttgatttaaatgctaatttcatctaaaaacctcctcacagaaacacctgggataatgtttgacccaatatctagaatcccgtggctcagtcaagttgacacatgaaattaagcatcacagaggctaacaaacaaagagccagagagggaagtggaaaagagtaacaagccgtgacaaaaaattagttggaggcaaggctaggccatgaatcttaggtttttatctcttagtcctaggcaatttgtattaccccatgatgcatttttttgagtttgctgttgcccagtctaagataaagtggagatgaaaaagaatttaaaagttggatatggcaaatatataataagaaatttaacatgcttctgtaggtttttattagtaaaa

SEQ ID NO: 243573 - DNA, 233 bp, Homo sapiens
ctcatgtatctttattgcttgcttgtaggggcctttgaagacactggtttctgtcacccatgacatatagtgctgaaagaaatggtggtataatttggaatgacagtttgtgtctgctgagatcaaaggtaaatgttaaagcagtgaagagactgcaggaccacagaaagaaaacaggtgcagtgagtgattactgagtattaacaaagaagatgaataatttcctttaacta

SEQ ID NO: 243574 - DNA, 458 bp, Homo sapiens
ttagtacaccatcacccaccctactctaacacacacagaaatgggttctttgaaatggagtgatgctgtatcagacaggccttagttctacagaatccagctgctgtgaggtccctggtgaagctggtggaagagaaccttctgtatgtacctggggagtgggcttaaaagaatcctgtcaacaacccgcacatcaacatgttttggatgatgctacctgctcagcaggcatagtgaagtggagtgcctttaagatcacttttcactgggggatggttttgttgatgacacaacattactaatcaagcaaatgggaaccaaggtacaatattattttgttagctaattcccatagtccagtcagatttttttagcccctttcttattccatttgtcaatttccttttgtgatgcatagttttgaaagtaaataaaaattacttatgttaaaagtggga

SEQ ID NO: 243575 - DNA, 305 bp, Homo sapiens
caaagctaatctgattgacatcagcatagtgctatgtaggggtatactgactggttaggagcatgagggatacttctgggatgctggaaatatcctacatattgatctaggtggtggttacagggttttatatatatgctatgtgtatataattacagagctgtaaacataagtttgtatactgaatgtaaattggacttcaacaataaatcatatctacctgccttaagaaaacaaaataacagaacctttcaaaataaaaatgtgaaagatgaataaaagatgtttttgaaaagatggatggt

SEQ ID NO: 243576 - DNA, 632 bp, Homo sapiens
acccagggatgtggagtgcaggtcttaggagtagaggagactttggaaccaccacattgggccattttccttacctgagccctggtggatggtagtcaacagcctgtgctttggagactgactagcaatgtttgaatcctggcttattagctctgtgtgactctgtataaacttactgtgcttcaattacctgtttcatagggtagaggtaatatagtgcctggagttgttgataggactaatgagataatatatttcagatatgcacagctcagtggctggcacaatttgaccactagataaaccctgggtcttatttgttgcaatatatctgccagagattctagaggtctggtcctagcctaccactaactagccagttgagtttttacacatcagttaatctttcagagagttggattgtattagatggtctctcaggtccttctagacttagaaatttgttgatgagacagtcctgtctagcctagtgcctaagaacttgaactactggagccagacatgcctacatatgaattccagctatgtcttttgctagcattgtgagttgaggtatattatttaatgcttctatgcctcagttttgtcatttgcaaaatgggactcataag

SEQ ID NO: 243577 - DNA, 293 bp, Homo sapiens
aatattaataaaatgtccctactagtcaaagctaaatacaaattaaattcactgtctatcaaaataccaatgatatttttcacagaaattaaaaagttatcctaaaattcatatggaatgacaaagtaccccaaatagctaaataaatcttgagcaaaaagaagaaagctagaggcatcacactacctgacttcaagttatgctacaaagctatagtagccaaagcagcatggtactggcataaaggcaagtaaattgatacatagaccaaaggaacagaatacagaggccag

SEQ ID NO: 243578 - DNA, 379 bp, Homo sapiens
tgattatattacacattcttcaagtaaaatgttactttttcctttctctttttgctgggttcccagaactcttttttctcctttttcttccccctctcagtgatccatgttgacaaatgatatcttttaaattttttcctctattttcatacaattatatacagacctatatatgcatgtacaaaaataaagcaggatttttataagcaggatttcatggaaatagttctgaattaattgatacgtaatagttcctatttattccttttaatggcttcttaatgtttcatgttgtaaatgggtcataatttaatcactttgcttccattttttgttctatgaataatgctttaataaatatcacaatacctatgtccac

SEQ ID NO: 243579 - DNA, 431 bp, Homo sapiens
gcaatcctcccacctcagcctccaaagtaactgggacgacaggtgtgcactaccgtgcctggctaattttttaaattttttttgtagaggttggggtcttgctacattgcccaagctggtctccaatgcctgggctcaggcgatcctcctgcctccacctcccaaattgcgatgattacaggtgtgagccgccatgcccagcttattttgaaataatttcaaatttatagaaaagttgaaagaactttatacatttttccagattcaacaatcaatacgattttaccacaactattttagcattctgtaagatatgtatgtatatgaatatacacgtattttccttgtcacctttgtttgatctaataatctaagatgttctcacatgtgtacttacaatgtcaacagtaactggtatccctgtgtgcatg

SEQ ID NO: 243580 - DNA, 456 bp, Homo sapiens
agagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacattaaaaaaaaaaa

SEQ ID NO: 243581 - DNA, 779 bp, Homo sapiens
acacagtcaaattctcagaaaggttttgtctacataagcaaaatggaagggagagttgaagcagatatctcaatattgggccattctccaccccaacctcaacttctattgttcccatgaaacaccatttggaggaagagactaattaatgaaattggccatctttgctcatcagacctgccagaaaattgctctattagcaacaggctaaatgttgttactagagaaagtaaaaaggctaatgatcatgctcatcttgggataactacaaaaatattgttaatgccacctctgagctacaattttaactgcagaagtcagaccatctgaattactgtttccacagcaactacaattcagtcggctctgcaaggcttgtcatagatgaggacgttacctctatattatcgttgctggggaaaagtgcacttattttatttatagccaagctgtgcaaagttgtattttgtagtcttttatttggaaatgtggtcattagagaccgacaaaagtccttctgaatcactgaaatatatgttttgatacaaggaaaaatactgcatagctcagagcttcccattcataatgtcataatggcctccagggcagtgagatttgaaagccctctattcttccctaatgaatattcaaaatttgagatcttgagcagtatatcccagcaatcaggctaccaggataaagagaaagaagatggtgtactccaaaatggctttgagaaaaacatacactaatttaaacagtcaagagacttatatctg

SEQ ID NO: 243582 - DNA, 551 bp, Homo sapiens
gattcttattagaccttgttattcacgcagtgacaaattcccttttcaagtagtggttctttttatttcttagaccatggactattttgagaatcgaaagaaaactacacactctcttctctgcaaaatctacttgcaaatgaatctatataagttaggatattaattatttttatatttattgactacttaatttgtgccaggcactaagctgggctgtgggtcattctgggatgttaaaaagccttggggcttcatctgtaaatcaagaaatttaaaaagcctcttagagttttatttggaacaggaggcatttattattgttgttgatgttgttgttaagtatagcaacaattgaaaaacagctaacttttcagaaaagtcaatattattggtaaggctctgtgctaagaactttgtctgggtcatttctgttaattcttacgacaaactgcatgaggaaagcattttataaaatgaagtaatacatgtcaagcacttagaatagtacctgagacacagtgaatcctcaataaatgttagttgctatt

SEQ ID NO: 243583 - DNA, 601 bp, Homo sapiens
ttatattatgttttcactgtaccttttctatgtttagatacacaaatacttacaattgtgttacagttgcctacagtattcagtaccgtatcatgctgtgcaggtttgtagccaattataggctgtaagatacagcctaggtgtgtagtaggctataccacctaggtttgtgtaagtgcactctatgacgttcacacaatgacaaaattacctaatgacacatttctcagaatgtatcctcgtcattaagcaatgtatgactgtttccatatgaccaagaaatttcacacctagttatatagtgaaaagaattgaccagatgcagtagctcatgcctgtaatcccagcatactgggaggccaaggcgggagggttgcttgagcccaggagtttgagactagcctgggtaacatggcaagacctcatctctacaaaaattaaaatgaaaacattttctgggcatggtggtatgtacctgtggccccagctactcaggaggctaaggtgggaggatcacatgagcccaagagtttgaggctacagtgagctgttttcacaccattgcagtccagcctgggtgacagagtgtgaccctgtctca

SEQ ID NO: 243584 - DNA, 1136 bp, Homo sapiens
agctggcataaggaggagagaactggtattgtttcttacatggtattttagtatttttagagtttttaaaaaccatgtgtattgctttgataaaaattaatagtaaaatatgaaactggatttagagagaatctcgctggtatgtatcaaatgaaattgaaggcacagggaaaacaacagtcttagatctcaggtgatgaacaactgtaatgactggaagggggaaccaaagtactggcttggaaagacattttaaaggaatataatgtggaattttaagacctattctgattggacaatgggagtgaaatattaggttaagatgcaaacaaacctgttttgaggcactcataacaataggggagaaggtatttatgcccatttcaagtggagttggaatggtaggttgtgctttggatatgttatagcttgcaatgaatgtaatataaacatttgtgatatatcctgtaaacagtttgaagtgtgagcctgaacatgtttgatctaaggtctggaggaagatgtgaagcaaatctgacctaaaaaaaattataggaaaaaagcaaattgttctggatttgtttcaccaaggaacaagtaagcagagaaccagacactggagaaaaaaaggagtcaggaagtagacaaggaaatgttaaaagaaataataggataactgaaagaatgtagcttccagattgctagctatcagcagatagatagaaacttttatacagcctttaaatcttccctagaaacctttttaaaagtagcttcttgattagatttaaatgggttttatttatgcttgtcattttacagatattgtaaatatacatatggtatattttctttttgccttttgtggacagttggaggtggggaacaggcatccatagtcagtatatttaaaggaagaaaaaacaacttccataatcttgttatattgactgtttctgttgatacattttccctttctttcttgtttcttagtatgatttgagggtcattttaaatttctgaataaatattttgtaagccaggtggttcactgactgaacgtttgggacagaggtaatgggagatgaggccttctctctctctctccatagacaaaggccttaatatgactaata

SEQ ID NO: 243585 - DNA, 742 bp, Homo sapiens
atacatacattaaaaaagaaattagctgcatgccggatccaagagaaaaaccatgaaaaagaaagaaattctgttttcaaaatattttgtgttgttgttggttgttacagggtctcactttgtcccccaggctggagtgcagtggcgtgatctcacctcactgcagcatcaccctccaaggatcgagggattctcacaccttgggacccccaccccccagcagctgggactacaggcatgtgccacaggcacacgcctgagtaatttttttgtatttattgttgagacagggtttcaccatgttacccaggttgggctcgaagtcctgggctgaagcaattcccctgccttggtctcccaaattgctgggattacaagcgtgcaccactgcacccagcccagaatattttgcatacattttgcctgtcatttgtctatttataaattctacaacagatattcgtacatagatatgttgtacaaaacacaatattttttcatttcttctgtattcagtgaaaatgataaatttagaaactcatgatgtgattagaaatataaacaaagaaaatgcttaaatgattatcgaacttttttagtttcatatttgagactgtatgaattatagtctaccatgtttgcctgtgattcacaaaattctgtttttcaggatatatatatatatatatatcaaccactgaatttagtgtaaggtactgaaaataaagaagaaatacttaaa

SEQ ID NO: 243586 - DNA, 746 bp, Homo sapiens
tgaggatcccccgctatcatcggcacatcgtgccactgcactccagcctggtgacagagccagagcgagactcctctgtgtaaaacaaaacaaaaacaaaacaaaacaaaaaagaaggagttatgtccaagagtcaggaagacactgaatgtcgcaggattcccagtggaatcctctgagggaaaaaagagaggtgagggtccgcggtcctgcttccccagaggtgaggcagcttttggccatgttgttggtagcaaagactcactttcagctctggaagctttggctggcagctgggaaaacaatgtaatctggaagttcagggagaccgaggcagtgacacacaatgggcagacgtgcaccaaagggaggaggccgaagctctatagggtgcctactgccaagggagcctgtgggtgtgattctactgctcacacagttgaaaacaattctctacatgctgcagcttccaattctctacacagctgatgtcctggcttctcttcctagtttctcttttttttttttttttttttttttcagacagggtctaattctctcacccaggtgcaaatgaccagtggtgtgatcatagctcatagctcactgcagcctcaaactcctgggctcaagtgatcctcctgcctcagcctcctgagtacctgggactacaggtgcatgccattatgccaggctaatttttttattttttatagagacgatgtattagtctgttctcacactgc

SEQ ID NO: 243587 - DNA, 692 bp, Homo sapiens
tgaggatcccccgctatcatcggcacatcgtgccactgcactccagcctggtgacagagccagagcgagactcctctgtgtaaaacaaaacaaaaacaaaacaaaacaaaaaagaaggagttatgtccaagagtcaggaagacactgaatgtcgcaggattcccagtggaatcctctgagggaggccatgttgttggtagcaaagactcactttcagctctggaagctttggctggcagctgggaaaacaatgtaatctggaagttcagggagaccgaggcagtgacacacaatgggcagacgtgcaccaaagggaggaggccgaagctctatagggtgcctactgccaagggagcctgtgggtgtgattctactgctcacacagttgaaaacaattctctacatgctgcagcttccaattctctacacagctgatgtcctggcttctcttcctagtttctcttttttttttttttttttttttttcagacagggtctaattctctcacccaggtgcaaatgaccagtggtgtgatcatagctcatagctcactgcagcctcaaactcctgggctcaagtgatcctcctgcctcagcctcctgagtacctgggactacaggtgcatgccattatgccaggctaatttttttattttttatagagacgatgtattagtctgttctcacactgc

SEQ ID NO: 243588 - DNA, 444 bp, Homo sapiens
gagagaactggtgagcatggctgtttttacttttcctaaagtttcccctagagctgttggaatgggtgagaaatggacaaatgcctttgagctctctctggaaaagagcagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctg

SEQ ID NO: 243589 - DNA, 600 bp, Homo sapiens
tttttaaataagcaactgtgtgttagctacaattatcttcatagcctaagtggaagaggaagtcaagatttaatacaaataacaaaaactgtttcctagttcctcaatatttgagttcctgatttctttaaatcctctaattcttgctgacatgtcataagcagttctcttatgacctaaataaatgtggaaacaaaacaaagtattattctctaaagaagtcaactcatatacagcagaacctcagaagaacataacttgctataaagcaagggctagctgcctgttttgtaaataaagctttcctggaacacagccatacccattcatctacatattatcgatggctgctttcagggtacactggcagagttggatgtttgccacagagaccaaaccataaagcctaaaatatttaccatctggccctttacaacatttgccaatgcccagtataaagggtaaatagggtaaagctgaagaaaactttaaggaatctgccactgcacggacccgaagaagagcatcagaagggaactctggtgttatgtctaaactgaaatatgattctttccaaacaaacaatgaaatgacaagaaa

SEQ ID NO: 243590 - DNA, 414 bp, Homo sapiens
acccttcttttccaattagaggcaaagaagtaaaatattgaagccaatactcagaactcaagtaattctgatagctacaacattgagctataattccaggctcagtggatcctttccaggcctggctctatttatctaagaaactaagagagacaaacaggcctcctcctcagcacagctatgatgaatatttaattagctaataatacaaagtaaatgtatcatcaatagcaaatgagatgcttataattaacttgggacaaagaagtagaaatcaagaaatagcctgaatctgggcagggtggctcgtgcctataatcccagtgcttttggaggccaaggcaggaggattgcttgaagccaggagtttgagaccagcctgggcaacatggcgagaatctgtctctacaaaaa

SEQ ID NO: 243591 - DNA, 366 bp, Homo sapiens
tccaagtccccggagaagggaatcccccatccgaaacgcctatgtggtaatatggactcctgcactgagtgtcgtccttacctttctcttgagtcttcaagcaaaaatattacataaacaatgatttcctgattgaaatatccccaattattacagaagtattactggagagtgaacaaaggtggagataaaatcttcaaggaactgacaagaaattactgcttgaggatcagtagagaactgaaaagaggaaaatgtttagtataacctgatgatgtgaggctaaaactgatagtatgccgatgtaattttaatttacatttcctgtattgtaaatgaaatagaacatcttttcatattttcaaa

SEQ ID NO: 243592 - DNA, 188 bp, Homo sapiens
ggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacat

SEQ ID NO: 243593 - DNA, 618 bp, Homo sapiens
attgcaggcgtgagccactgtgcctggccataacttttttttaaaataaaatatttttttgcaagggtagttgcaggacctgaatgaggtaatgtatatcaagcacttgtcacatagtcctcattcagctaatgtcgactcccctgcctcctgttacagcccccaccactcactcagaatcatcaatccttgggtggcgctactttgagtttacatgcatggcagagtggttaagggtgtccattctggagctggactgcctgggtttaaaatcctggcccagattcatgctagatgtatgaccttgagcaagttcttttaacctctttgagcctcagtttcttcatctagaatatgaagatagaaatggaaggattgttgtaggattaaaatgaatacgtgtgtgtttgtgcatgtacatgtatatttgctattgatattgactagaaactttttgagggcaggatcaatttcaggaaggtgtcacctgggttctcactgccttagtgaagatatgtatggctgagtgatccagatgatggtataataacaaggataacaagtatatatgttggaaatacttgcttattataataagagattttgaaaaatataatg

SEQ ID NO: 243594 - DNA, 1032 bp, Homo sapiens
agaaaaaatcattagtatagtccacacaccttcagatttggccggatttacgtgcactgtatgagatgtacatctgtgcatttttatcatatgtgtagctttgtgtgacgccagcatttttaagcaattgaatagtatcagagtgcattacatctgttaagggtaagtgttgatgtggaaacgtattttagttacatatgcacatcatgactggattgtagaaatgtctcttgactgtgagtcacagtggagaattttgaaaaccacaggtcgttcagtcatcagacttgattttatttcactaaaatgggctgctagagagctcaaggtactctgatttctaattggctgctcagggtgcccctgaccacttacttctggtacttggaaaacctagattaattggatatattgacagcaacatagtgcattctctaccccatgagttatttaaggggttttcaagtgtaattttgactagaagcagtttttgctctttttttgttttaattttagtttttagagacagggtctcactgtgttgccgaggctgtactcaagctcctgacctccggagtagctggaactacaggcacctgccactatgtccagctgagtttttgctttcttccttagtagaacataactaatgttggagctcactgtactcttttgccagtagtaggaatccgatttctggtaagtactgtaggtgacagaaccaaggttgcttagaagatacggagttaggagaaaaatgaaaaggcataaatattttctacagcagtaaatcctaaggaagtaactagttccaagacactgtcaacattaaaaatccatagtgcaggctgagcacagtggctcacacctgtaatcgtagcactttgtgaggatgaggaaggaggattgcttgatcccgggagtttgagaccagcctgggtaacggtgagactccttctccatctctataaaaataaatctggctgggcacggtggctcacgcctgtaatcccagcactttgggaggccaat

SEQ ID NO: 243595 - DNA, 531 bp, Homo sapiens
ggcaaaactgaccctagaataaaggctgctctggacccaccatcacaaagcctaaaaacaaacctcaaaagcctgaaactgatccaaataacctatatcccagagaaaagccaacaatgtttaaaggaatacaacgaattccatcaacaacaaggcccagcataaaatttgcaatatccagcatccaactagaaatgaccagacatacatgaggcgggaaagtacaatttatgatgagggagaaaagaaacactcagaaatgaccaaaataatagaattagcagacaaggatttttaaaaagttactataaatatcttccacatattcaagaagatagaagaaaatggacatcatgaggagagaaatggaagatattttttaaacaagaccgaccttgaacttctagaaatgaaaaatatatctgaaataaaaatatataaggtagtattaatagattagacacttcataagaaaaaattcgtaaacttgaatagcaatagaaacttgaatatgagacacacaaaaaaaaa

SEQ ID NO: 243596 - DNA, 414 bp, Homo sapiens
ttgctgttccggcgcccactacccaagaaaccaaagaaatgaagctggcaagctacttttcagcctcaagctttacacagctgtccttactttctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtatggtga

SEQ ID NO: 243597 - DNA, 663 bp, Homo sapiens
gagaagggtgcggttggctgcaaaaattagctcaagaccttttctagaagtaaagtctgtttctctgccattttgttattattttttgagacagagtcttgctctgttgcccagtggagtgcagtggcatgatcatggctcactgcaacctctgtctcctgggctcaagcgatcctcctgtctcagcctcctgagtagctgactataggcatgcatcaccacgcctgcctaatttttgtattttttgtagacatgaggtttcaccatgttactcaggctggtctcgaactcctggactcaagcaatttgcctgccttggcctcccaaaatgttgggattacagctgtaaaccacggcgccaggccattctctgccctttaaatctggccctggctgtgtgacttgctttggtcaatgggacatcagccgatgggatgcaaagagaggcttgagaagagcttgatcatctgtgcctgctgcttctagaacctcatcaccatgggagccagcctagggtgcctccaaagggtatgaggccacaaggagagagaccctgatgtcccagccggggcctcagacacacagccatccggcccttgctgagccagtccagccaacacacagaaatgtaggaaagactaaatattccattccattccattg

SEQ ID NO: 243598 - DNA, 618 bp, Homo sapiens
catcccaggatgtacatccctttgcaatgtgactatcccatgcttacagagtcttgctctgttgcccagtggagtgcagtggcatgatcatggctcactgcaacctctgtctcctgggctcaagcgatcctcctgtctcagcctcctgagtagctgactataggcatgcatcaccacgcctgcctaatttttgtattttttgtagacatgaggtttcaccatgttactcaggctggtctcgaactcctggactcaagcaatttgcctgccttggcctcccaaaatgttgggattacagctgtaaaccacggcgccaggccattctctgccctttaaatctggccctggctgtgtgacttgctttggtcaatgggacatcagccgatgggatgcaaagagaggcttgagaagagcttgatcatctgtgcctgctgcttctagaacctcatcaccatgggagccagcctagggtgcctccaaagggtatgaggccacaaggagagagaccctgatgtcccagccggggcctcagacacacagccatccggcccttgctgagccagtccagccaacacacagaaatgtaggaaagactaaatattccattccattccattg

SEQ ID NO: 243599 - DNA, 411 bp, Homo sapiens
catccacctcagccttccaaagtgctgggattacgggtgtgagccattgcacccggccctaggtatttcattattttttacggtgggattttcttcatttaatttttatattggttatagttcacatggtatatctttttccatccttttattttcaacctgcctgtgtctttgaatccatgatgtgcctctgatagacaacatatggttagatctttttttgatctattataatctatactttctgatttgatagtccattgatattttatataattattaattttgtggttggatttgtgcctgctgtcttgctgtttttttgttttatatatgacaggatttttagtttatcggtatctccttaactgcctttgtttgcaataaatatttttatcataccaaaaaaaa

SEQ ID NO: 243600 - DNA, 499 bp, Homo sapiens
tctccatatttgcttttcagaatgtcatatggttggaatgtcatatggtaagtcatcttttcagactggcttctttcacttagtcatatgcatttgagattcctctttgtcttttcgtggcacaatagctcatttcttattggtgttgaatcttattctactgtttgtatgtaccaaagtgtaataactcctacgcctactaaagggcttctcagttgcttcccagttttgacaactttccatcaagctgctatgaatatctatgtccacattttttatggaaataaaattttaactaatttgggtcaaagtcaaggagcacacttactggaatttatagtgacaatatgctcactttagtaataacctgccatactgtcttccaaattgttgtaccattgacattcccaccagtcaatgaatgacagttcctattgctcctcaacttgccagcatttggagttgtcagtataggatctttttttaaaaggaaaagaag

SEQ ID NO: 243601 - DNA, 608 bp, Homo sapiens
tagggttggggaaacaggaatccaacacaggagagagataaaggacatttccaggatgagagtagagagaagtctcagcctgacaggttaacaggcctagggagcgaccagtccagatggtggcaggggaacaaaagactccaaggttaatgtcttaaagaaatagaaaacatgatactttcaggaaccatttctctaggtgttaaagaagtagaagcagcagcaacaacctggtgtacttgaacgttcccagaggagattttacagttctgtcagaggatttagggtcccattaattatacaaatgagaaaacaaagcaattataatctccagagaaagtagctgaagttgaggaaggtaaaccacagcttaatacagcaatagaatattaaaagtttgtattaatttgggaagaatgtactttctaagagagttactcaactggtgatgtaaatcaatcatggcaggtgactgagaaagtcatgaaaagtgctggagcattggcagaagtgagggggtctcttttaggtaatgtgtgcttgacgatgtcatagtcattcagactattcatttaatggcatgtgtctaaggtttacaaaaaaaaaaa

SEQ ID NO: 243602 - DNA, 389 bp, Homo sapiens
gaagggcctttgtgactgccttgatgaacagaatgaggtgaaattgaggctacacatgatttccaaggttaggtcataaaataagacagctcctgcctgcctctgttcctcttgggacattcatcttgtaagaagtctagctacccttaattcagcatgctggagagaccctgtggagagggctcacaggaatagatgtctcaggagcctcagctgtgacagttcccagcaatgcaagaaccgcctaatacagatgattacaacatcctgccttcagatgccctggctgttgctgatagaccagagacaagccatccctgctgagcactacccttattccaacttcataagtaaataaattttgctactttggagtggctggtttgaaa

SEQ ID NO: 243603 - DNA, 410 bp, Homo sapiens
agcaaaagtaacacagttggaagcatcatattacctgacttcatattatactataagactgtaataaccaaaacagcatgatgacggtacagaattataccaactggctaatggaacagaacaggacccttacacctacaaccacgtaatcttcaacacggtcaacaaaaatacacaatgaggaaaaaacaacctattcaataaattgtcctaaaaaaattaaacagccacgagtagaagaataaaacaggacccctatcactcaccatatataaaaattaacagaaaatggattaaagacttaaatttaagactggaaactataaaaactctagaataaaagccaaaaaaacctcttctggacactggtctttgcaaagaatttataactaagtcaatgcaacaaaagc

SEQ ID NO: 243604 - DNA, 655 bp, Homo sapiens
gagaaaaggacagagggaccgacccaagcttcagagacatggaataatatgatcctggttcataagccttgaaaagctcccctccgccagggttaaggaatggtgtcaccagccttggctgtgaggataatttcttgatttgtgttatgcaggctcctgtcaggactgtctccttaactcccactacctaaggaaaagatagccagagagttgtccagggatttgggtttgggttgcttctagaaagacagcatctttcttgctattttttttttcacatccccccaaaacaatttttttcccccttcagactgggcagactttgatttagataagaggttggagttaatttgattttccccatgtctgtttagatcaatgggatataggagatagtttgaagctaatgtacccctatgcctttgtgtgagtgtaagatttataacttgagggaggcagttaataaatagcacatccttgaaccataaacatacgagatagacaagagctagataataaacagtttttcccccaatccctaagctttacttattttttttactgattcttgtactttgtcattagaaaaaggagtggggttggtttcccagtgaccgcattcattaagaaactgggcatgtacagcaagtagcaa

SEQ ID NO: 243605 - DNA, 350 bp, Homo sapiens
aaaaattccatctgttgtatgagattaacagcacattagacactgtatggatattgctgagaagttgtgactgtaccacaaaagaaaggactaatgtgaagacacagcaatagaaactctccaaaatgaaacggaataaactgaaaaaaaaaaatgaacagagcatcacttaactgtgagacaatcttgggcagcctaacatacatgtaattggagttcccaaggatgggagagaacataaaaaaacatttaaagacataatggctgaagaatttttccaaatgtgatgaaaaccataaacatatatagccaagaaactcaacaaaccttgatgtgatttggctatgtcc

SEQ ID NO: 243606 - DNA, 461 bp, Homo sapiens
tcctatttcataagcttttttagggtgaaaatgtggaatctctttaatgtttttattctctcattcaaaagtaatcattgattctagacactgcttccatgacaatgcctgtgattgtcacagaaggcagagcatgatctcctcaaacaatacttgctgtaggagggagggaaccaatgtgtgtttggaatctggcttcaccacttatcacctatgtgactttggccaagtcaccgcaaactgagtgcccaacaggtgctgagtccctttctatatattggtcaaaatcaatttaaagggccatcccaagtgtaatgtaaaggttcatctgaagattcagagattcatgttctctctctgttctatgttattattcaataggaatatatgattcttgataatgaactgtcagtgcagaaagaaccttcttttcattaaagaataactttttgttgacttct

SEQ ID NO: 243607 - DNA, 180 bp, Homo sapiens
atatatatatatatatatatatatatatatatatatactgcaaactgccatatgacatcaccttatcaccagctttgtggggccaggagccttgtctgtctcattttctgttcaacccccaacttctaccagtgggcctggtttgtaggaggtgctcaaataaatgtttatggaaaaaca

SEQ ID NO: 243608 - DNA, 341 bp, Homo sapiens
agactccatctcaaaaaaaaaaaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaaattatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttcttta

SEQ ID NO: 243609 - DNA, 514 bp, Homo sapiens
atcacagaacaggcagaggcagttcagggggtattctggttgccttacccagctctgaagtctgtcagcctcttcagatgtcacttgccctgtggtaaggaagtgtagttggcagctggtgcagtggcaagaagagaaaggaggttccccaagacagaaatatctcagcaggggttagaataattcaccagtgaagtcatcacaacctagaaaaaaattgaatcctaccaacactaacatgagctgggaaagggatccttcctcaggggatgcttcgcttgaaacctcagcctgggtcatctgatccagagaaaagaccgtgatcatgggctacattctccataccagcttcatagctccagtgagaaaataaattcctgcacccaggagacgtggagtaagagatacagctgaccttgaccacatttcttacttccaagaagattgtagcaataattcaggtgctactatttgggacatttataattcaataaacctgcttacccctctgagc

SEQ ID NO: 243610 - DNA, 1562 bp, Homo sapiens
atcacagaacaggcagaggcagttcagggggtattctggttgccttacccagctctgaagtctgtcagcctcttcagatgtcacttgccctgtggtaaggaagtgtagttggcagctggtgcagtggcaagaagagaaaggaggttccccaagacagaaatatctcagcagaccgtgatcatgggctacattctccataccagcttcatagctccagtgagaaaataaattcctgcacccaggagacgtggagtaagagatacagctgaccttgaccacatttcttacttccaagaagattgtagcaataattcagtcttcagggaacaccaaggcctgtttgattttccaagtatcaacaagtggagttgacaagagtgacaaatggtcagagcaaagcatttcatgatgactgtaacgtgcctgcgtcagcagcgactgcttacagtgagattcacatgaccatcgtttatgacataggaagaataaaaggagaggagaaaaagataggtagttgatcgaaatgaagaactggatttggaaagcaacttcgaatagtctctgcctatatttctgagattaaggcaaacagtctcaagagatttcatccaggatacctcatcacagcctggagtgcagtgtcatgagcttggctcactacagcctccatcttctgagcttaaggatccttccctctcaacctccagggtagctgagactacaggcaacattcgaaacccaggtgccactccttcaggaaagtaccatcaagctccaaggactcttatcctctttctccttccccactacctagtcattagagcgtcagcatccactttcttgaaaggaagatgcctgtttttcacatatcccagaaaaccccattttaggacagcatttagcagagtatattcaggatcccactaacctttttggaagacatgacttccagatgatataaggcaagaataagaaatttcagtgacagggaacagaaatcatatttctgcattcaggatcatgttttcttggctccatcaggaactgtgcaggactgtgcactctgttgatactcacatggtggaattatattgcctttggccaaccctaaagccatcaagatagcaggtctggtctaccgagaagagagatcaaagagctcttcagctgttcccagctccccacacaaatctacctaacaaagtcccgataaacagtctgttttctggagtctatcaatactgatgaggtcttgttcttttggccaggctggagtgcagtggtacagtcgtgactcactgcagcttcaaacacctgggttccagcattcatcccacttcagcctcccgtgtagccgggactacaggtccctatcttttttgttggagaatgaaattaaaaaagatttggacactcattggttgtacacattgttactggggaatgtgttgattggaggccttgttagctaacagagcaaagagtaaatatacacatatgtttacaaatttctacaagtctccatatgtatctgcattaaattaaacatgaattcctacagc

SEQ ID NO: 243611 - DNA, 134 bp, Homo sapiens
aaaaaaaaaaaaaaaaaattgtggggaagagattgaaatctctaatgtagtataatgtgtatatataatagagcagccattcccattagggcccaatgctttgaggtgttgtagacaacataattagctgtgca

SEQ ID NO: 243612 - DNA, 347 bp, Homo sapiens
ttcctacacttgtatcatagtttaaggtcatactaaatgttcacagaaaattaatgacttatgcatcaaacatctcaatttaatcaggcttctattagaaagcaatctcttgcattacatataaaaatgagagcagagatactagttagagagcagcctattgcacaaggcagaaagtgattttgcttgtcgtatagcagaagttctattaggcaatgtcataactccaaataataccaaatacccctaatacttaaaattttcaaactcaaagagctgtttatgttaataggtccaacagggtgagtatatttattgtaattcagctttttttttttttgcaatat

SEQ ID NO: 243613 - DNA, 310 bp, Homo sapiens
acagttacccaggccagaatactccactcattcttctcctcacctccacagccaatcaagccctcaggtcccccccaagataacccataaaaccatctcttttctcattcccactacaccacgcaagcccaggccacaatccttttcccagatgctggcaacagctccctgaccaaaactgcctccggctgtgcgggtacacactgcctctctcccacatgcacactgcccagagggccagctggggcccgggtctgatcctgccacccctgccttaagatttcccattaaatgcatctgtttagaaaaa

SEQ ID NO: 243614 - DNA, 1322 bp, Homo sapiens
tcagccggaacggaaaaatccaggtcccaatacagagaggccacacaatgaattcaccctcattgagtgaggctatggatgagaggcatctgtaaggaagaccttgcacagtgcagggtgctggctaccctcagctaacccctagctcgcttcagctgctgggcatgaggaacctgcttagatttctcacagaagacatggagagttctttttctcacagaaaaaatgtagagtttgttccccagagtttgttcccaccatgtagaaagtgaccagtggtgaaaaggaaacataggaaagttaaggaccaaagggtccaaggagggaaaagaaaggacttctggttggttgctttgcgggcattttgaagagatcaggcatatgctctgggccttaaaaaaagacacagagattgaagtggtggggtgggcaagggagagagagatggagagagggtgagtgttgccaagtatcctgaggagacagggatgaggggacaaacacattgtgttcagataatggaaatacagtgaaaggttcatgcgttcctgttcatacatttcatttgacttatgtcttacagtttggaaataattttgatagtctaattttacaattaggagagatggagagagattatctctattttacagatgagaaaactgagccccagagagggacagtaacttgctaagatcacatagcaagtggaaaaagcacaataagaacccaggctttcagactcaaatcctgtgttctcttttcatccccctttagtttcatctttcctactgccaagggtagggaagctgtcagggacagaaggttggaatgggaccccaggacaagactgagcagagatttgaatgtggggctgaatgtaggggagctcagaaggctcctgggtggccccgagtgttagggagatcatccgagttagggagatcattccagtgcagaggcaccatcttccccatctacctgggcaaggcaaggaggcccaaggggaggttggggcaacaatagtctggtcctggactatgaaatcacaacccgatacagggaaggaagacccagaagaccaggtgggaaagaaaagggctggctccgaattaataagagcctacaggagcctatgtgttctgctggggatcacagaatgttctacatcttagaatgtgattcatcaaaagccattacaataaaaatgttgggtacttaaacatggcttagctttatttcactgatttggagtatagcacccctagtcataataagcatattcttacaggcttcaaaataaagtaagaatccctaaggtt

SEQ ID NO: 243615 - DNA, 450 bp, Homo sapiens
gggctggagttctaatgtcactatggcaacaagggacatggatttggggctctgcaaagaggggagccgaatgtgagacttgaataaagtgaggtctctcaaagggaacagaagcagaaaggtttcccactagcacagatgagtctgggctctcgaactcagccagaaaagctcctatgaaacccaagagagctcctacacagagaaggagaagcaagcacttaaggtaggctgaagccagcagttaatgcctgcaagttggtcaccatggaaacaacacaagaaaatctccctccactacctcattctttaatatctgaaattttaaatttacaaaattaagatacaaagaatcaatcatgaagttgaagtttatatgagtgctttctgctgttgcatgttgctcaaggtacagtaaaaccttaacatcgggttgacgactgtaacttt

SEQ ID NO: 243616 - DNA, 508 bp, Homo sapiens
aaaaatggggcctatacaatttctcctaatatggcatcaggaccaccttttgaagtgatatactcagggctaagtggagaaaacggtattgttttccatacaccacaaatggaaataaaaacacttttataaataaatggtataaaaacacttcctatgtgttatgatagttcaccaatctatgacctttattctttgtcaaacttctgtaaatactattgtattcttaagctttatacatttttttcactgccaacattctaaatttgacttatactcctgagtgacactatgtaagtaaggtactgctatatttttaaatcaaaaagaacaactaagaaacatgcttcaatatgctaaattctcaatgaaacataaaattcttcagagccatgtggccaatatgaaagcagtaccaccaacctggtggcagcatatcctaattataagcagaatacatgtagagaaaaagttgttctgaatgttccaattacaaaatgagcggccg

SEQ ID NO: 243617 - DNA, 418 bp, Homo sapiens
tgtaccagcaatgaataactaaataggaaactagaatttttaaataaaattaaatgtttaaaaaacatttacaatagcaacatatgaagcacttagatattaatttaataaaatatatgcaggatatgtcatgttcatgggttggaaaagattcttgttagtgcatcaattgtccccagttttatctataaattcaatgctattctaatcaatatcttagcaatcagatattgatcaaataattctaaaatctatgcagaaaggcaaaggaactagaatggtcaaaacaactatgaaaaagaacaaagttgtaggactctcgttacctaatttattcccgctgcccaatttaaagatgtaaactgggtagcaagagtccttcagcttgaggtacagtaaaaaagagtatgattttggt

SEQ ID NO: 243618 - DNA, 341 bp, Homo sapiens
cttccttcctcattaattcatccatacacacaggcattagtttgtccaatcaacaaatattaaaatgcctgttatatactgcatatctcagacatagctttcctgtgatagtctcttttgagagctaggagttgaggcagggctctagatctctcaaaccgctctctggctttatgtcatggaactctaggcaagtccaatctgcaagagaccctatagttgatcctctaatcaaacccttcatattttttttttttttgagacagtcttgctctgtcgcccaggctggagtgcagtggtgcaatctcggctcactgcaagctctgcctcctgggttcacg

SEQ ID NO: 243619 - DNA, 315 bp, Homo sapiens
caaaatttcaggtaaacttaaatattttaagtttttaataatttgtgttaccaaaattaaattttggttagagtttgacattcctaagtgatagaatcatcttaaacacatgttgtcaacagaaatttgaatgctgaagtcaatttttgttattgttattgttctgcttagtgaagaaatgtatcctctctaaccagggacagtatgtactgctttctccttaatactttgagattttcataaagaaaataatttcaaaggtgttgtgctgcaagctaaagagattatttctaaaggaagaatttgtcattctaa

SEQ ID NO: 243620 - DNA, 316 bp, Homo sapiens
ggattacaggcgtgagccactgcgcctggccagctctgacctttttacaaggatacactgggccctggttggcgtccaaagcaggctggtgctgcgtcctcactgtgagctgggcgcctgcagtgtggcagccgtcagaggacacagggcgtgttgggctggcattgtgcttggcctgtagtgaccacttggtggacgaggggacattgcctctctcagtcccaccctcgggccttgcagaagcaggtgagcctgggcagggccaggcgcccagagaccctctgtggaccccaggcatctcccagccctttgggct

SEQ ID NO: 243621 - DNA, 280 bp, Homo sapiens
accccgcctgtacagagaggtgccagttttcttcctcactgggattcctcctcaggggcttcctttttcttttctccagagatgccctcccctcctcagaacactctccccctcagcccttcacagagtcgctcaggagctttgtgtttaaacactgtttggccatgcacctccgtgggccctcagtggcctgtgtcataggcaggggccttaggttcctgatctgcctacgaatgtcgcccagaatttaatgataaaaaactacttgtaactcatatgc

SEQ ID NO: 243622 - DNA, 612 bp, Homo sapiens
tttaatcagttgaacagtttatatagacaggtggctttaataaattctgttctaaatctaggctaaagtttaagggaacctcacgttgaatctattaatgctaaagatcaattattgaaggaagaattgtagaagaatttaaatctatacatctacagttctgccaaacttacagttcttactattttttttcactaggaataatatagaggaattttttatggaacaagtgtattggtcaataaaactaagctttggtacaaagaacactattttaagaagtgatggttcattattgaggatttagtaataaataaataaatacacaaataaataaataataaaaactttgcaatagtccccaaatggcatagtcattgccagtataatgaagattatgtcttgtggtagacagaattctttttagggttctaatattctatcactttcaggccttcgctagtgtgcaaagagggagcatgtattaactgggtcattcttatccaaccatccaaaatgaaccatccaacaaccatccaagacgaacaaagagtaattgaaaccctgaacactaatatagagttccaaatttgaatcagtactgaaaaaaac

SEQ ID NO: 243623 - DNA, 350 bp, Homo sapiens
attgaataaaaacataggatacaaaaggcaaacatattctacttaaaacttgtccctcatcagcactcagtgccaacagtattaatttgctccagatgatagtgtgtattataaaattataaagttcatctaaattatgttttgaccctctgtgtagaatataaaatcactggatttcagagcataccacctgcttttttacatactttatacagagtatgatttcggagtatgattagagagtatgatatcagtatactgataaccaatttgttgtgtaattataactaatttgaatatattgacaaccaatgtgtttgtgtataaatatatattttgtgtatatattt

SEQ ID NO: 243624 - DNA, 454 bp, Homo sapiens
ctaagagactaaagacaggggcgtggaggggcggagctgggtggggggcgcctcatgaaggccgggctgggtgtcccaaaccagggccacggaaaggcagcgggaaggaggcgtgcgggccgtaggggctgaggggcgggtgttgggggcggaatgggagggacccgggacctcgcatgcatgaagccgcaggcccggggcgccctagtgtttgaggacgcgcggtccatgcctgaacctgggtgcgcagccgcagctgccgccatctgcctcagggggttgggctttgaccaggcggctgggcagcgccagttgaaagcggttgagcaggccgggcgcagtggctcacgcctgtaatcccagcactttgggagaccaaggcgggccgatcacggggtcaggagatcgagaccatcctggctaacacggtgaaaccccatctctactaaacata

SEQ ID NO: 243625 - DNA, 490 bp, Homo sapiens
ccctgggctggtcttgaattcctgggatcaagtgaccctcctgcctcaggctcacaaagcgctgggatttacaggtgtgagccactgtgcccggccacaaatcaaaatttttgagtcctgtcattggctcccccaggcccataggacaaagtcctaacccctagtcaggacactcagtgtcctctgctctctcctgggttttcatcctcttctcttctcactcctggccactgatctgtttccactgccctcatttgctctcctgctcttgcttgagctattctttctgcctggaatgcccaagttggcaccataatcaccaactaaaagatccttttctttttatttttttagagatagggtcttgctatgttgcccaggctggtctcaaactcctggactcaattgatctttttgccttggcctcccaaagttctgggattaacaggtgtgatccactgtgctagcctttttttattttttatttttt

SEQ ID NO: 243626 - DNA, 488 bp, Homo sapiens
atctctaggtcttgagtgtaacctgccccaccgtttaaaaaaaaaaaaaatagtgctctttcagaatttgaagctaggtatgtgagtgaaaatagaaagtgcattttgagtaaactcaccaactattcctggtgataaagaaaaggcaccaggccccaccaatggcagagacacctttcctattccacacatgcacaacttaaatctgatcacaataaacaaaagaagattgaaaccggaagttgctcacctttttttttttaaagtctccctgtgattgtataattttcttagctactacatttgctgtttgtctgtgctcctggagtgtaagtcctgaatacatgtgcagaacatgcaggtttgttacataatttaattatacatgtgccatgatgggttgatgggtgcagtaaaccaccctggtgcatttatacctatgtaacaaaccagcacttttttctcatctaccccagaacttaaagttt

SEQ ID NO: 243627 - DNA, 724 bp, Homo sapiens
ttttttttttgctcatgtataaaacacatatatccacatatgggttagtagtagtatttgttgaacacaatttttggttttcacacaaatgcaccttttcaaaaatcaattgttccttctcccaacataccccaggctggcaaatgacaaatgaaaataaaatccctgctggaaatagtggtataaaaagcattttccattttatgtgcacttttcaacccagagaaaataagaaatttgttttatttttgtgcagtagtttctaaaatataatcggagagatgctagtaaacatttaactttagattagctttctcaaaacttttaagcgctggaatgaaagatttgcttacattctgaagctggtgcagggtatcttttttaagccttctttggcatctcattttcacgcaccatctgagatgacttggaaaacaccagaaaataacaacactacttccacaaaacaactgcctggacagtgcctatttctacagccatcatttatagaactctttttctggggagaagttttattttaagtgtcaatactaaaagatggtatatttggagttggctgcttcaatcagtaaatgtagtcagcaccgactcagaaacagcttatttttaataattggaagaagaaatatttctagctgttagttttaaatggctacaaaggaaagaaattatttttttggaattattagcttgccgtatgtgt

SEQ ID NO: 243628 - DNA, 605 bp, Homo sapiens
agatttcagatttttctgggagggtggtggaaagagcaaggacttggaagacacaagataaagatttgaatcttgcttctggctctgtaacagcagagcctcaacttccctctggagaatgaggacataagactcctccataggaggtttataagcatggattcgaatttgtagaggacccagcccagcgaagtactcgttagctcccttcttttgggaaggatctgtcttttggatattttgtagattggccatggaagtggaaatatttgcctgtggccatttttcctagggaaaagcagggctgcctgacaagctgttgcaatcccaaaggcctctccatcccctagttgttttgatgtcgggatcaagcttggggtcaggttcaatgtgtgtctgggagaggggatacccaggcctttgcaagtctgagctctgcggctgcctaggactgtgacaccgaaggtgtggagaacatgggctgaggagggaggggcctttctgagctgagagaacttggcaagttacttttaaccttcgtttcctgtaagtttcccaaatttccttcggttattgatttccaatttcaacccgttttgattgga

SEQ ID NO: 243629 - DNA, 589 bp, Homo sapiens
agagtctcgctctgtcagccaggccagagagcagtgccatgagcttggcttactgcaacctctgcctcctgggttcaagggattcttgtgctttagcctcccaagtagctgaaattacagatgtgcaccaccgtgactggctaatttttgtatttttagtagagacaaggttttgccatgttgtccaggctggtcttgaaatcctggcctcatgaatcctcccacctcggcctcccaaagtgcctagattacaggcatgggccactgcaccaggcccagaagcttctttagactgccttctttcacttagctacatgcatttagtttctttcttgtctttttgtgagttgataggtcacttctttttattgctgaataattttctattgtatgaatataccccagtttggctatccattcacctattgaaagacatcttgtttgcttccattttttcatatgcaagtgcaggtttttgtggggtcatgttttcatctaacttaggtaaatacctaggtgcatgattacttaacagtatcataagcctgtgtttttctttgtaagaaacttccagactgtcttctaccat

SEQ ID NO: 243630 - DNA, 513 bp, Homo sapiens
cccattcttaccactggatgtcaagaactgctagatgcgatccagccagtctgtactcgactctcagttccatcttctcaactcacagtgtcttccaaagtccatgccacaccacagcctggaagatctcccaaggtggtatcttgaggcaatggtagagctcatgtcacagtattgtatgcctcaggctttgaataactcaccagtgaagtcatcttgacctggacagaaattgaatcctcccaagaatcccaggagcttggaaggggatccttccccagatgagccttcccttgaaatctctgccaggcatctgacccagagaaactgtaagtactgtgtagggctgggttggaaagtctaaactatgtagtaatatattatacaacaatcggtcagttatatgcctgacagtaaatgtaatgtggtatcttggattagaccctagaacagaaaaatgacactagtggaaaagctggtaaaatataaagaaaatcttttccagttaaaagt

SEQ ID NO: 243631 - DNA, 320 bp, Homo sapiens
tactccaatttttatggccttttaaaaaactacttttatattttagcactgacacacaggctcgcacctcttagaaaaagtaaaaagcttccattcaaaaactagcaatttttacagagctttctgtatgttctttgggtgggggttggggaagtaggaggaagaaggagatgaagcacactgtacttgtcccaaattatattttcctttttcatgtttttccctgaaacaatattgtttgtactccttatacaataatgtcacatctcccttgtttcttcagctggaggaggtggtggtggtgattcccgttgctaatc

SEQ ID NO: 243632 - DNA, 211 bp, Homo sapiens
  misc_feature (1)..(1): n is a, c, g, or t
  misc_feature (4)..(4): n is a, c, g, or t
  misc_feature (35)..(35): n is a, c, g, or t
ngtnagaccaataatgtcacattattgtataaggngtacaaacaagggagatgtgacattattgtttgtactccttatacaataatgtcacatctccctttttcatgtttttccctgaaacaatattgtttgtactccttatacaataatgtcacatctcccttgtttcttcagctggaggaggtggtggtggtgattcccgttgctaatc

SEQ ID NO: 243633 - DNA, 691 bp, Homo sapiens
acatcaccctgcctcaaaaagagcttcttggcctattcattcctaggcccaccaccaaaatcagattttgattatatttctcttatggtgtccaccaattccaatctattttacactgtttacatccagccctacctcatcttaaaaccctcaatgccgccaggaacggtggctcatgcctgtaatcctagcactttgggagtctgaggcgggtggatcacctgaggtcaggagttcgagaccagtctcaccaacatggagaaaccccgtctctactgaaaatacaaaattagctgaaagtggtggcgcatgcctgtaaccccaactactcgggaggctgaagcaggagaatcatttgaacccgggaggcatatgttgcggtgagccaagatcgcaccattgcactccagcctgggcaacagagcaaaactccgtcaaaacaaacaaacaaacaaaaacctcaataccttacccttgtcctctgtatccctgattaatattcaaataatcaccttaggccatccataatcacaccacattgggagaccaaggcagaaggatcacttgagcccgggagctctggaccagcctggaaaacatagcaaggctgtctgtacaaaaaaaatgttttaaattagctggggttgctggcgcacacctgggtttggtggcacacacctatagtcctagc

SEQ ID NO: 243634 - DNA, 416 bp, Homo sapiens
gggctgcaggattcggcacgaggagactttagccaccatatatctcattagcatacaaaaagacacttctgagattccagaggttttaggagctgtgtttctagtcacagaccaaatattcactgtgccgggaactggtggcaaagaccaaatgtatatttcttactacaaatcacaatatcaaagtgaaatacaagtttaatctcctatatttatatgtccaaaggccttttattcatggccacacctaaggattgcccttctgagtctccggatagcatctgcatcatagttgacttatacttctgctaatccgcacccagtgggtaggagcagaatgatctagccagtagccacacaggaatgtagatggaaggagctatgtagggctgacattttctgttgtttttccttgg

SEQ ID NO: 243635 - DNA, 576 bp, Homo sapiens
gaagtgcggttgccctgatccatgaatacttaatggtttcaaccattaagttagccattgaagaggtctagctttatttcatgagctgttgtaaatgttaacattctatcagacgttctgcactgtgaaactggaattattctgtaatgaggaaatctccctcacaaccatttagttaccccgaggtataaattatataaggaaggtaggatacttctttctttcctgttctcaggcaccacaaggctcataatcgctctccatagcttatactgttaaaataatctgacgtttctgctccagagagatgcattctctacctactcacagtgcactcctgcttctttgaacttttaccatgtttagagtgtacatcataaaatgtgatgtctggctatggggtctagattcctccacaaggtagttgggcacttgctacaacattgtaagctcttaaaggtgaagtacctcctgcagtgttatcctgtttaggagatagaaaacagccctggctgaccaggcgcggtggctcttgcctgtaataccagcactttgggaggccaaggtgggcggatc

SEQ ID NO: 243636 - DNA, 522 bp, Homo sapiens
gaagtgcggttgccctgatccatgaatacttaatggtttcaaccattaagttagccattgaagaggtctagctttatttcatgagctgttgtaaatgttaacattctatcagacgttctgcactgtgaaactggaattattctgtaatgaggaaatctccctcacaaccatttagttaccccgaggtataaattatataaggaaggtaggatacttctttctttcctgttctcaggcaccacaaggctcataatcgctctccatagcttatactgttaaaataatctgacgtttctgctccagcatgtttagagtgtacatcataaaatgtgatgtctggctatggggtctagattcctccacaaggtagttgggcacttgctacaacattgtaagctcttaaaggtgaagtacctcctgcagtgttatcctgtttaggagatagaaaacagccctggctgaccaggcgcggtggctcttgcctgtaataccagcactttgggaggccaaggtgggcggatc

SEQ ID NO: 243637 - DNA, 330 bp, Homo sapiens
tttttgtagtagagacaggatttcaccatgttgaccaggctggtgttgaactcctgacctcaagtgagccaccaggcccagccttgcccagttattatataaacaaggtctcagtatgttacccaggctgatctcgaactcctgggctcaagccatcttcttgcctcagcctctcagagtcctgggtttacaggccactgcacccagccaccttttcccattttaaagttggtttgtttgtgttgttgagttgtacgagttctcttttatagattctggatattaaccccctcgtcagctatgtgatttgcaaatactttctctcattct

SEQ ID NO: 243638 - DNA, 200 bp, Homo sapiens
cagatcaccagtggtttaacagctgtgggcggaggagtatcaagcactcccatatcctcgggggaaatggaagctcatgctgcctctgcagagggtgaatggtcagcacagaagacagccacagatcaagaaaaactagttgtcaacaaggcccactcacttagaaacaatctaaataaaacccggaagatcagagcaga

SEQ ID NO: 243639 - DNA, 666 bp, Homo sapiens
tgagaaggaatctcactctgtcacccaggctggagtgcagtggtgtgatctcggctcactgcaacctctgcctcctgagttcaagcaattttcctgcctcaacctcccaagtagctgagattacgggcacccaccaccacgcctggataatttttgtatttttagtagagacggggtttcaccatgttggccaggctggtctcgaactcatgacctcaagtgatccacccaccttggcctcccagagtgctgggattacaggcgtgagcaccatgctcaatggtaactactttttagggatgatacatggtacttagttgtcactgatttttttttgttgttgttcaaaaattattatagtatctaaaatcttgtgaacatgggaacagattgtgaggagaaaaataaataaaagcttgtgattatttcaaattcttatgatctcaagtcttgactaaaatgtgtgctttacagggattaagattaaagtgaagctgtttttttccctcataatgtttctaacttaaatttttaaggggcattaatacttatgaaattgatagttttctcatcttttgattactcccctcaattcatgcttctgaaaaatgcattctagctaaaaatataagaatgcttattaatcataaaatatattggtacttg

SEQ ID NO: 243640 - DNA, 474 bp, Homo sapiens
tccataaggaatttctagaaggatgcaataagaactgttaatagtcattttctctggagaggaaaacaagatctggagtgaaaggaaaagactgtatgtaacaggcaatctgtagaacactccacccaacagcagcaaatacacattcttttcaagtgcacatgggacatttaccaagataaatattaatatcttctgggccataaaacaagtttcagtacctttaaaagaatcaaggcatacaaagcatgttctctgacagcagtggaattaaattagaaataaatttcagaaagatttttgggaagttcccaaatcttcagaatctcaataatatacatttcagtgacccatgggtcaaagaagaaatcaatgggaaattaaaaagcacttggaactgaatgaaaatgaaaacaaatatatcaaaatttatggaatgtcattaaagcagtacttaaagggaaacttacagca

SEQ ID NO: 243641 - DNA, 283 bp, Homo sapiens
cctaggactgtggctgctttggtgctctcagaaagtgagacaacattaaatttagatattctgggtaaaattgggtcctgggagtacacagaatgtctacattccgagttcatccgctttcttcaggatgagccaagatcaactggaacagtccacgcagcttacatggtatcgcgagaagcttgcagttgccaggtgttctactttctgctctctcccacatggcaattagtgaaactgtctttcaactactctaataaatcaaactttattctctgtctca

SEQ ID NO: 243642 - DNA, 625 bp, Homo sapiens
gggagtgggtgcaacagaaacagttctagtgttggagccgaggaagccaactctgaaacatttggacctttgttgtctgacattgcttttgccactccttcttccttcctcccacctttgccttccccaccacctcctccaaactcccctgccttctatctctggccccactgatgacccctccatgtgagtcgtaggcttttactacccatgatttcttttctccaagcaaaagagagaagagtttatttcattctcagcagcatccctggccagcctcgtcaaagctacgtttgaaaaccaatggccaagatcagtgcttcttaagctttaagttgcaaatgaactctctgagtgaagatgttgttctcaacctgtaggaacttccttcctgccaagaagctggttcattcatcaccaagcatcatcatcatggaattctcaccctgctggaggttcgagccaagacatagaaagaggacattacctggggcaggaatcaattgcctatcactggggatgcctgcagatcattgtccagagtggctgctgttcactgagtgtttcctctgtgccgggcaccttgcacaccttattttcagtctccgcagctgccttgttgagg

SEQ ID NO: 243643 - DNA, 472 bp, Homo sapiens
tgtcagtgagcaataggggtctctgccacacctttggagaccactctactcctggctcagtttcccaacccctgtatgtcagagcctgacgtcttcctttttccaacttgtcttgagtcccatctggcctgagtttgaacaatagtaatcaggcctgttggctgatatgagatttgaggtaaccacgaataagcccttcttggtcagaaccattaaagataacttctagtctcaatgaccacacatttgcaaagcagtcctcctggaatgtccttccctgaactcctgtggcccagtcattataggcagagcactgggtccaaggaaaagccaggccccctgtatgggatgggccagtttgctgagaatgacacattactgttgcccctctaacttgaccctgggtttcctgtgggtaagcagctgtttcagcaaatcccagattcctgcaaaacagccttttaagtttttc

SEQ ID NO: 243644 - DNA, 723 bp, Homo sapiens
ttctctgtggagtgtttcctccgtggtgcttttccaccattgatagaagatgaccaaatgtccttggccatcactcttctttgctcgtgcccaaagtcgctaagccaggtatatcattcttctaatgttgtagaaattgaaaagagcaagtaaacactgaagccagatctctctcatgacctcttctccacagaaccatcggaagttcaaacttcttctgtgagccctgtgactttgggcagtctaaattctacctcgcctgcttctccaatgtcatcaaaacaatgaaaacaaaaccattcagaattcacaggaagggtttaatacatttaatgaaattatatctcttaattatgaaaacttgaccaaataggcttgccatttttggttataaaagccatcccaggacctgcagtttacactctgaatgccacctgccagtctaagctcctctgtggacgtccatctggctagcatccccttaggcagtaaataagtagggagagaggcctttctacaggacttttccttttaaagtcctttaaaggaaccctacctgtaatccttagaaattttatgtctttgtcttctctccttaactagcaaaagtttcaaaggcttatctgtaactcaaggggtgtcagttcatttgtttgcaaatgaaacctgagctttctgaaaatgactcccctgcaaaatcattcccccataacactcctccag

SEQ ID NO: 243645 - DNA, 366 bp, Homo sapiens
agatttcatgagatatttcatgttttgtccctctaatggttctattaagtctcttcaaacaggcacttttctaccagagcaaacttgaaagaacagaacatttattccaaaagcaatttcctttcccagttattttctgtattcccttggcagtgtttttcgacagttttacttgaataagagcttatttggtctcaaaccagcttctcctgctgcttgaacctgcagtcaagtctcagaccttttctgtgtgacctcccaatttgctaccatggaaatgattacaatcacacaagtgtattttttattgcaagatgagttcagatatttattttttaaaattaaagcaaactcttgcaaaatata

SEQ ID NO: 243646 - DNA, 573 bp, Homo sapiens
ttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccagatatgactcttaacaacttccttcaagtaactcattttgagacagtcaaaaaattccttcattttattgtctaaaattatgcataacaaatgactcagaaataaaatctatttttattttacatggaatataggcaattcctaactcagaaatatgatgggttgattctttaccttgagatatttaggaatgacccaaatgtccaaaagtaatacagggattatttagtatgtatgaagcagtccttgggatgttatttttaataattttgagtagg

SEQ ID NO: 243647 - DNA, 136 bp, Homo sapiens
gcataaattaccttttatagaagtttagttgttaatgatcatttttagggtctcatccagagaggttcaacacattgttatggctgatttaaattatgattacaattatgaaatattgtgtctgtgaagttcaaaa

SEQ ID NO: 243648 - DNA, 311 bp, Homo sapiens
ctctgcccagtgcctggcacagcaaatgcccaggtggctgctgctttccactgagacttgaggctcctgagagttggtggcaaagggctcacccagagctgaagactccagcccattcctgtgcgagggctccaggcaccttggaagcaccgtgggccggggagccaggccaggctggttgtggatccccatgagtccttgtcactgtgtggcccagctggaaagcatggtcaataatgtctgggaattgtgaaaattgtgtgaagtgtctgcacacagtaggtgctcagtaaaggtttgttgagtgcgta

SEQ ID NO: 243649 - DNA, 318 bp, Homo sapiens
acattgaaaacaagcaaagaagtaagcatcatccagtatccgcagataaataagcactgttaatgttaaaattatacacgcacaaaagcaaatacacattttaaataaaattgatatcatagtacaggataaaaatacatatgtatagctttatttcttgaaagtatatataatttgcttcaagttgagatggagtaaaaggactggttttaccatctcattttaaacaattaaaaaaaaaaaaacagacaaaatgtaggaaaaaatggcactcaacatgttgtttaccagccagttaagtatagtagtctctgagac

SEQ ID NO: 243650 - DNA, 482 bp, Homo sapiens
caacagatagaagcctcatctctctctctctctcttttttttttttaaaggcaaagccaaggagagtgccagggaaaaacataaacccttccttggtccccaagcaagaaccacacacagcttaggatctgaggtggaagatgtgggtagcaggtggggcataaaaagctaaaaagctgtggaagtccagaacttagaataaaatacaactgggcctaattgagggtagaggatgggaggagggagaagatcagaaaaaataagtattgggtactaggcttagtacctgggtgacaagattatcggtacaacaaaccctcgtgacacaaggttacctatataacaaacctgcacatgtaccccgaaccaaaaataaaagttaaaataacgaataaaaaaacccactacctatatgattggtgactgttccaatgaattcaaaagagaaccagactagaatatcattttcttgctggggggtg

SEQ ID NO: 243651 - DNA, 491 bp, Homo sapiens
gatcctcaatttatttctaaaatagtcttagttccaaagcaaacacactccagttaatgtgccctgagatgtgtttcttaaccaaccagtccttgacagctgagctctgtggacacttgaagacaacagctattgttgagtttctcactgtgcagttggaagagccctttgtgtttaaatgactccaaagactgaactcactttagttgactttctcaggaagctcatgggtagtaaactgtgagaatttggggaacagttcagcttattacttcataacccctgatactcttgctaacacgctgaagacagaaaatatagcttctggggacatcgaaatccaagacaagaaggaggcaactggcacttgttgtaagtttgtggaaaagcaggttttctttttggaatcatggctaacttaagtgatcaaaagactgaaaattattctttccacttggctttccacaatgaataaaactcatttcaacaca

SEQ ID NO: 243652 - DNA, 387 bp, Homo sapiens
acatgaggaaatagaatgttattgaggactgggggacacagttatagttactgagtgcctatcacataacaaaagttatcctaggtgtttttcatagactatatgatttaattcatataacttcacaccacaggaaactaagtcaagggaaatgaaataatttagatatttcgtagatatttcgtcgtagatactggccaaaccagaacatgaacccagatatttctgactaaaatgctcaaagcttttctacttcactacataacattctattttgtcactatcaatcctataaatgtattaataattttaattttgtggaccagattttccccttttcaccttgatcaaagataatgtgattataaaggctgagattttgtgaaa

SEQ ID NO: 243653 - DNA, 529 bp, Homo sapiens
attggtgcttcaaggagggcatttatttagccttaatactagcctatttggcatcataaataagagaaagaaaagatgaagaaatatgtcagaaatagattctgattcaaatgctacaattggggttagttaccattaaatagcaaaatagaaaatggatgactcctatggcaaatggtttggggagagacaatgtcgaagttgcttggcatgacaatgagtgccttaaaaccgtttggcctagaagtttcatctgcaggaatttatccaaggaaaataaccaggaatgtacgcaaataactgaatgatatttataatagcaaaaaaaaagaagcaatgtaaatgtccaacattagaaaattggttaagtcattagtttttagacagtacttcttaaagtataggattccataggagtgtgttgataaccatgtcagaaaagccacaggctcttcatcaccacttcaatcagagtagtttcagttttatgtgttgtacatattaaggttccatgtgagactttgtttag

SEQ ID NO: 243654 - DNA, 673 bp, Homo sapiens
cgggagtccacccggggggggccctctaaaattagggatcccccggcgcaagaattgggcgcgaactttcctaaaaatacaaaagttagccaggcatggtggtgcatgcatgtagcccaagctacttgggtggctgaggcacaggaatcgcttgcaccctggagacagaggttgcagtgaactgagatcacacaactgtactctagctcaggcgacagagcaagactcttaaaaaatatatatatattcataccatggaatgcaagggtttaaaacaatgaaatggaactttatgtactgacatcgaaagcttttttttatatgaacatgattgtaaaagagtaaatataatttcaatctgctattttaaaacagtacatttctagatacatattaaaagtatggaatcagcttcacaaagtgcatctctagattacaggcctttttacttccaacatttcatattttgcatttttattatttttattgtaaacatgttttaaatgtatgttagtttgcagagataatataagtaaaactcaaattgtataagtgagtttttcagacaatttattaatcttgggcagaaacaattaagtgttaaccatttggaatacaaatgtttgtacgttatgatatgtaatactaagcataattaaaactttgtaacttt

SEQ ID NO: 243655 - DNA, 420 bp, Homo sapiens
ttttattaaaaatgattcccagctttttagagatttctagttttaagagtattcttatatgatacacacttgtgacagcattccagtgagacaggaaaaataagtattagtgccctataggtaggaaagctgaggctgggcacggtgcctcacagcctgtaatcccagcactttgggaggtcaaagtgggtggatcacctgaggccagatatttaagaccagcctggccaacattgcgaaaccctgtctctactaaaaatgcaaaaattagctgggcatggtggcgcacaactgtaatcccagctactcagaagtctgaggcacgagagtcactggaacccaggaggtggaggttgcagtgagccaagattgtgccactgcactccagcctgggtgacagagtgagactctcaactcaaa

SEQ ID NO: 243656 - DNA, 443 bp, Homo sapiens
cttattcccgtgggatgtcatcatagtgttccttggacctttgcccagcgagatatgatagggatatttctttagttgggcctttgtctaccttgtggtcaggtgattaagaaggatgtttctcacagcccgaatgcctgggaaatgtttcactttgaccaagggttgcaaaatagtggggaagcttaaaatggtgcagtttggactaacacccaggaggttgaggccgcagtgagccatgattgtgtcactgtactccagcctgggggacagagcaagaccttctctccaaaaaaaaaaaaaaaaaaaaaaaaaaatcatattgagagggatgtgtaagacctgttggacatttggggaaaattggtgatagttccatgcaaaacaagcaaatggagacaatcaagacaattattcagtccaagaaaaccaaaacattgttc

SEQ ID NO: 243657 - DNA, 342 bp, Homo sapiens
actaatggcatatacattcatgaatcgtgcccaaggggtgagaagcaaaaaaaggaggactattattatgtccataatattattatgttactaaaacatctgataacgatgatgatgatggtaatatttacgtcatgctattagggcaccatgctgctctaagagctttacatacactatcttctttaatcttcataacacctaaacttgtgaggtaagtactactgtcatcccactttacagatgaggaaacccaagcacacagaagttaaataacttctcacagcctaaaaatatccaactattaagcagcaaaagattcaaactcaggttgctttatcc

SEQ ID NO: 243658 - DNA, 363 bp, Homo sapiens
cactctgtagcccaggttggagtgcaatgatcatagctcactggagcctccaattcctgggctcaagcaatgctcctgccccattgttgagatgtggtctcactatgttgcccaggctggtcttaaactcctggcctccagcaatcctcccacctcagcctttcaaagtgctgggattacatgtgtgagccaccacatctggccttaaaatcactaatagtctttttaaaaaaaatttctaaattacactttatttttcctctacttttaggttcagtaggtacgtatacaagtttgttacatggataaattgcatgtcactgagatttggtctatgagttatctcatcacccaggtaatgag

SEQ ID NO: 243659 - DNA, 508 bp, Homo sapiens
tgcctcaaaaaaaaaaagaaagaaaaaagaaaaaaaatttactttttggcacactaactccacttctagacatctatcctaagataataatcaacatataaaaatgcacatacaaatattgactataagaataaaaaaatttcagcatttaagctgtacaggtgaatgtttaaattatggtacacccatttgtgttatttattttaaaaaatttttttgaagtataactatgtagaaaactgtcctagcataatgttaagcatcgttcccaatgtgttttaaaatctgatgcaaagcaaacagaaggcaggcaattgggaaggaaggatgggggaaagaaagaaaggaacaatgaaaaggaggaaaaggaaggaagagaaagaaagaaagaaaagagagaaagaaagaaaaaagaaagaaaagaaaggaggaaggaaggaagagaaagaaagaaagaaaagagagaaagaaagaaaaaagaaagaaaaaaaaatcataaaaaaagcat

SEQ ID NO: 243660 - DNA, 830 bp, Homo sapiens
ccagtatgacaacgagaagaagtgggagctcatctgtgatcaggagcggtttcaagtcaagaatccccccgcagcctacatccagaagctgaagagctatgtggatactggtggggtcagccgaaagtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagtatgtgggccacaaagtggggtggtgggagaacagagaattcagcccccacactgctgcatctagccagcccaccccgggcccttggggttggcgagaggggtagccatgcattaggggtccgagtaagggactcatacagagtttgggacaccagtatgttaagaagccatcaggggtggggctgggtgctgtggctcatgcctgtaatcccagcactttgggagactgaggtgggcagatcatttgaggacatgagtttgagaccagcctggctaacatggtgaaaccccatctctactaaaatacaaaaattagccgggtgtggtggtgcacgcctgtaatcctagctactcaggaagctgaggtgggagaatcgctggagcccaggggatggaggtggcagtgagctgaga

SEQ ID NO: 243661 - DNA, 934 bp, Homo sapiens
tgggtgtgcactttagatattcctctgtacatcctgtgtgtgcttacatggacacattctgtgtacttatactgtgtgtatacacatgtgcagcccatatgtccatacataggtgtgtgtgtatactatgtgtgtactttgtccacttatggatgtgtgtgtgtaccattgagtccatatctaggagagagagagaatgtgtgtgtgtgtgtgtccatgtatggatgtgtggatattctatgtctgtatttagagtgcaggtatatggatgttcatgtgctgtgtgtgtgtgtgcgcacacacactctgcctctttgtgtgtgtgcatgtgtataccttgtgtgcccatgtatcgggggtgtgtgtaccctgcttgtctatgtatgggggagcacatgtagcctgtgagttcttattctgctgggcaggtgtgtggaggtggtgggggaggctgagcatgaaaggccacttgtgccagttggaggagggtgggcgctgctgcctgctgcctcaggacttggtgggcctgtgggaggccgggctccacccaccagccttccctgttctcggtccccagtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtaagccccctgctcccagccctcatgccgctcctcagagctttgatccccgtctccctgcatctcacccactcccctggccagtttcaagccaggcagcccgagcctaccctggaaccctccacttggccttgagcgatgctccttccagaaggcctgcccccgacagggaggggtggcctctcttccaccactatgt

SEQ ID NO: 243662 - DNA, 460 bp, Homo sapiens
ttttggccattttaaatgtagctactagaaaatttaaaattacatatatgtttgcattatatttctattggatggcactgctcattaatcttttcactgctgcagaaaaggtgaagtagagtttgacacgtttaacaaagccaagtaaatcaagaacataagcactgacagtcctaactctgaataagcttgaaagtaagactaaggctgggtgtggtggcttaggcctgtaatcccagaactttgggaggatgaggcgggtggataacctgagccaggagtttgagaccagcctgggcaacatggcaaaactccatctcttgtagagaaaaaatatgaaatacaaaaatgcaaaaattagctcggtatggtagggtgcatctgtagccgcagctactccagaggctgatgtgggaggattgcttgagcctgggaggcagagcaagacccggtctcaaaa

SEQ ID NO: 243663 - DNA, 368 bp, Homo sapiens
atcatgaggacttgaactggagcagtaatggtggggatggtggagaagggatgaagggataaacttaagagacattacggggctagacaatctattagacttgctaaaaatatgattgatgtacaagcgagaaaaagaaattaattcaactagagatattctcagacatgcatgaaatagcatttgcagcattgtttgaaacagcaaaagtttgagacaacctaaatgttcctctctagggagcaggttaaaaaaatcataatttttttgcatggtacaggcataacatggagcaccaggcagccaccaaaatgaatgagacagctgtttagattactaatatgcagtgacctccaagacatattgtt

SEQ ID NO: 243664 - DNA, 413 bp, Homo sapiens
aaaccagcgtggtctgtagttaataagcacaagataagagactgcatttactggattgctcatttcatcagaaaaaaagtgatgtttaatacacttaacaaaaactaaagtcaaagataggacataaaattaggcctatctcaagttgatgggaaccaagctactttagaaaggatacaataaaacatagtcccaaagtgaaatttttgatttagggcttctgtgagacaattctattatagaaataatgggatgacactgtttaaaggcaacctttacccctccaatagtgtttagtaaataaaagtgaaatcttcattctaccacacgcagcctgatgacctaaatccaaaactgattgttaggttaacacagtgtttcattgcttccattttccaccatttacgtggtta

SEQ ID NO: 243665 - DNA, 299 bp, Homo sapiens
cacttggaatctcaatttattgccaatagacgacgttgtcaggcactaattttctggtggcgctccatcacaggcctctcaaatcaggggaggggctcagaggccggtgggcaggggggctcggaggagccgtcgcgagccagccgggggttcctgtaacgaggctttaatgaggggagcgcgacggcctttgtggacaaaccggaggaggaggcggcggccgggtcaggagctcggcaaggtcgcttcctcccccggcccccagagcccgggaatccggagagggtcagcggcggccg

SEQ ID NO: 243666 - DNA, 377 bp, Homo sapiens
gaaggaacttttgtagactagttaaacctcttaagcctctgtggcccaggctggccatctgtgctgccgttgctgctttgaggatggctgaggcctgcagctactgggggattggatggcaggcctgtccactctacccagtgctgtcaccccacattgtggcaccaactctgtctggaagacatctgtgcttcttaccttggccagtgagtgactcaatgacaactcagctctggcactttgcctcttgggagccaggaacagctgggaccctgaggaccatgggtgggagctactggctaggctgaacaagccctggctggggcccaggacttggaggatacctgctgcccactccattagccctcaccacagag

SEQ ID NO: 243667 - DNA, 450 bp, Homo sapiens
ggtttgctgaccaacaaacacatcatagaaactgtctacattaaaattcctgtcttggccagctgctggccatcgactagcactggtctgtaaaacttgatacgatcagcagggtgcggtggctcacacctgtaatcccagcactttgggaggctgaggcgggtggattacctgaggtcaggagttcgagaccagcctggtcaacatggagaaatcatatctctactaaaaatacaaaaactagccggctatggtggcacatgcctgtaatcccagctattcaggaggttgaggcaggagaattgcttgagcccaggagatggaggttgcagtgagctgagattgtgccactgcactccagcctggctggcagaatgagactctgtctcaaaaataaaacaaaaacttgatacattaaaaacttattcttttgtgtgttttgttcggtga

SEQ ID NO: 243668 - DNA, 319 bp, Homo sapiens
ccttgggaagacacaaaaccatcaccactagaaaatgcctttgaccaagccttggacagatgaagacaaagcggagcacacatcacgaaaagtgtctgtctcatccgcagcctggcctacccttcccccatcaaggtggagaaaatcaactttccataaattatgcagccttaaagcaagtgcttcactatgctgggagttaacaacctcatttgtaaaatcagtggatgagactatcctagaaaatgacctttaagaccttttccgggtctaacttacactttactaagagtgccgattaaataaacttgtgatgaaa

SEQ ID NO: 243669 - DNA, 341 bp, Homo sapiens
ccttaatgaaagatttaaaaaggaggaaaggagtagagtatacaacgtccacccagtagaaaaagctaattctgttgtggcagcacaacagaatcttttgggtctttctcatccttagagaaaggtaggtaacaagagtattcaactttttagaataaaacagcaggattaagctataaatgcagaagtattatactaagaaaatgcctcccagatattgttaaagcaaatagtatcatatccagcacaaaaccgcagtgaattgatttaatcagacattatcagagcaaggaagaaataacattctggttttaatggcaaaagaaaaatcccacctcata

SEQ ID NO: 243670 - DNA, 503 bp, Homo sapiens
agatcgaggtgtccaatcttttagcttccctgggccacactagaagaataattgtcttgggtcacccataaaatagctgatgagctttaaaaatttgcaaaaacaatctcatgttttagaaagtttatgaatttgtgttgggccactttcaaagctgtcctgggctgcaagttggacaagcttgcctagattattgacttagtataggaaaagcctgagtcgaaatggagcaaaagacttcctaggcaaatttcgttctttttgaaggatattccattcttatatttgcactttacttgtgtgaaatgggatgcatgctctacagaatgtaaacttaggagttctggccttgcaatgtaatttatgcacatagcatttaagagtagttttgaagtcagcaagatagacctgagttcaaactgtggttgtgacattcactactgactgacttagggaaggtacttaaacctgtaaaacctaagtttacttaccaaaaaaaaaaa

SEQ ID NO: 243671 - DNA, 575 bp, Homo sapiens
aagagagaaatacagatgtatatacacattacctaaagcagaatgaggaccctactgggctgccatcccagctggactgctgctgtggagctcagcatcaagtacttccaggagaagcttcagcaggacctagaggcagagcatggtagaggtagaggatacagccctcataccaccgtgctgtatgtccatctttcaagtcctggtggtgcccgcagagtttgaagggaagccactgcttcagagataccaggtggtaaatgcatgcctagtggaagtgtgctcctctgcatctatgcctttgagcagaaagcctttgagtcccaattagtgggcccatgagtggccaaaatgagggactgggacctgtatagccgttaaactataaatcagggccaaaaaggaaagataaattataagtttaaagaaaatgggctaggcatggtgacttacacctctattcccaaaggaagctgaggcagaaggatcatttgaggtcaggagttcgaggttacagtgagctacaatcctgccaccgcacttatatgtgcaacagagcaagaccttgtctcaaa

SEQ ID NO: 243672 - DNA, 417 bp, Homo sapiens
ctccttcccttgctctctccctctttttagtccagttttatggcgctctgtgttagaggtcttcatggagctacctcgagtccctctgagaaagggccatcaacaagcccaactcacaagtcacgagcagagctggtccccagcctggcctggcagctgccctgctgaaagctgcaggggccccaggctctggctgagtggacgcatttcctccccaaacagacgcttgcatgagaacagaattctccaagtatcaagaaaacaccaggctatgagaatggatggccaacagcctggaaattttctaagtcccatttgtgctggaagctggcacagaaacaaccaagacggcaaggcatgtggtttcctaggctttttaaaaaactatttcagaaaagaaaaaaaggcacaagcata

SEQ ID NO: 243673 - DNA, 387 bp, Homo sapiens
gctcactgcaacctccacctcccaggttcacaccattctcctgcctcagcctcctgagtagctgggactacaggctcccgccaccacacctggctaatttttttgtatttttagtagagatgggatttcaccatgttagccaggatggtctcgatctcctgacctcatgatccgctcgtctcggcctcccaaagtgctgggattacaagtgtgagccaccatgcccggccttatctttgtttttattgcatttgacttcgggttcttggtcatgaaatccttgcctaagccaatgtccagagggatttttccaatgttatcttctagaatttttatagtttcaagttttaggtttaagtccttcatccatcttgagttgatttttgt

SEQ ID NO: 243674 - DNA, 448 bp, Homo sapiens
  misc_feature (27)..(27): n is a, c, g, or t
  misc_feature (45)..(45): n is a, c, g, or t
gtcacctacttctcctctacaaaaagnaatagggtgtaaaacagnaagtcaagggttttcaggaaaaggtctttcttcatgaaaagcagggcactggggcataagagtatccctaatagcagtaagcccctgagtttacttttgggcccttgggtgtttctccccatgtgtatttttcctttttcctcagtgagtccagagaattcattttgtctttctacttttaagctaccactcaccaaccaccacactcagagggatttctccaaggtggcccgccaggggacgtgcagcctcctgggatctccctgcttgtggttgaacatgggtgggacagaagtttattttttgctactgaagaagaaaattaatagcaaattaaccgtgtaaataatagaaatgaaatagtgtttaggcaccaaacctttgaaaactgatctttcttaaa

SEQ ID NO: 243675 - DNA, 330 bp, Homo sapiens
agagagagagagagagacctgtgtgatgtagctaaagcattaatctgagggaaatgtatagctttaaatgcctacgtaaaaaaagagaatttgaaaaaatcagtgatttcagtttccatctccagaagctggaaaaatagtaacttaagtccaatgtaagtcaaaggaaaagtataatagagcagaaatcaataaaatacaaagcagatagctgacagagaaaatcaacagacaaaaagttaatacttagaaaaggctaaaaaagaaaaaagaggtcaaacgcgatggctcacgtctataattctagcatggcaaaaccctgtctctaca

SEQ ID NO: 243676 - DNA, 418 bp, Homo sapiens
ggttaggtttttgtggctcgatagcgcacttcattttagcactgcatattctattgtctgaatgcaccacagtttatgcactcacctactgaaggatatcttggttgcttacaaggtttggaaattatgagtaaagctgctacaaacatctgtgcgcaggttttttgtggatagacgttttcaacttatttacgtaacgaccaaagagcacaattgctggatcatatgccaggagtcttctgagaaactaccaacctgtcttccagagtgactgtaccattttgtattcaaacgagcagtgaatgagagttcctgctgctctgcatctccgtcagcatttgatgttgtcagtgttctggattttggccatcttaatagctgtacagtgggatcttgtcattgctttaatttgcatttc

SEQ ID NO: 243677 - DNA, 328 bp, Homo sapiens
cctcccaagtagctgggactacaggtatacaccactgtgcctggctaatttttttattttttgtagaattgggtctcactgtcttgcccaggctggtttcaagctcctgggctcaagcagccctcccatcttgatctcccagagtgctgggattataggtgtgagccaccatgcccagcctattccagtttttaaggtgaaagtttaaataattgatttgagatatttctttttttttttgagatagaattttgttcttattgcagtgagctgagatcatgccactgtactccagcctgggtgacagagtgagactccatctcaggga

SEQ ID NO: 243678 - DNA, 364 bp, Homo sapiens
caggtggcttattttaggtaaaaaagcttttcagacttttgcttaaattcttatctaataaatatagttcttacaaagtcatagtaaaatattcaaaaccaaaattttctctaaatcaacagctatatttgttccatgtcttgaaggagagattttgaaagattaatacattgaatttaaacctctaggtctggaatacttaatttaaacctctaggtctggagtagcatccttccaggtaatattatacaatttaagcctaaataatgcagtgtaaatttgagctgacaccaccttaagtctctgttttctaatgcgccctgtactttggagagacggtatgctttttgaaggaattggatag

SEQ ID NO: 243679 - DNA, 1147 bp, Homo sapiens
caaatagatataaaatatttatatacttgctagagatagtgatatggtttggctgtgtgcccacccaaatctcatattgaattatagctcccataattcccacgtgttatgggagggagcccgtgggagataattgaatcacagggatggtttcccccatactgttcttgtggtaatgaataagtctcacgagatttgctgtttttataaggagtttcccctttcacttggctctcatttttccttttgcctgctgccgtgtaagatgtgccttttgacttctgccatgattgtgaggcctccccagccacgtggaactatgagtctattaaacctctttttctttataaattacccagtcttgggtgtgtctttagcagcctgaaaaccaacaaaaacagatgggtcacaaagttggccctgaactttctatcaccaacctaaataaggaaagagcatcaattcttgaggtaaaaataggctgattgttcagaaaaatgcagaaatgtgcacaacaccagagatcaggcgattttctgtgaattcttcctcaaggagatgatgccagaatatgtaattgacagcattctcaaaacatccttccaatgcacatggaggctgtttctcaaaaatatgttctgagtctggtactcaacatctctactactcctgccaaatcttgtctgaactgggtgcagtgagctctcaggtttccttgtttatcactcccgcaactccagtctaccactatccatcctccagtctaccactatgtagctgacatagatttttaaaaatacagaaacaagaacaggttgttcctttgcattaagaaattatggttgtttctggctgggcatagtgactcatgcctgtaatcccaacactttgggaggctgaggcaggtgatcacttgaggtcaggagttcgaaaccagcctggccaacatggtgaaaccctgtatctactaaaaatgcaaaacttagccaggtgtgctggtgggcacttttaatcccagcttctcaggaggctgagacacgataattgcttgaactcaggggggcagaagttgcagtgagctcagatcgtgccactgcacaaccagcctaggcaacagagcaagactctgtgtcagaaaaaaaaaaaa

SEQ ID NO: 243680 - DNA, 359 bp, Homo sapiens
cagatatttgatgcccaaaatgtttggagggcctttctttttcttttttttgagacagagtcttgctctctcacccaggctggaatgtagttgtgtgatcttggctctctgcaacctccatataaacatggcatcttataaaataacaaaatagtatttaaatataggcataagttacaacatggaaagtcagaaaaccatggagagagtttagatgttttgaggtcaggggatcgagaccaacctggcaaacatggcgaaaccctgtctctactaaaaatacatggtcctgaccacatctatgtatttccttacatttctcttgatttgattagaagagtcttttttttttttttttt

SEQ ID NO: 243681 - DNA, 438 bp, Homo sapiens
ccactgcctttggaatctcctatatgtgcccctgaactttctctaggattcctgctgaagatagtgtggcatgtgtcacttgtggactgtcttccgtctttattctgagaggaaatggggcaggagtgtacagcagttaggagcacagactcttgagccagcacaaatggggtcaaatctgagctgagtccaaatattactagctgtgtgaccttgggcaagttgctttacctctctgtgtcccactttccctatctgtaaaacaggaaacataatatagttacccttaagatgaggtcaacaagtgaatcaaataatctatgtaaagcactttgaccagtgcctggtgcctggtcagggttacactagagtttcctacacagaagtcaggaggtgagatgccaagatactcagagggaaaatcaggctgaaaaagta

SEQ ID NO: 243682 - DNA, 217 bp, Homo sapiens
ccactgcctttggaatctcctatatgtgcccctgaactttctctaggattcctgctgaagatagtgtggcatgtgtcacttgtggactgtcttccgtctttattctgagaggaaatggggcaggagtgtacagcagttaggagcacagactcttgagccagcacaaatggggtcaaatctgagctgaggtgcgctcgtgctccacctccccggcgcc

SEQ ID NO: 243683 - DNA, 450 bp, Homo sapiens
tttgtggtttatggtcatgctgaccttagccattaggctgatgccctttgcatttaggtggtttttgatcaaggggaactttacaatggtggtgcttgtgcaagatggccatgcttctgctctgtcaagagagaatcagaaaataagaacctttagtagcctgggtgcagtggtgcacaccagtgcggtggctcatgccaacacgttgggacaccaaggcgagctgattgcttgagcccaggagtttaagaccagcctgggcaacatggcaaaaccctgtctctacaaaaaaatacaaaaattagccaggcaagatggtgtgtgcctgtggtcccagctacccaggaggctgaggtgggaggatcatctgagcctgggtggtcgagggtgcagtgagccatgatcgcaccactgcactcaatggaggtgacagtgaaactttgtctcaaa

SEQ ID NO: 243684 - DNA, 421 bp, Homo sapiens
ttatgtttcatatacaccttatacacatagccttaaggtaattttataaaacattgtaaataattttatgcatgaaacaaagtttgtgtaaagtacttatgtgtggaattttcaacttgtggtgtcatgttggtgctcaaaaagttttgaattttggaacatttcagattttggatctgtggattagggatgctccacctgtactattttacacaacgttgcttgtactatttcaaagcattctgaaagcaaagtcttaatattaataaaaaattttctatgtgacaataaaattaaaatgctgcaggcccaagaaaaaaatattatcatattgaaatatttaatgccccaaatctaatcagatgcaggtttttgaaagtaccatcctattcaaaattatgaaataaagaatttgtttcat

SEQ ID NO: 243685 - DNA, 404 bp, Homo sapiens
acgaagggagtgtgagctgctttagggactggggcccagctcctctccgtacagtgatggacagacagtgtcatagactggagaggaaattctattttctccttagtttaagaaaaaaaaggccgggtgtggtggcttacgcctgtaatctcagcacttttggaggccgaggtgggtggattgcctgaggtcaggatttcaagaccagcctggctaacatagtgaaaccccgtctctactaaaagtacaaacaattagccgggcatggttttgggcacctgtatttccagctactcgggaggctgaggcaggagaatctcttgaactcaggaggcagaggttgcagtgacccgagatcgcaccattgcactccagcctgggcaacagagcgagactccgtctga

SEQ ID NO: 243686 - DNA, 628 bp, Homo sapiens
tctgtttcttgcactctagttataggcacttgctaaatgtttcttgagtggatgaatgaataagtgaatcctggacagattgagatgtatggggtgagtcataatcctggcaaaaccctaattaaacacagtggaaccattgccttatgcacagggcaacctcaggcattctgcgttcatcgtgtctgcagtgttctccaaattctgaagcagagatgtctagatgcttgtttagtgcggagggtcactttctttatattttaaaatcagtaaggtcatacttaacttcgtttgtacatattaatatatccataaatgttggtagttcctttgggtactatgagtgactataatattaactaaactgcatttttagattagaaaattgtgaggggggaccaagcacagtggctcacacctgtaatcccagcactttgggaggccaaggcggatggatcacccgaggtcaggagttcgagaccagcctgatcaacgtggtgaaacccccgtctctactaaacttacagaaattagccgggcatggttgtgcacacctgtaatctcagctactcgggaggctgaagcaggagaatcgcttgaacctgggaggcagaggttgacgtgagcc

SEQ ID NO: 243687 - DNA, 446 bp, Homo sapiens
gctgaattgtgttccccaaaaattcatatgttgaagtcctagccccaatacctcaactctgactgtattggaagacagggcctttagaggtgattaaggaaaatgaggtcatacgggtgaaaccaaatccaacatgactagtgtcttcataagaagaaattgggacacagacatgcacagaagaaagaccatatgaaggcacagggacaagatggccacctacaagccaaaaagggaggcctcagaagaaaccaatcctccccacacgttcatctgagacttccagctccaggactgtgacgataaattcctgctgtttaaaccacacagtctgtggtactttgttatggtcaccctatacacgaatacagccagccaataagattctgttgtagcattataaatgcatcaatcagttctgaaatggttaaagaattatgagcatc

SEQ ID NO: 243688 - DNA, 501 bp, Homo sapiens
ttccattgagccgggacccagccagatctcaaaacaaggagccaggagagacacctcaactatgttctccttcaccccttcagtctgttgccggtgcttgcctttggctgagctctactgaaaaccagaagacaagaaagttcagcttgatgtactggatggtccaaacctggcttctaggctgtggagcaggttggagaaaacgtagggaagattagggtgggagaaggaagctattcagcataaagagagatctccatactcagcatttcactgccttcttacttgaggtccagtttttgcattttcagttgcctacccagcccttcagcttgaatgtcccacatcagattcaagatgtccaaacttcctcaccaagctattaatagctgttttcccagagtcccttgattttatcagtggcatcatagttcttcttacaatcatttggactctggttcattatatctcattatttataaaatctttagttacctaaag

SEQ ID NO: 243689 - DNA, 357 bp, Homo sapiens
atacatatctagacagagatttcctgtcttgcttggtacatggaaatactccaaaggctataatttggaatatgaagattcttgttctgttctttctaccttattaagactcaagatggaatgtcctgtgatatccagaccaacaggagcatgggtattttatttctctgtctgacattttattagacagtggtaacaaatgagctgtggctgcagagtaatgagagtgttttacaggtcaaacacaaaattcagcactatgtatgtggcagcaagcactggacttggaagacctaccgtaacttgtctcgattcttttggttattggttgtatttcagaagttgctcagcataatg

SEQ ID NO: 243690 - DNA, 648 bp, Homo sapiens
gtgagaatttatggtgctttttccgggcctgctcatggaccaatcagcatgcacttcctcccttctgagcccataaaaaccctggattcagccagacttggacagatgtcaatactaccaactgtgggaagaagctacccacttcaggactccttgactcctcaggatgacctgcctacagaaagaagctacccactatgggtcttctctctgctgagagctggatactcgtcaggatgacctgcctgcagaaagagctacccaccatgggtctcctctgaactgttctgttgcccaataaagctcctctcctttttgctcaccctccagctgtctgcatacctcattcttcctggccgcaggacaagaactcgggacccaccgaatggtgggactgaaagaggtgtaacacaaataaggctgaaatgccctgccccgctttccacattgtgggtgacaagaagagaagagctgcagcccttcaggaagcccagacctaggagctccccgagccagagctgtgacaccctgtttggggctctgtgtggttcttggtgtccccaagcttccgggtgccaccgcattctccttgtccagacatgggtgcccgcaatggaagccgcttgcggtacacgtgatctagcctca

SEQ ID NO: 243691 - DNA, 252 bp, Homo sapiens
gcatcacttgagcccagggtttgagactagcctgggcaatgtgtaaaaccccatcaatacaaaaaattacaaaaatacaaaaatcagccaggcatggtggtgtacacttgtagtcccagctactaaggaggctgaggtgggagaatcacttgagcccaggaggtcgaggctgctgtgagcccaggaggtcgaggctgctggatcgcagtgatgtgatcactcactctgggtgaaagagtgagagactgtctc

SEQ ID NO: 243692 - DNA, 407 bp, Homo sapiens
taaaagctgtaaatggttagattcacattgaaaggaatccaggatagtcttattttgcacttttaaaaatatgtatttaatctgccacgatatctgctatctgtagtgttattaaaatgcaggttttcatcattctcagcaaagtaacacaagacgagaaaaccaaacatggcatgttctcactcgtaagtgagagttgaacaatgagaacacatggacacaggaaggggaacatcacacaccggggcctgtgggggggtgggggctggaggagggatagcattaggagaaatacctaatgtaagtgacgagttgatgggtgtagcaaactaacatggcacatgtatacctatgtaacaaacctgcacattgtgcacatgtatcccagaacttaaaaagtataattt

SEQ ID NO: 243693 - DNA, 417 bp, Homo sapiens
aggttttgcacaggctatacatcctgtctggaagtccctggctttacgggccatgtgaagatgttataactctttgcagtttccaagcaggggagtgtgtggtcagatgcggctgttagaaataccagttccaggctgggtgcggtggctcacgcctggaatcccagcgcttcgggaggctgaggcgggccgatcacgaggtcaggagattgagaccatcctggccaacatggtgaaacaccgtctctactaaaaatacaaaaaatagccaggcgtggtggcacatgtctgtaatcccagctactcgggaggctgaggtaggagaatcacttgaacccaggaggcggaggttgcagtgatccgagatcttgccattgcactccagcctgggcgacaagagcgaaactccgtctcaga

SEQ ID NO: 243694 - DNA, 488 bp, Homo sapiens
gtggggcgctctctcccggtgtgggtactgctgtctgtggtgtggctgtgggacccgtgagcaagcagcgacgccagcggcggagaaccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccc

SEQ ID NO: 243695 - DNA, 2921 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatcagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243696 - DNA, 2694 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatcagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243697 - DNA, 2594 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243698 - DNA, 2637 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggactgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatcagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243699 - DNA, 2048 bp, Homo sapiens
gtggggcgctctctcccggtgtgggtactgctgtctgtggtgtggctgtgggacccgtgagcaagcagcgacgccagcggcggagaaccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatcagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243700 - DNA, 3219 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatcagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatctttttttttttggagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatccttggtgtgtgtgtctctctgtacacctagataggatagcaacaccttccctttctcaccttgctactcttaagacctcaggaaacttctgagtatatacagaaaacagttctcactctgcctcctcctggagcctgaggtctgagcccggctcttcacttcacagcccaatacgccctaaagggcctcctcttctccgtgggtttgggagtaattgcacctggaggtctgttccacccttctacggccttggcggtgggttgctaggagttctgccttcttagtggcccccaggtcttag

SEQ ID NO: 243701 - DNA, 2069 bp, Homo sapiens
cagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacgccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatcctt

SEQ ID NO: 243702 - DNA, 386 bp, Homo sapiens
cagtctgatatggttttgatatttgtcccttccagatctcatgttgaagtgtaatctccattgctggaggtgaggccttgtgggaggtattggatgatgggggcagatctttcatgaatggtttagcaccatccccttggcaatgagtgagttcttattctgagttcatgggagatatggttgtttagaagactgtggcacctttccctcaaaccctgctctcgtttactctctcactgtatgatgtgctggctcgcccttgtccttccactgtgatagtaagcttcctgaggccctcaccagcagcagatgctggcactatgctttgtgtacagcctgaagaactgtaagccaaaataaaacctcttttgtttataaattaccca

SEQ ID NO: 243703 - DNA, 463 bp, Homo sapiens
acattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtgg

SEQ ID NO: 243704 - DNA, 716 bp, Homo sapiens
atttttgccaccaaacacttatgttcacaccatttttaaagcagttttaaatccttgggcaattggtcaaatgcttcttctggctattttcttgttctgaaagtcagaagtttgaagagggttttagggattcgaattaaggtgtcagcagacctgtgcttctctggaaggctctacgggagagatttaccttctccagcttccagtggctggctgcccacacaccttggctcgtggccacctcctcacgtcagtccagcctctgccaccatcgtcaactctcccactatgactgagaccttctgcctgtctcagcacatgagtttcaggctctctaccgttcatgcccatgacaccaggagcagcaccctggagcagacacagccagaccacaaacccagctcaaggttaatcactgctgcccgtcaatgtgattatctccctctgcatggcagtgccattttcccactgtgggaccagagtatgtgctgtcatacacaacagtaaacactggatgctgttaattcatggctgcctggcgtgctcgcacacacacacacacacacacacacacacacacacacagacacacacacaggcatcaatgcctttctttgtaaaatacaatttaaatttattccttattctaatacaaaaaagttacatataatcaaagccacacctacttcaaaaacacagccagccaatggaggtat

SEQ ID NO: 243705 - DNA, 517 bp, Homo sapiens
cttgaacctgggaagtcgaggctgaagtgagccgagctgtgccatgattgtaccactgcaatccagcctgggtgacaaagcaaaaccctgttcaaaaaaaaaaaaaagtaagaatgttgaagtatatttattttcatggaaagttactcacaacatatggctatgcagaagaggatgatatatctgtatgatctcattcttttaggaaatatgtaacacacaaaagaatgtcaacaagactatgtattgacagtttttaaagtggttgtctgtaagtgatggaattgctggtgaattttattagtttcctttgcccatttgtattttctcattttctacagtaaatatttatggtttgtgaaattttaaattttttaccaaaaaaaaaaaaaaaaagaccgagcatgatggctcccagctgtaattccagcactttgggaggccaaggcaggaggattgcttgagcccaggagtttgagaccagcctagacaacatagggagaccccatctctataa

SEQ ID NO: 243706 - DNA, 780 bp, Homo sapiens
gttcccattgtccaagccagggacagtttgagcataaaaataagaatgatagtaatggatgataactcattgaataaattaagaatctgtataggtccagactgatacatatgaagaaataaataaatgaataaataatagaagagcagagaaggctctttgtcatagtattctaactataaatatacaaatagtgataaaattaaattattagtgggctttaaaagtagtaggtggaaagtttgataaaaagaagtatatttacatgtctctgaatatcttaccaaattgcttattgatatcagaggaaaatagtaattcaataatgagaaaacttgtaacacacctctttaggccaagtcattaaacctaacaccactaatattgggacagctcacgtcatgtgcatcctaataagatgatctgaaaaagacaaacatcgcttcagtgataatgcttccaaaaacgtataacccgaacgtaatcatgaggagacatcagacaaatcaatagacattttacagcttggttggtattttttaaaaagtcaaggtcaagaaacactaatcatgctccttagattagatctgggcctggggggaaaataactacaaaggacgtgattgggacaattgacaaaatttattgggactgtggatcagactgtgtaactattaaattttccgatttttgagattgtcctagattttggaaagtgcaatgaaagggtaaggggacaccgtgtcttcaatttactcttaaatggtacagaaaaaaaaa

SEQ ID NO: 243707 - DNA, 328 bp, Homo sapiens
gtttacacatttttatctaattttttaattatactttaagttctgagatacacatgtatacatatgtaactaacctgcacattgtgcacatgtaccctaaaatttaagtataataataatttaaaaaaagagcagagagacattgaataatggggaaaaggagccccaaagcctgattaatgatgatgtatgtgatgtttacccaaaataaaaagtccaaggtgaacttaccacaaatgaataataaacacgaagacaatcaccttgcctacaaaacaataatcctgagtacataaataataaaacagcttttggatatttcaactaa

SEQ ID NO: 243708 - DNA, 444 bp, Homo sapiens
cgcgctgccagtgtccgggaactgggtttgcgaatcctgggagccgcgttcctgagtcttctccgctctctgccctcaaaacctcatttgtaggactgacctccggctccaccctccccacgggcgagttaaaactgttcccccgccgtgggaaactgccgaatgaccgtggaataaaggatttcccatcaggctttgtagccatttccaactccaatgacatgaagaagtgttcaccatctttaaggagagaaggaggatgaatgcagtcgcttgtctaaagctaaccaaacggaccaaagcctccgttcatgggtgtcccgcttggtgcccttaaccctgatgctcttaacctgggcatgataaggaaaattgcagtttttccattttcgattttcagaagttcaaactaaaattttgtgttactttgttacgtttgagcca

SEQ ID NO: 243709 - DNA, 426 bp, Homo sapiens
ctagggtggggtcttgacaaagtagctgattcaggaacatctgtggatgtgcacgtggacattgtcaatcatctctgtctacctatttgccttcttcctcagcctgttctctgtcttctatctaaaagtgcactatcaattttcagagagatgctagaacccttgttcattttcttatatggcaacttttctctgtatagtttcatgaaacctccatacatgaagtttgcagtgagaggcaaaaaactgagtcgtgatcatggtgtttttagccccagttagagggttaggtgagttgaagttgtcagcccagggaactttacaagtgaggacagcttttaaacatcactgccgacattatcatcatcagcaacaactaataacaacttctttaaatttaaaaaaacctttgccttcttgcctagg

SEQ ID NO: 243710 - DNA, 570 bp, Homo sapiens
  misc_feature (11)..(11): n is a, c, g, or t
  misc_feature (51)..(52): n is a, c, g, or t
  misc_feature (71)..(71): n is a, c, g, or t
  misc_feature (79)..(79): n is a, c, g, or t
  misc_feature (91)..(91): n is a, c, g, or t
  misc_feature (104)..(104): n is a, c, g, or t
  misc_feature (118)..(118): n is a, c, g, or t
tttggggcccnccctttgggggggggttttggaatttaattgcccggcctnnctttttttaggggaagggnttcctccnaggggaaacccntttgccccccttnttctttaagggggnataaaatttgaagaatgtgggtaagtcatgtgcctacctgaaggaagagtaatttagacaaaagaaccagcaaatgcaaagaccctgaggtagaaatgtgtttggtgggttcaaggagcctggagcaaagtgacaggggaagaatggcaaggggcgagagagagagagagaggagggtagggtcgcatcacaggacctcagaggtccttatggggatttgggcttttaccctgggtgatttgggacccactggaaggttctgagcagaggagtgacatgatcagaattacatgtgaaaagaatctctactgtgttgagaatagcttaaggtagacacgtgtggaaacagatgtgaaggaagcagaggaggagacatgagagatggtggtagtttgttccaaagtgttgctgatgggaacagagagaagtggtcagaccctggatacatattg

SEQ ID NO: 243711 - DNA, 807 bp, Homo sapiens
ttctgagatggaattttgcttgtcgcccaggctggagtgcaatggaccatcttggctcagtgcaacctccgcctcctgggttcaagcaattctcctacctaagcctcctgagtagctgggaacaggaggatcgattgagccgaaggtcgaggctgcagtgagccatgattgcactgctgtgctccagcatgggcgattctgtcaaaaaaaaaaaaaaaaagaaagaaagaaaaaaagaaatacatgaagtggccgtaagtgctatgaagaaaatgaggcagcataggaggatagaataatgacggctgctatttagggagggtactcagggaagccttgccccctctcttaagagataaaatttgaagaatgtgggtaagtcatgtgcctacctgaaggaagagtaatttagacaaaagaaccagcaaatgcaaagaccctgaggtagaaatgtgtttggtgggttcaaggagcctggagcaaagtgacaggggaagaatggcaaggggcgagagagagagagagaggagggtagggtcgcatcacaggacctcagaggtccttatggggatttgggcttttaccctgggtgatttgggacccactggaaggttctgagcagaggagtgacatgatcagaattacatgtgaaaagaatctctactgtgttgagaatagcttaaggtagacacgtgtggaaacagatgtgaaggaagcagaggaggagacatgagagatggtggtagtttgttccaaagtgttgctgatgggaacagagagaagtggtcagaccctggatacatattg

SEQ ID NO: 243712 - DNA, 504 bp, Homo sapiens
acagaaaaccaaacactgcatgtcctcactcgtaagtgggagttgaacaatgagaacacatggacccagggaggggaacatcacacaccggggcctgtcgaggagggatagcattaggtcaaataccgaatgcatgtggggcttaaaacccagatgacaggttgatgggtgcagcaaaccaccatggcacatgtatacctatgtaacaaacccgcatgctctgcacatgtatcccagaactgacattaaaaaagagaaaagatatggccacaataatccagttgtcttttccctctgaagcaaaagtcccagagagagagttagcctgtgtgcccacttcaggaatcccagcatgtccagctagagtccccatggggtctagcttcatgtcgtcttgggagaggggaccccagcactgggaagatcatcaaaagacactggctgattgctgttgggaatagaagagccattaaagaaaatgaactgagaatgtgtgcttaatta

SEQ ID NO: 243713 - DNA, 470 bp, Homo sapiens
ccgctagtaccatacaggtaatatacatatgatgaaaggaggaaaaagaaaaacagacagaggaaggaaagaaagaagaaggggaggaagaacacaggaaggaaaaaagcagaccctgtcattcttttcaaaagacttaaccatagccatttacctaaaaagaatattaattacttctattgtataaataaaaaaaactaaaagacaactgaaggtggcctgaattttttcattgtgtaaaaattaatgggactgtatcattagatgacccacaggaagaaggtatcatacacctattcacagcgagtaagatgtcagaacatcttacttacagatggctattgtgttttctatcaatagccaatttctggaatttaaatttaatacattttaagaacgatatcctgagacttacattatcaatgatcacactttccttatcttgaactaggataataaaaatacgtaaa

SEQ ID NO: 243714 - DNA, 439 bp, Homo sapiens
catttaatggacaaggtgggaaagtgcccaaagtatcaggaaggtacatacttatatgtagattcatgagcattcttttaataatctttcctaaacagttactgtgtgcaaaccactgttgtgagagcactattgagagattttggattaaatgtccatcataagagtgcactagagacaaagcagactattatagatgatgaaactgtcccagaggccaaacacagcagtgataggaaacttcaactgtgtttttatttacctggaccacatttgtaaatgaccatggcaggccctcaataaatgctgaccacttggaggagccctaagcgttaggatctgctgcgagggctgcctggaacggaggtgagaggatacaagtggcccggggcaagcatagtgaatcactggctaatctggccttcgaggtagtgaaagg

SEQ ID NO: 243715 - DNA, 450 bp, Homo sapiens
gccaaaaggaaccacctgttttctggggctgtggcctgcagccttaggaacagtgctttgctctgggggaagctaaaagttgcaatggggctaagctaagagcagcaactccatggctcagcctcctgagccttgtgctctatttgatgagataatccacagctgcctggtgcaaagtcaagaaccggagaagagaaacagagattgctgaccttctccgtgggccaccagagtccagcctgcatgtgcaggctctccctccagcacacaggttgctcctgcagggctcagccccagcaacgctgagagggtgaaactggccacctacctctccctctgattcccaccctggatgccctgtgtcccaggacccctgtaacattctcccaccctaagtaatcatctctggaccttgccacctgatcatgccattaaattcccctaatgcca

SEQ ID NO: 243716 - DNA, 466 bp, Homo sapiens
ttggactcccagagctgctctcctgttttttctccgcagtactcagcctggagagcattcttagtctgtttggagaatattaactcctccctgtcctcattactttttttttgaccctagcttgactcctttaaattgagcttgcaaagttttaaaatttaaaatacaggccctgtgttggctgtcacagtatctggattgtagcaaagtcagttgcgggaatgcccattgaaagatttcagagtgtattatgtagagtcagtcatattgaactatacagttgtacaattagtcacccagaaattccaatactatgtttttctcagtttgcaagtagaagttgattatgagtatctacttttgtacttccaagtttgggcatttaggaatgtagttaactagtgtttctaagaagaaatttattttcaagtaccatatagcttgatttttaaaaaagtgtgtatat

SEQ ID NO: 243717 - DNA, 655 bp, Homo sapiens
  misc_feature (416)..(416): n is a, c, g, or t
  misc_feature (427)..(427): n is a, c, g, or t
  misc_feature (436)..(437): n is a, c, g, or t
  misc_feature (442)..(442): n is a, c, g, or t
  misc_feature (445)..(445): n is a, c, g, or t
  misc_feature (471)..(471): n is a, c, g, or t
  misc_feature (478)..(478): n is a, c, g, or t
  misc_feature (490)..(490): n is a, c, g, or t
tgagacagagtctcactctgtcacctaggctggagtgcagtggtaccatcacagctcactatgacctggacctcctgggctcaaatgctcccaccttggcctcccaaagtgctgggattacaggtgtgagccaccatgactggcccagaatcacttttgatttgaggtctttatataataatgacggttaatcttttgttatactgtttttttgtttgtggatcttttggatcttgggaatggggttttgggttttttggggttttttggtatagaaaagttcagacattctttctcatcaaatttcttttctttgtaacttcaacaagaaagtctcctccatcaggagttttgttaaatgttctcttttcttgtgactttcaaaaatattaaactttctaaattcttcaaaaaanaaaaaaaaaanaaaaaaaannaaaanaanaaaaaaaaaaaaaaaaaaaaaaaaanaaaaaanaaaaaaaaaaanaaaaaattgggcaggtttttgctggggccccgaatttgagccccttggccaattcgccctaaaggagggggtataaaaatacaggggcgggttttaacacgggggaggggaaaacccgggggtaccccattaaaccctggaaaaacacccctttgcgaggggggg

SEQ ID NO: 243718 - DNA, 259 bp, Homo sapiens
gatgtaggtgggagataaggagattgtcacaatgaaaaaaggaattcgttgaataggagagaatttttaaaataatttattttgtctaactccaaaataaatatacgctgaatgtagaaaatgcagataactcagagaagcacaaagaaaaaaggtctaaaatcctactacctaaaattaccattgttaatatattatcgtatgccctttcaggaagcaaatattgtttattataaaaataaataaaatttattacaaa

SEQ ID NO: 243719 - DNA, 447 bp, Homo sapiens
cgcccagcacacacgctccttcactcccaggtcagcatcctggggcctccgtgtccttgtctggaccatgggtgtaaagaagccacatttcatcacaacgaagccagcaccgatgtcagctgcacaatgttttgtcctgttatggtcttaatgttggtgtccccaacatatgttgaaatcccaattcctaagttgatgggtttaggagatggcgcctttgtgggggtgattcagtcacgagggtggaggcttcatgagtgggattagtgccgtcataacagaggctctcacgagacccccgtccctttcaccgcgtgaggacacagtgggaagacggccatccataagccggaaaacgagcccttcccggacacccaatctgccttgatcttggacttcccatcctccaaaactgcgacaaataaatttctactgttcataagccac

SEQ ID NO: 243720 - DNA, 123 bp, Homo sapiens
tgctcaatcggttattttaagctcaaagtccctttgtcaaataactgaatctttgccagtaagacaggtgataatatctcaaggtgattttaatttatattttcatattaaaatacttttttt

SEQ ID NO: 243721 - DNA, 327 bp, Homo sapiens
gcactccagcctggatgccagagtgaaactctgtctccaaaaaaaaaaaaaaaaaaaaaaaagccaacagcaaaaaattacagactcaatgttcccatttatataacaactgtgaaacaacataattatagagatgaagaatagctgagtggctgacagagtgcgagatggggtagcgtggctatacaggagcagcacaagggagtcctgtgatggtgtggttaactagcttgattgtggtggatttacacaaaaccaggcacacacaaaggagtgcatgtataactggtgaaattccgataaactctagggttataccaatgtcag

SEQ ID NO: 243722 - DNA, 371 bp, Homo sapiens
atccagtttctgtgtggcttagctgggcccccagctcaggccctctgaagggctgtatttagggtgatagaaagaggtgtggcttagagattggaatacctgggttcattctttcaatacacacttgtaagccctcattgcataccaggcactggtctagaccctgcaacagaaaacagtctcccgaggcttgttgggcttctatgctagttgtaagcataccccacactggggatgatggcgcccttcctccctccagggccatgatggtgactgactatatgataataatactagaatgatgatgatgatgacagaagcaacaattccctttcatttataaagtggaatataattaagagtctttaaaa

SEQ ID NO: 243723 - DNA, 456 bp, Homo sapiens
acctatcagactaattatttctaaatcctaccacctattcagggaactgccctggaaagccagcttgtctccactgataaatgacaaagacaattgcttcagaattgattttcttcaatgccttgatggacactgaattttggcatttggtctggatgtcaaagtttgttatattttcctcagaacactgaatggtcatgaatgaagaactgagttaaaattacaaattagtaaattctataatccggcatacacaaaaaaagcacaaggggaatagatgaaacaagtctggcaaattgtggagaatgttgaagttggcatgagaacttatgagaactcatgatatataccagatatatttattatataccaccatatgatggatatatgtggattcattgtaccattctctttacttctgggtatgttcaaattttaccataataaaaagttaaa

SEQ ID NO: 243724 - DNA, 579 bp, Homo sapiens
tggccaggtgtttaccagttttactgattcttttcaaagataatcaggttttggtttcactaattttctctaaacagtttttttgttttttatctcattgatttctcttctttttatttctttccttctgtttgctttggatttaatatactcttctcctattttctttaagtgaacgtttgaattactgacttaagaactttcttcttttccaatacaagtatttgatgctataaatttccctgtaagtccaactttggttgcaactgaaatattataattttcattgttattcagttcaaatgttctctaattttctttcttctttgacatgactttttcagaagtatgctgtttaatttccaaatatttggggatattccagatacctttctgttgttgatgtctaatttaattctattgtggtcccaagaatatactttgtatgatttcaactctttaaaaatttttaaggtttgctttatgacctacgataaggtttatcttggggaatgtttcacgtgcacttgagaagaacgtccattctgctgtcattcgatagaatataatataaatgac

SEQ ID NO: 243725 - DNA, 656 bp, Homo sapiens
ataattaattaataagaagcatgtcccatatttgaacccaggcagtctgctcttgagctcaggtgcaaaagaacaatactctgctgtttcccttgttgaccaggacagcgtgcacggggcaggcgcgtggtgtgtcttcacaaacactagctatcactgctgtgagctgagcacttccactgaattgactcattcgctcattggaaatacatttattattgagagcctactgtgggccaggcagttttccagatgctagagataaaatatgagtaagacagaattcagccagccccgaatgagagaaacaggaagaaagtgcagtagattctcattattcacaagttctaaatttgcaaattcttccctgtaatcccagcactttgagaggctgaggcaggaggatcgcttgaggctaggagtttcagatcagcctgtgcaacagagcaaggccctgtttgcttaaaaattatacacattgaataattcttaaaaaaaatttgtttgtggccaggcatggtggctcatgcatataatcccagtactttgggaagccgaggtgggtggatacctgaggtcaagagttcgagaccagcctggccaacatggcaaaaccccgtctctactaaaaattcaaaaaattagctgggcgtggt

SEQ ID NO: 243726 - DNA, 482 bp, Homo sapiens
gttgaaccaactggtgaatagagaaatacagattaagtatccctacaatggaatattattcagcaatagaaagaaatgaagtatggacccatgcatggaaggatgcaggggtgtttcctacagcatagaaggaccttgaaaacacagggctaagtgagaggagccggacaggaaggatcatgtattgtgtggtctgctcatgtatgatctgctcacatattgtatgatctgcttacatgaaatgcccaaggtaggcaaatccagagtcaggaaataggtcggtggttgccagggacagggacttttgggggaaaatagagagtgactgttaacagggacctgctttcttctagggtgatgaaaatggtctaacattgattgtagtgagggttgtgcagctctgtgaatatgctaaagaaccatcgaattggacactttaaatgggtgcaaattatattccaataaactatctgtagaaactt

SEQ ID NO: 243727 - DNA, 183 bp, Homo sapiens
aaagtcttattatataaaaacaaattctaaaaatatttgaacttttatgatccatttatcacatctggcccactaatttcgaatgattaagtctatgagggaagctcatagacttttagcccgaagaaatatttccattgtattagaattttgacactgtattattactatttttttttagga

SEQ ID NO: 243728 - DNA, 348 bp, Homo sapiens
tctgtctgtcacttccctagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgacctgtcatcgggggaccaccattatgacacacggaaacttggctgcatgtatctgataaaacaaaaactgtcctttaaa

SEQ ID NO: 243729 - DNA, 460 bp, Homo sapiens
taagaattctgataaatcacaaacattcaacgtcttaaatattctaacttttcaaaacctaacttctcaatcaatgcacacagtgttcacttcaggaatgcaggaataggtaatcgtcacaggactgcaaaaaccataggaattttaaatattaaaataaaatgcaacttttaacttaataaaacatgtctctgccactctttaaagccctctgttaggctttataatattgaaatgatgacactaagtaatcaccagtagacctgtgatttaaattgattttccacacgtggacaggactggtactgatttctctcctattttgcgatggatagtacattttaatagtaaaagtaaatgtcttttttaaatgtcacacattttgctttaaaaaatcatatacaggagaaagacatgaataattttggttttggtaaatattcatttgaaaaaagaaaaa

SEQ ID NO: 243730 - DNA, 351 bp, Homo sapiens
ccttttcccaaaatattagtcaactggcccaaccatagttattaaaaagttcatgaccccttgaccactgatttaataccccagtcttacaatcgacctttatacatgtcacaggctccctgtcccactcattaaccgcctcagcgctcctgagtaagcgtcccctccggcagccgcgccccctccggcagccacgtcctgagctccggtgtcccccactgtgcacagtccccaccactactccagagggtctccacctccaccctcacttcagaaccagcagttacacaaaagtcctgctaggatcttgatgggagctgttctgaatttagaggcaaacatggagaaaat

SEQ ID NO: 243731 - DNA, 361 bp, Homo sapiens
attggttaatatttcagtttattgaagatacattattttgtatggagtgtttaagttgttgaggtttaaccattacaaacagttatgacaaaaatagatccaggggtaaacagcctccacagtcatgcttttaataagcacagccataactaggaaattggatttccaggagctgggagacaggaggggggaaagttgcagagacatgggaaggaatgggaaggaccctcagttcttctctgcacccataacacttatcaggatttcctcttaaaatagaggaacatttcatcccttctagtaatcataaacatatttgcccctttctagagaggaatcttttctctggtgtctttccagg

SEQ ID NO: 243732 - DNA, 590 bp, Homo sapiens
  misc_feature (7)..(7): n is a, c, g, or t
ttaagtnaaagctggtttattatcattcacattatttcatagaaaaaggaatatagcaaacggtcagaatgcagtacatttgaaaattctatctcaaaaacagaactatcctaagtgttgggtaaagtatagaaatgggtagaggaattaaagtgcaagaggttattggaaaagaggtggccaagaaattgataggccagtgtaaaggttttttttacacattcacttaattctgtcccttcaatatgagttctacatattaactctggttggactctcagctttaaaaattctcactaagcaatgaaaggatttttccttctgaacaacactgactgatcacactgtatcttttgtatttttcacgtctttgtcattttgcaggtgttttcactgttactggcactaaactttcctttaatgaaggttccagctactagaaggccaattcagtgcaagattacagtgataacaaaaattaatcgctatcaccaatgacactttattccaaagacaatctattatatttcatagaaaccgtaatatttttacattaaaaacaactttcatatatgtgcaatggaggacag

SEQ ID NO: 243733 - DNA, 412 bp, Homo sapiens
agctgtgtgacctctttgggcttcagttttctcatctgtaaaatgagataataacagtgcatacctcccctcctatctcatagaggtgctgtgagaatgaactgagttaatacctgtaaagcacttagaacagtacctggatcaaagtacatactcaatataggttagcttggatcattactactgcagtccactgggaggtgggagtagagaaagccatctctggagagatcaaggagggtttcccagaggaggtgatgtttcagcttagacattaagacagcgtagaagaaggccaggtgtggtggctcatgtctgtaatctcaacactttgggagactgaggcaggaggatcacttgaggccaggagtttgagacagcctgggcaacacagagagaccccatctctaaa

SEQ ID NO: 243734 - DNA, 358 bp, Homo sapiens
gtaattattattcccattttatagatgaggaaactgaggctcagaggtcacatagctaataagtgattgtccccactgtttctcacatatcataatgtcaccctcaatttccaaatgaggaaatcagacaccaagaaagaagtagagcccagatgtcctggtcccagccttggctcttattccatcctgttttcctgtttgggtgaaggtgcaaactcactctctgcagaatttgcccttaacagaaaatggcctgaggtttgtagctagcactcagataacctaatgtggatggaagcatttcaaatgtttggccaaaataaagttggtggagtgtgcagctggagaacagacaaca

SEQ ID NO: 243735 - DNA, 718 bp, Homo sapiens
tgaagatggacttattgatttctatattcttcctctagcatcatgaaatttgacctcttcagccgtgcatggttaacactccatctatctgagtaagtcctgccttgaagaatcgtgagtgcaaaccagtttgagagagaagaggaaaaataaatgagtcgtgctctgtcttccaggctggaatgcagtggtatgatcacaactcacaacttactgcatcctctacctcctgagctcaaggggaatccttccacttcagcctccaaggtggctgggaccatagatacactccactactcaaagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaa

SEQ ID NO: 243736 - DNA, 873 bp, Homo sapiens
tcagagagaatatggccctgctgaaacattgatttcagacttaaagcctccaaaacaagactgtcaatgaaggaaccaagagcccatggcaaatgggtgggcacatgacccaagccagggaaatcagaatattattactttacatgtttctggctgagctatgggaaacgattctctctatctactaaggaagcatcatgaaatttgacctcttcagccgtgcatggttaacactccatctatctgagtaagtcctgccttgaagaatcgtgagtgcaaaccagtttgagagagaagaggaaaaataaatgagtcgtgctctgtcttccaggctggaatgcagtggtatgatcacaactcacaacttactgcatcctctacctcctgagctcaaggggaatccttccacttcagcctccaaggtggctgggaccatagatacactccactactcaaagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaa

SEQ ID NO: 243737 - DNA, 655 bp, Homo sapiens
ggcacacagctgggccggcacactgcactcacacccagtcgaatgcctttgcactgtgtccacattgcaccaccacacatgacagccctaaatgtgaactgaaggaacaaggactgacccctctgaccaccactacccataaccagtactgtctctgcgtctgagtcctggcctggtttacctgctgggtgacccctggcaagttactttgcctctctgggccttagttcccgcacgtgtaaaatgaggttgggctcaatgacctggccagctctgacatcctgtcattttcttgccaaggtctcagcctatcagttgtgacacaagtctcatcagtttcagttttcttgtccatagaatgaccacagatcggccagatgcggtggctcacgcctgtaatcccagcactttgggaggccgaggctggcggatcacctgaggtcaggatttcgagaccagcctgaccaacatggagaaatcccgtctctactgaaagtacaaaattagctgggcgtggtggcacatgcctgtcatcccagctacttgggaggccgaggcaggagaatcgcttgaacccaggaggcggaggttgcagtgagccgagattgcgccattgcactccagcctgggcaacaagagggaaactccgtctcca

SEQ ID NO: 243738 - DNA, 198 bp, Homo sapiens
tccacccacagagctaatcacctccactcctgccccggggcacctatgagatggatggcatcacctaaatgatcacaaacatctccaaaggccacgctgccagtgtagacacactcattccatgggtgttagtgataccaaatctcccccagttcttagctcaggaggccctgcttaataaacatgtgtgtcctctga

SEQ ID NO: 243739 - DNA, 670 bp, Homo sapiens
tagattgtggatattagtcttttgtgggatgtgtagtttgtgaagattttctctaactctgtgagttatctgtttactttgctgattatctctttcgctgttcagaagctgtttagtgtaattgagttccatctatttaactttgttttggttgcctttgcttttgggttcttggtcatgaagtctttgcctaaacaaatgtctagaacagtttttatgatgctatcttctacaatttttatacttccaggtcttagatttaattatttgattcatcttgagttgatctttgtataaggtgagagatgagtatccaatttcattcttctacatgtggcttgccaattatcccagcaccatttgttgaataggttttcctttccccattttatgtttttgtttgctttgtcaaagactagttggctataagtatttagttttatttctgaattctctattctgtttcattggtctacatgcctgtttttataccagtaccatgctgttttgttaactatagccttgtagtatagtttgaagtcaggtaatgtgacacttccagatgtgtgttttttttgttgttgttgtttgtttttttgcttagtcttacttgggctatgtggacatcaaagctgagaatcaaataaaaacctcaacccctattaaagca

SEQ ID NO: 243740 - DNA, 373 bp, Homo sapiens
tagagcatctgattcaacccttccatttgactcaagaagaaaccaggaccttgaaagtttcagagatttggccaccaggactccagaacttatggactaaagtgttctcatatgtgtccagggctccttctgccctaccccattgctatagtctttcccacttatcagcaattttactttctgtggttttagttactcatcgtcaaccatgatctgaaaatattaaatgggaaattccagaaatgaacaattcgtaagttttaaatttcactccgttctgatattgtgatgaaatcttgctccgtctactctgtcctgcctgggtcgtggatcattcctttatctggtgtctctcctgaagatgcttcccacc

SEQ ID NO: 243741 - DNA, 426 bp, Homo sapiens
gttgctctatgaggaatccaggaaaagcatgacttaaaactctttaatattatttttttccacttataattgtaacacaagctggcacaattcttaggcttgtggggttggggaattggataggggtggggtaataatgaaaggttgacttgaggattctggtttataaggctgagggctgagcgcagtggatcatgcctgtaatcccagagctttgagaggccagggcaggaggattgcttgaggccaggagtttaagaacagcctgggcaacattgcaagacttaatctctataaaaaatgcatgcctataatcctagctacctgggaggctgaggtgggaggattgcttgagcccaggagtttgaggctgcagtgagccatgattgcaccatggagactccatctgttaaaaaagaaaaaaaa

SEQ ID NO: 243742 - DNA, 411 bp, Homo sapiens
ttttgtttgcttatattcctaggctaaggcccttcagaggttccaactgaaagccatgggaaatagttctcaaaatcagcatgcatctgattcacctgaaggacttattaaatcacagattctggggctgggtgcggtggctctcagctttaatcccagcactttgggaggctgaggtgtggattgcttgagtccaggagttggatggagacaagcctgaggaacgtggcaaaaccctgcctttgcaaagaaattaaccaggcttggtggcatgcacctatagccccagctactcaagaggctgaaatgggaggatcacttgaacccaggaggtggtggttgcaatgaactgagatcacgccattgcactccagtgtgggcaacaaagcgagaccctgtctcaaaaaaaaa

SEQ ID NO: 243743 - DNA, 1060 bp, Homo sapiens
tcatcaaaatagatattgtataattttcactgtaatttcctctttaactaatgagtaatacagtaattttcagcttccaaaagaaaggtatctggccaaaatacagtagcagaaagcagctataccctttcacctaaaagaaaagctttaaaaatgaacaaaacatataacacttagtctttagacatgaaatatcggttagttctgagacaggagtgtgaccctgtctcagaaaaaacaaataaatacaagaatcactgtagtgtgctacagtgattccttaaaaaagaaaaataaaatcctacagagttttacaattgtcccggcttatattctagagacagtttccaggcctcagtgcagggcaagggaacccagatggagcctgatggtcaccctaagttgagatgatgaagctaagaatacaggaaaatgaagaaagctagaattcgtaggacagagtaccaaaacagagacaactatacagacaggaaggggaggggggtgtcccatcttcatctcaaaatttcagctcaataccaatccccatatccttgtgaggaaacacacaaggcctagagcagagtcaccagaaaggaagagagagaacaattaccaaagatttctaagggttgggaatagttcatgctctcatcggccagactggaaaacttcataatttaagagacaccaggtagaatactcagaagaatactgtcttagtattggggaaaattagctgtaggctaccagctgctctgttcccacctaactgagcttcgaaataatacctgcaaggccaggcgctgtggttcatgcctgtaatcctagcactttgggaggcccaggcaagtggagcgcttgagctgaggagtttgagaccagcctgggtgacacggcgaaacccatctctacaagaaaatacaaaaaaaaagccaggcatggtggcccgtgcctgtagtctcagctgcttggggagcttaggtgggcatttcgcttgagcaggagaggttgaggctacagtgagccaagatggcaatactgcactccggcctggatg

SEQ ID NO: 243744 - DNA, 435 bp, Homo sapiens
tagataatttggtttattctttctggattctttaaaaattatatggctatttaaaaattcaagctttaaaaaacgtattgcaatttttaagaataatttcttcaaagctctatttttttatatatgtttgaaattgagttaaactcaaatttaagtgtgctttcttacaatgcctctgaaaccctagattaattatatccctggaattcagtcctaggcacctccatgttctctagctattcctccacattacctcccctatcctcatctcatcctttaaggtagaatggctttcttttctggctttcttaaaagaggtaactcagctggctttctgtcatggaaatcaagcttgatagtgcatttttgttgtttaaatgtgtcatcagaatccgtctggcagtgagcacactttaaatctaaaaatgatcactt

SEQ ID NO: 243745 - DNA, 566 bp, Homo sapiens
cagcctgctgcagtgtgggtgggtggggagattcagctctttcactgtgaccctgctcccattccacactaggctacaaggacaggaaagagtttcagcagaaaggagtgagcagccacttactccttcaatgaataagctttcctaagcaaggaccagagaaatggtctccacacagaacctgcaatgcccactgggcactactgggtcctctctcccactacccacccccaggtactaaagcaccctggagaacttaggtataggtggtgggaagtcactgaatgcaagggagagagtgacttgatcaggtttgtattcaaaaacacaacgttaccggcaatgtggggaatgggtaggggaggggtggtccagagaatgggaagccagttaggagaccaccccaggtgagggatggtgaagacttgggcaaaggcagcagcaataaaacagcttctataggggcctcattacccttgacctgtatcagaggcaagacagtcactaccaagctgcctctaattcttcagagagcagagacattaaagtattgtaatgagtaaaaa

SEQ ID NO: 243746 - DNA, 336 bp, Homo sapiens
gaccccaaggtttttagaggaactgaaagacagcaattagttcatttgagtgaggaacagaaaggattcttagaggtagggctatattaaactcgaatgggtctgaacactcttactctgcagtccctattctacgaagtcactatcttatttaaatgcactcaaattccacattaaatatcacctttttgatataaaatttttgaaaagactcataattttgggccaggcgtggtggcttacgtctgtaatcccagcaatttgggaggtcaaggcgggtggatcacttgaggtcagggattcgagagtagcctggccaacatggtgaaaccccat

SEQ ID NO: 243747 - DNA, 1773 bp, Homo sapiens
atggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccggtctgcctggaggcctgggacccggcctctgccggcccggcccgcttcagcctctctctcctgctcttttttctgcccttggccatcacagccttctgctacgtgggctgcctccgggcactggcccgctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcgggggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacccacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaaccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataa

SEQ ID NO: 243748 - DNA, 433 bp, Homo sapiens
gctggtctcaaagtcctgggctcaagcgatctgcccaccttggcctcccaaagtgctgggattacaggcgtgagtcaccgtgcctgggcaaccagaactttttataaacttgtgtgtgtatgtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctac

SEQ ID NO: 243749 - DNA, 934 bp, Homo sapiens
agcgtggatagagagaagaggaaaagaagagacacagctactttgagaagccaaaagtacatgatgagtccgtggacgttgacaaaggacctgggtcggccaaggagttgatcaagtccatcaatgaaaagtttgctgggtctgctggctgggaaggcacagaatcgctgaaaattgcagaagacaaaaagcagctgagagatttctttggcatgtccaacagttatgcagagtgctatccagccacgatggatgacatggctgtggatagtgatgaggaggtggattatagcaaaatggaccagggtaacaagaagagaaccttaagccgttgggactttgatacccaggaagactacagcgagtatatgaacaacaaagaggctttgcccaaggctgcattccagtatggtatcaaaatgtctgaagggcggaaaaccagacgcttcaaggaaaccaatgacaaagcagcgctcgattgccagtggaagattagtgcaatcattgagaagaggaagaagatggaagctgatggggttgaagtcaaaagaccaaaatactaatcaccagttacaaccagagtcgctccacaaggatatgctccccactgttttctttctacaatttccgaaggttgcaagatgtttttttgtggatgaatataaaattttattgtgaaaaaaaaaagaaacacagatagtaaaaacaaatgttatgtctggcaacacagctcattcaaaaataaataatcatttactgatgatgggctttgtagattcccatcatctacagattagaacatataaggacaaattctgaagagctatactcccttccatcttttctctacctgcaatgaaaattacagaattcttattgaaggatactaaggttctattctattttccagccttaaatagaggaattagaggat

SEQ ID NO: 243750 - DNA, 397 bp, Homo sapiens
ttttttttggtagagacaggctcttactatattgcccaggctggtcctgaactcctgcagtcaagtgatcctcctgcctcagcctgccaaagagctgagattataggcatgagccaaggtgcctggcataggaagagaatttttaacagaagcagcaaaacgattagttactttacatttttttcatcatgcaggtaacctaattacatttcagattttgaggggaaaatttatccctaatccctgaagcactgacaaaatgttaccacttcttttctgtgtatgtgtgtacgtttaaaatatatatttggcatcatacaatatatatcctcttttatagtctatacttttaaaatttatcactacgtaaacatttttatgcaacataattgtgatc

SEQ ID NO: 243751 - DNA, 238 bp, Homo sapiens
ttcacaggtattggttcctaataaacatcttgcacctcaaattccatcccagaatctgcttccagagaaccccatctataccaagaccctgatgatcccagtcatctcagttattcctgctgaagttccactcgtgagtgaggccatcctggatcagcagaccagctgcgccagctccaacataaaaaacaaccaactcagataatcctgaaaaataacaaatacctgttgttttaaa

SEQ ID NO: 243752 - DNA, 215 bp, Homo sapiens
aaaaaattggtaaattaaatcattttattctcaaattatcaacccaaattacctgttcttcacctcatctaataaagtcctataaaaagaaaagtgggccagacatggtggctcatgcctgtaatcccagcactttgggaggccgaagcaggaggatcatttgagcctgggagtttgagaccagcctgggcaacatagcaagacctcatctctac

SEQ ID NO: 243753 - DNA, 1549 bp, Homo sapiens
aaaagtccttccctaagactatgtctaagacatacattaaacaagcaaacaaataatatatcacatataacacagcctagcaaagagtaggtactctcattacctactatttctcgctcacattttctccctaaaatgagtgttatttttatgataatttgttctgtacccttcatgcaaacaatctttgaaattcttattcccaatgtgatgtggaatgacttgttccatcattccttagcaaggttaaggtactccagtaaatattttccttttcttagatatagatgtggtaagatgttaaaaggaggtggtttgtggcaaggcaatgttttaaaatttaactttttgttaacattttaaaatgtaaataaaaataatttcctgggttttggaaaactaagatttggagacattagacccacattcttttaagtaaagcacttcgttcatatagattgcccagcccctgtaggcatttgaatttactaccttggcttaagtacagtcttgcaaactctgtcccctacactcttctaggtcaggggagataagaaggagagggaagaactaagttatgatgaaagcagccataagaagggggcagaaatggggtcatttgacccttcgtcttctcaaatcagaaactcattgtgtggctgtgcctttaaattaaccatttactttcatggagttacttcaattgctcttctaagacataaatgagatgcctgtttctttatattcttaccctgtgtagtacttgctggtggtggaaagccatgctacctccctgaattcccaggattgtgatgcaaggtctaatgcagtagttctccaagtgtggtctgtagaccttatggggtggggggtccctgagaccgtttcagggagttcacaggtcaaacaattttaataataaagctaacgtgttatttgatcttttcactgggttgacatttgcactgatggtgccaaagcaatgttatgtaaaactgctgatgttttgggcaccaaactggaacaaaaccttatattctttaccactaagcatctgccggttaaaaaaaaaaaaaagaagtttaccttaagaatgtccatccatgatgaagtggtaacaatttttattaaatctcaatcctgaaattcttaagtacttttttagatttctttttgatgttctgtgtgaagaaaaagtattcctactacatatcaaagtgagaaactgtgcttgtgctattgagttgcaagttaaactagccttttaaaaaatgaaacataatggacgatgtggtggctcacgcctgtaatctttgggaagctgaggcgggtggatcacgaggtctggagattgagaccatcctggccaacatggtgaaaccccgtctctactaaaaatacaaaaattagctgggcgtagtggtgcatgcctgtaatcccagctacttgagaggctgaggcaggagaatcgcttgaaccagggagtcggaggttgcagtgaatcaagatcacgccactgcactccagcctgacgacagagcgagactct

SEQ ID NO: 243754 - DNA, 477 bp, Homo sapiens
tcctgcacacagggacccttgtgacatatatacaggccaattgcctaggtgatgttgtgcaatatacctgagaccagatcaatggcctaataatgactcttttacctagagccaggacatgtgcaggatggtgatgtaactctcctctctggaacgggccatgaataaaggaaagattgtgacatattgcaagaccaggcacacagctgatgttactcttttgccagagccatgcaaggagagcattttgagatatctctggacctatcacctaggtgatgtggctctcctgcttgggccctgccagtctggacagtgacatatttctaggccaggcacacaggaacattgtgacatcgctggatgtagcatctacgaaatgtgactctcctctcctgcttaggtcctgcccacaaaaggaattgtgacatatcactgagtgcaaaacctagtaaatgcaactctcctctttattct

SEQ ID NO: 243755 - DNA, 620 bp, Homo sapiens
aattatgacatttctgcctgtggccggtggaaaccgatgttactcattcctgcccctgagcaccgtcccttcagatctttagaacaagggaaggtaaattttttgtgtaaagggccagagaataaaccttttaggcgtggctgagcgagtaataaatgggtgtggctgtgtccagtgagattttacttgcaaaacaggccgaggaccagatttggcccgtggctatagtctgccaatctctgctttaggataaatgttctgcagccttcagtcatttccttcagagagggggaccttctctgaggctttctcggcgcagccctctcctctggagttctacacggcggactcgagctgctgtggtctccctggattctcagcctgacctcctccatctggggagtccggcagctgtggctcatgacctagaaactctccaggcaatgactgtggtgatggcaggcttgccccgttgtgtttcctttttgttgcctgctgtcttgaaaaccattgtttcacatcctgtttgttcttggctgtggaagatgcctattaccccatcttggctgaaactgggagttgcttagctatttaaatttaatttaatttaaatacaattt

SEQ ID NO: 243756 - DNA, 620 bp, Homo sapiens
ccttacagtgtggggttcttgttttggatcttctgtaacttagggatcttcttcctctgcaggtgtttttgtctccagatattcttgtccagttgtcctccaatcatcactgtcccttagaattagaggcttaaagaatcctgatgcccaaacctcactaaatcatactctctgggggtagaactaaagcactggtatttttaaagctctccagatgattccactgtatagccaaggttgagaaccactgtcttgctccctgaacctggtcaacttcttgaggtttatgctatggaatcaggtatcttagatttgaatcttgcctctaccacttgggcaattccttgtgtttttgttttctcatctgttatatggggataattgtatctacctcaaaaagctgttgaacgggctacatgagaacacaggtaggtcaagaataatctctggcatatagtaagtgttctataagacttagcaagtgttctataaaatttaactcatgtgcctaggacagggcctagcgaatgttgacataatatttgtgcacttgccatgagataggcattgttctaagcactctacttttgttgtgttgaagatctagtataagaaaaatt

SEQ ID NO: 243757 - DNA, 373 bp, Homo sapiens
tgaataatataggtgcacagaaataggactgaaaagctgaaggtaaggaaggaaagagataagaataacaaatgggccaggcgtggtggtggctcacgcctgtaatctcaacactttgggaggctgaggtgagaggatcacttcagcccagaagttcgagaccagcctgggcaacagggcggaaccctgtctctacaaaaaataccgaaaaagcacaattagccaggtgtggtggcacacgccttcgtcccagctacttgggaggctgagatggggggattgcttgagcccaggaggcccactttgctgtgagccaagatcatgccactgcactccagcctgggcaacagagcaataccctgtctcaaaaaaa

SEQ ID NO: 243758 - DNA, 453 bp, Homo sapiens
caagcatagcatcaaggtcataatctgtgacatctgggtgaggtatggtagtttctaatcatgatctgcttccaagcctgagtgacagagccaggtgctgtcccaaaaagcaaaaacaaaacaaaacaaaaagattccagaacctctcctgattaccctgaaacccacaaattaaaagctaagcagtcattttttttttggtaaactttcattgaggccctcataatttcagtgtttttctctcctgtctttcactcttctttgctgccacggagtacttatttgtggcctcctcgaaacacctcttctgctgaaccaaccctagacttctttatgagaactctttccaattcagtggtgctgggctgctgagttgagatggttgactttattaaatttttggccaacaattttacctagtactgggaaatacaatttattaggttggttata

SEQ ID NO: 243759 - DNA, 2658 bp, Homo sapiens
tgaaacggagtttcgctcttgttgcccaggctgcagtggcaatggtgcgatcttggctcactgcaaccttcgcctcctgggttcaagcgattctcctgtctcggcctcccgagtagctgggattacaggcatgtgccaccatgccgggctgatttttgtatttttagtagagacggggtttcaccatgttggtcaggctggtctccaactcctgactttaggtgatccgcccgcctctgcctctcaaagtgctgggattacaggcgtgagccaccgcgcccggccagttacgggaatttttaatggagttttaccctttttagctcttttccacatcactacaggtcatcacatatactttttaccttactttttagcgtctcaaaaaatagggagagctctccctgaacagtgcagagcccgtatccctgatttcctaggctatttgatttctacatccaggaacgtagggtcatatccactgttcttgctttttcttcctaagaaaggagagaattcctcgcacatatatatcgttggcttggccttccaaagcaaagcaaaactaaactctgttgattttgcctgggaatcctcggggcccctagtattggaaacttctttgaactgtgaggagctgctaatttgcaggtgacatgtgaaagaaatgtaaccgaggccagcagtagctaaaagtcggccaccacccaacgtgtgacgccgatttgtggccactgtgcttataatcgtgtacacacaggtttgtgagcagcagagaacaaaagcaagtaaacaaaaacaagctaaagatggcgtctgacggccttgaaaaagcctcacagtcttgtccctccctgaggaggcccctcccctacctgactttttgagtgactgttgtttgcagccaatagtgtccgtgaccctgctccccagccatcgtctaaccgccaatcaccgggagccagaaggcaaacggggcggtgtctccccgcgtgcgcgcggtagccgggtacacgggcaggcgccgcggatagttctgtctcccgcgcgcccgcctccgcctctgcctagctgagtcagcccgtgcggtagcgccaggcacacgcggtagaacatctgtagggctgcaaagctgcacctccgcgtcagttctcacggcgagcgccgccttcagcccaagttctcaaagctctcggggctacgtagtctaccctccccggtgacccggcgagatccctagccgctcctccggccgctctgctctccgcatccctcgcgggaatgaccccctttacccgggactcccagagcgcactgtatggtagggcacagtggcgagtcaccctgtcccctgaggcctcttgagcagtcgccgatctctgcttcccgcgtcgctgcgatcgcctttcccgtagctgaatcacactgacccatcggaaacggttctgccctccctggggtccaccttgtcatccttgactaatatttaatcaactaacatttaccaagttctcgctggcacgagttctaggagctactttttcatttttcagtttctccataaatgcagtgggtcctttaggcaaacctgaaatcggaaatattaatcttaccaatgtaatcttagcaaatgtaaataaaaaggactgtgctatactgagctaaaaattctcatcctgctatagaaatatacgtggaattttcagattacgtggaatcctttaaagaccgcattcggccttctgggtctacagctctctttttttacccctaaaaataaggtcttggattttttgcagaccattagtcgagtcactcttttaaaatgtgggaaaatagtattttgtggtatttacttagctgctcttgtgtgataaggagctcatttctgataaaaataggttttgagagaaccttttgacaggtgagccattttgcaccttgaagtggaggagtaggactgaccaacacagcaggagctttaagtggccgttttccttatttatttcttaaaatgaagattatgatatgaattgccatgctttcagtaatcacatttaaggaagtctattgctagcatgaccctgaatgagtcaagcacccattataaaaacatatatcatctgagtgataccatatcatacacatctattaaatagtgagaaaacttttatttttcatagtttggaggtgaactcagtcatgcagaaaattcaaactcagaatggggagaaagcaagcaagggaactgccaagagtatgatatatttagtcctaacaaaaatgtgacttgggaggaaagggatagttaaaattatggacagtcttaccctgaactgtctgtctaaaggagatgaattgtctttcttttttatctaaatatttatgaaaaataccaaaagtactggaaagtacatttttaaggctcgtttcacatttatttaaattagaccaatactgaaatgaaccccaaatgcttatattttttgcaaacctaagtgtgacatctactgtcatgttgtgttggcaacgcatcccaagattgaagatctttttctcttttttagacctagtcagttgttttcaggactttctacttaaacatgttgccatcatttgaaatttaaaatgttaaataaatacacttcttctctaata

SEQ ID NO: 243760 - DNA, 405 bp, Homo sapiens
ttagtgtttctttatgctgttggtgggttggtagaaccactctgaagggtaattcattatatcccatccactggaattggcacgagcagttcctgccaggtatagttttttgcccaagtgcacaaggaaacatgtaaagccatcctagcagcattatttgtaataacaaaaaactgaaaatcacctgcatgttcaccatcagggaaatggataagagaagtgtgatctgtttgtgcagaagggaaaatgagtgccttagaactaaatgtatttatagcgtatgatactatttaaggatgaacaatgtgcaaaacaatgtcatatactgtttatgatatggatgtagtaaacgtataaaagcttgcacaggaatgattagcaccaaattcaggacacagttttcct

SEQ ID NO: 243761 - DNA, 347 bp, Homo sapiens
agaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttg

SEQ ID NO: 243762 - DNA, 321 bp, Homo sapiens
cttaggcatcccagctctcccctggaccattacagaaacctcctggctggcctctttttcagcttctcccatatgacccttcttggtacacatctttaaacaccagagtatatagtatggcgcttaagagattggctctggatttacaaagacctggattcaaatccaagcttagccattctctttgctagatgaccttcagcaagttatcccctctgagcctcagattccttacctgtgaaatgggagtgccagcctgggttgttataaagattcaattatacttgactaatacagatttagtattgtcctggcacagta

SEQ ID NO: 243763 - DNA, 364 bp, Homo sapiens
aggcctcagaggaatgagcccctaaatggtgggactttaggcagagggtcaaactgaggagatcaagaatggaggggagggctgggcacggtggttcacgcctgtaatcccagcactttgggaggccgaggtgggtggaccacctgaggtcaggagttcgagaccagccgtccaacgaggtgaaaccccgtctctattaaaaatacaaacattagctgggcgtggtggtgcacgcctgtaatcccagctactcaggaggctgaggcagttgaatcacatgaacctgggaggcagcggttgcagtgtgccaagatcataccactgcactccagcctgggtgacagagcaagactccatctcaaga

SEQ ID NO: 243764 - DNA, 207 bp, Homo sapiens
agggcctgagatttcagaaactgaaaatttttttttcaaaattctgttttctgggcctgaccacttcatgaaatatgcataataagagtttcttaaaagcttgtaaagagtttggaagcctatttattgccctcaataaatttatgtctcatttaggcaaaaaaatgccaaccaagtacaaaggtattgatatagaaacaagcaaat

SEQ ID NO: 243765 - DNA, 287 bp, Homo sapiens
cgagactccgtctcaaaaaaaaaaaaaaagtgagaaaatgttaaaaagaagcaaaagaaataagcccagtatcaaatttatgtattcatagaaagttttcctaaaaacatatgtttaaatgtaacatacgctgggctgggcactgttgcgcatacccccaaatgccagtcctttggggctttcagaccaaaggattgctggaggccaggagtttgaggctgcagtgagccatgttggtaccactacactccaatttggacaacagggtgagttgagaccccaactca

SEQ ID NO: 243766 - DNA, 110 bp, Homo sapiens
ctactatctgccagtcactgtcatgggcgctagggatgtggcaatgagccaaacagattcccactgagcttgcactctggtggagacaaaaataaataatcatatatata

SEQ ID NO: 243767 - DNA, 381 bp, Homo sapiens
agaaaattatctttttaatgaaaatatcataggattaaattcgacttatttaatatatttttaatacataaaactcattaaatgaaaaacctagagttttcttcaaataaaatcttccttagagagaaaaatgtgaaattcttatcagcagcaaacgaatgattaaagtgaatttgaaaagttcaaatgtctactttgaagacttctgccagatttgcagaaaccaagagttttgtgctccataatcataaaatcatggtgaccaacaaaacaaaacaaacacactttggagcaaatgtaaaaggcaacaaacctgaggggtcatcagcaatatggggaggaaatatttgcctcagttataataaataataagttgtcata

SEQ ID NO: 243768 - DNA, 550 bp, Homo sapiens
ttaataggagaaaaataaccctcttccttccttatgccaatcttctcgagttccttgctacttgcagctgagtccactcttgactgatatcacctaatctcagtcgctatcagattaaacaacagcattactttcagagggccaccaagaaaaaattgcctgggagaagagtaaggagcctgaagatctgactaactttctctgtagccctttaccgaatagcagattagctgagctcatatgatcgtatcaactagtcatcaccttgattagaacacagaagaagtaagtgttcgtggattcaaactgaagagtcggatggaggagtgtcaaggacctgtcatcataaggaggcagaaagtgagagggtatctttaactataagtgatggttttataaagtagatgcacagttttagaaagtaggaaacccactacaaatgaagtgtctgaacatatagtccagaaggtgtctggtttaaacaaaaaagaaattactacttaggggcatgaacagcaccctatctataaataaagactgccatcataaa

SEQ ID NO: 243769 - DNA, 690 bp, Homo sapiens
  misc_feature (676)..(679): n is a, c, g, or t
atattatgtgaagaataataaaattgtgcttatttcttggacacataggaagtgtttagtaaatggcaggtcttctctagggcaaacataattcatggtacagcatttgtaaatgtaaaatatacataataaaatgtctgattattctattaatcatgctatacaatatataaacctttattccaatgatatagagagtagaattttacttaaagtattttcctaaaatctgacccacattaatagatatgaataaaactacatactgtatgcactattgctcagaaatgctgtttttcagttaaataatctaaaaagaattgcatataaaagcactttaaacattagatatttttctttaatttttcacacagttataaagttactctaacatgcccctgaatgttggcacaaaatcaaaatttcaacttaatgtgaattctgccaaaatacttaagaaatataagcccacaaatctggagaacaatctggcagcacttagtgacatcaagaatgtgcagccctatgacccggcaactctcccctgggagcctcttccaaaggttgatctggaggttctttgcagctttgtcttggcaccagggaattatgagaaacctaggtgtctggcagtttatttcttattataaacaactaaaatatataaattacacannnnaattaaccttc

SEQ ID NO: 243770 - DNA, 388 bp, Homo sapiens
agaatgtgcagccctatgacccggcaactctcccctgggagcctcttccaaaggttgatctggaggttctttgcagctttgtcttggcaccagggaattatgagaaacctaggtgttcgtctccagtagaagagaaaaaaaaaagtgtggtagattagcctctgggctgtgcagtggtcaagagcaatgatctacatacagctgagtctatagccacaatgttgagttaaaaataacaataagcacatctgtagcagaatgccatgtttataaatttaaaacagagacattcataaaacaacaatgcacgtttttcaaggatacatagtaatttaagtggagtaggtgactatataaagaaggtaatagcagtgaagagtggaaataa

SEQ ID NO: 243771 - DNA, 381 bp, Homo sapiens
cctaacttccagctttgaaataggactgaagatgaaccatgctcctggcaccccctgttgagagcccaagttcagcagattgcggccatgggggactgaaaatggagccctggacaaagacacttgctgggtgacccaaggcaagactttccatgtacactatgaatgccaagtgctgtgaataccaacccatgctttcaaagagcctgctgcctcagagcatgtgatgtggaactttctggtggcctcggcgtggaggttctcaacctcagctgcacactgtgtttagttggtctggagcgagatctaggcatcagtatattttttaagctccccatgtgattgtaatatgcagccaagaataaaaaaaaaaaaccctga

SEQ ID NO: 243772 - DNA, 868 bp, Homo sapiens
atggatcaaagggctcgctcatgataacaacagccttctctaagccaggcactgaatactgtggatacaaagagcccagagtcatcaagaggaaccaggaactctaacatgatgtgtggagcaggctatgcaaagaggggtacctctcccagtcagaggcatcagagaaggcttcctggtggagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctg

SEQ ID NO: 243773 - DNA, 685 bp, Homo sapiens
cagggtctaactgtggcccaggctggaatgctgcggcatcattacagctcactgcagcttcgacctccccagctcaagtgatcctcctgcctcagcctcccgactagctgggaccacagtgagcacagggaggaggaggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagcactgaatactgtggatacaaagagcccagagtcatcaagaggaaccaggaactctaacatgatgtgtggagcaggctatgcaaagaggggtacctctcccagtcagaggcatcagagaaggcttcctggtggagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattcc

SEQ ID NO: 243774 - DNA, 1173 bp, Homo sapiens
cagggtctaactgtggcccaggctggaatgctgcggcatcattacagctcactgcagcttcgacctccccagctcaagtgatcctcctgcctcagcctcccgactagctgggaccacagtgagcacagggaggaggaggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagcactgaatactgtggatacaaagagcccagagtcatcaagaggaaccaggaactctaacatgatgtgtggagcaggctatgcaaagaggggtacctctcccagtcagaggcatcagagaaggcttcctggtggagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctg

SEQ ID NO: 243775 - DNA, 358 bp, Homo sapiens
ctggtctctctatgcaatctgcaattctaagctcattctattaaaaaatgtatctcttaattttaaagaccacctgaagatttacattttctagctgcacatatcctatagagggaaatatttatttcatctctctgggatttttccaggaactaaaacctcaggcaccaaaacctcaggcaccatctgcacttcacccgggggtctcctgtcagatacagattctgcagctctgccctctggctgtccacaccattggtgctgcaccagagctgacccttcacagctacttagtggttacttggagttggtaaaataatggatacttggacctaaatcaaactttttatttatcaaa

SEQ ID NO: 243776 - DNA, 356 bp, Homo sapiens
accaagatggagtcactcatgctaagttccatatcaccaaactgaaactaagtcatcagaccttcccagaactcaagacagagagagataatatgcaaatccccaaacaggccagttgtagccagcatgataaggaagtcccctctactttaacctttataaggaaagtaacctgaagtaacctgagcttaccaatctgctttttgttccctgtgtctgctttcttcacccttttctgcctataaagccaagcttctctgtttagctcatcagagcacttttcctaaagttttagaggagatgctgccccaattcatgaattacaaataaaaaccaattcaatcatttaactaaat

SEQ ID NO: 243777 - DNA, 731 bp, Homo sapiens
ctggcattgtttgaatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctca

SEQ ID NO: 243778 - DNA, 405 bp, Homo sapiens
accttcccaagcaagggggatactgtaattaagtctacttgaggcttcaaggggtcaggtgacttgcaaaagatttgtctagtaggtggtggaaaaagaattcaaagccaggcaattttaatctggagactgaactcttagacattttacactgtggtgccttaacagagcaatagatggctgttgttctaacatagacagatctgaaatttgctctggttcaagtatgactcctcatttgtcatctaggacattcatgtttcctggatgtggttgtgtgctagaatgagtcaattggtcctcacgcatcctctccatgatctttatcactggggcccctttttccccagcttgtttctatgccataagaataaaattcgtgccccagctctttccttcaaagcc

SEQ ID NO: 243779 - DNA, 120 bp, Homo sapiens
cttcagagttgatattaatagaaattattccaaaattattcttaggtcacaaattactagtatgccacataaaaagggaaaaatcccacctcatcaaagaaaaggtgtcctgtgtatgtt

SEQ ID NO: 243780 - DNA, 644 bp, Homo sapiens
atgccccgtcccttcacccatcctgccattcatcctttcatggtgcactgttgaggtacatttctgagtaaactggcaacatcaatgcatttccttctaaatacatgggcatacaactgttcattataggtcaatgtttgtgtttttaatgtaaactttattttaaacgtgcacactgtaatgcacacatcttcagtgtgcattcttttgagttctgacaaatgcacacacctgtgtaacccagacccctctcaatatatggaacactactatcaacccagaaagtcccctcctgctccttcctcctagtcagtccccacgtcctccatcctcagacatagccaatgctgatggtttttttcattttggattagttttccatattctagaatttcatataaatggtgtcctataatttctactcttgtgtgtgtccgtcttctacacacccagcataacgttttggagatgcatccatcgttgctgaatagattggtgattagttactttttattgcttagtattcccttgtatgaattgagtaaaatctgtccgttctattatataggtactggggctttttccagtttttggatattatgaataaagtttctgtgaacattcatgtgcaagtctttctgtgg

SEQ ID NO: 243781 - DNA, 285 bp, Homo sapiens
ttgtttaggaactgtgactaggcaaacaccctttaaaaaggacaaagagttattacattttctgatttaaaatcatgatacaaagctacaaaaataaaaacaatatggtattgccacaaaaacggatacatagatgatgaaacagaatagacatcctggaaataaaccctcgcatacgtgataaaataatcttccatatgctttccatgaccatgcaatagaaaaataagaatctctttaacaaagaattttcaaaattgaatgtttacagagcaaaaataaagt

SEQ ID NO: 243782 - DNA, 497 bp, Homo sapiens
atgagtgaaaggaaagaaatttgttattgcttaaattctgtagtaataaagcatatttcaacaatgagtaaaatcaccatattgaccatcgatacatgtagatttcttaataaaaaagattttcaagattctgacaggtatttgattgtgtttgttttatttgttatacctcattattcacataacaaaatatataagttgagaccttctttgttacaaataaatgatgttatttgtatcaaagaaggttatgttatttgtatcaaagatcttatgtgaataatgaggtataataaatataaccactttatatatgtaatgtacacatattatatataaaggactccaataactcaacgaaaagtcaaaaatagcaaagcacttgagtcttaacttatatattttgctatatgaataatgaggtatgataaataaataacaaatatatgtgtatattatatgtatgtgtgtgtgtgtgtagaactccagtaatctac

SEQ ID NO: 243783 - DNA, 427 bp, Homo sapiens
accccggaaatgagggaggtcaccagagttccaacatcaagtattccttggatttttgttaagcccagtctacatgctgacacataaatactttaccatgggacccactaaatgcactagggaacgtatggataggaagaccaatattgttaagatgtcaataccaccgaaagtgatctacagatccaatgcaattcctatcaaaataccaatgatgtcttttgcagaaataggaaaatccaccctaaaattcatatggaaactcaaggaacacccaacagccaaatcaccttgaaaaagctgtaaaagtcacgcttcctgacttcagaacttaccacaaagctacggtcatcaaaacagtgcggtgctgacgaaaggacacacatatagaccatgggaatagcagagaaccctgaagcgaaccctc

SEQ ID NO: 243784 - DNA, 295 bp, Homo sapiens
gtgacagagcgagactcttcctcaaaaaaaaaaaagagagagcgagagagaaagaagagaaggaggcttgcaaaggactacagaaagaatgctgggagagggtaataggcccagagtagaggagcttatggagagaatgaagtggtcattcgtgtcctgggcagccaacagttgaagcagatgaggggaaaaaagtctggtgggtttgacaattttcatgggctggggcaggtgaatcatagcccaccagggtttgacactaagctggcgagaggacagagacaggataagaagg

SEQ ID NO: 243785 - DNA, 589 bp, Homo sapiens
ttttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggtaagaattgtgcctactaattttgcaatttaaaggatttcaggaagctttttggttgaaaaatcttgttttttttttttagacgtagtctcgccattgcactccagcctgggctacaaaagcgaaactgtctaaaaaaaaaaaaagaaaataaataaagttatgctttttcctctattcctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttg

SEQ ID NO: 243786 - DNA, 1017 bp, Homo sapiens
ttttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggtaagaattgtgcctactaattttgcaatttaaaggatttcaggaagctttttggttgaaaaatcttgttttttttttttagacgtagtctcgccattgcactccagcctgggctacaaaagcgaaactgtctaaaaaaaaaaaaagaaaataaataaagttatgctttttcctctattcctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaacagttccaagtatactgcattatcttgagatttgaagatatggtgcccacggggattatactaggcaaatgcgttaagcagctctggcctaggtgttgtattttaagagactctatcttaggagagcttaagtgattgggctgcaggaagaagacattgtaacccaggaattaaaaatggattcagattgcctgattttaacactttagtttcaccataggctaattatgtgacattgggcaagagacataattcttctgtaccttagtttctacatttgtaaaatagagatgatttggtaacttattaataagatttttgtgagagataaataaaacaaatacattttgtaaag

SEQ ID NO: 243787 - DNA, 516 bp, Homo sapiens
gtcatgcagacaactctcctgggagctgaggaagctggtttctggggcaggtgggcctagtgcctttgacatgaacttgggccagctcccagcttgaagcctctgtgccctctttcatccccagcacacatagcactgctgctggcctggtcttcctgggtcctccctgtagtgtcctcacatctgtcccttcctcttcatttttcttcagagtccccactcctttcttacaacttcttgccactttcttttaacatttctgacctgtgctacagcttccccagcacttgctatatcctcctgcttggcctgagtgtttggtcggggctgggtctgcgtgtggggtctctctgcttccctctcagggcccagagcatcactcctcacttcttccacagagatcatctcagtgccccacatacaaagcactgttctgtgggctgcattcagaggtggccagactgggaggcccctgccctcatggagctcccattcctcggggaacatagtcactat

SEQ ID NO: 243788 - DNA, 339 bp, Homo sapiens
gatcaactaatctaaccttcttcttttgcatataacaaaaatgaaaggcagactcatccctccacccattcaagttggggtagagcatggactgaaactgactacttcacagtgtcatggaggtcagatgttcggagactacagaggggacacaaactacccccaaaatctttgtcactgagatgacaatttccacaagagatgaaataaacagaaatgctaatagtaatatggtattttagtaaaagtaactgaaagtatttgaaattacctatgttttatgggtatgtatatatgccatggaaattttacataaaactctaaaatcacactttgctg

SEQ ID NO: 243789 - DNA, 584 bp, Homo sapiens
aacagttttgctgtgttggccaggctggtctcgaactcctgacctcaggtgatccacctgccttggcctcccaaagtgctgtgattacaggcatgagccactgcacctggcctctggcaccattttttaaagcccagttcaaatcttcattactttgacctgctttggtatcttctgaaattgtatagtaataaaaagtagtccttggatctagaaaaattactcaacatctctcacatccaaaaaaatcaaacagttatgggatgcagctttccacttcttgtattggttaagattttgaaagcactctatctctagttttggttatgtggagtaatcaacattcttatatgttctaagtgatcatataaatgggttaaaatagtctgagggtttgcttgacgacatttttaagaattcttaaaatggacatactgtttgatgcagtaaatatatgtctgaaatgtttccagataatttttcaacaaatgaactaaaatgtatgcaaaaggctgattacagcactctttttactagcacagattggaaacaaaacaaatgctgaatctgaagagttatacaat

SEQ ID NO: 243790 - DNA, 435 bp, Homo sapiens
tctccctttataacaagtattttataaagtccttatattatccagaaagaagatccatagatgagatgcatttgtacccataaaaatcaacatcatgtctaaagtagaccgatgtttacatttatgcaaataaatttgggttgaagagaagattggaagctattctatacaggaagtataagaaaatggagtgaagaaatagagtagatactaaataaaaactgatgtttaatgtttatcaaaactattaaaaatatacataaaactgctttaggttctgagtttgattattttaaataggttttaacttacatgtatgtctagcagtacatttgaaagttgtgcaggaagttggtcaatttttcatggtccagaactagagcactgcaggatatctatccctctacctccactccactgttagcaatgattaaa

SEQ ID NO: 243791 - DNA, 570 bp, Homo sapiens
tgtaattttctaaaaacagcttttggagagaacagaggcatcaatactgttacagtctattagttatctggccctatggacattagtaagtaacattctagagtatgagtgtcagagaccagtggtttgtctattaaaatagtagaattatcttacttgataattcttgagaaggctgtgactcagtttactaaatttactatatttattaaatataaagcaatgtttggctccttgattctgcacacctttatttgactctgcctgttttctttcacataaggactacagcattttttactgactcctccttgaccatcatttttttcataatataataaaaacctggcatttccgtgaagttgacttactggcttgtattgctatttacttctgggatgtagtaatatagggatatactatggaaagaaacttaacaaaaaacagagaaaattatctgtagttgtcaagggctcattaacctttctgtgccttaaatcgaagccacatttttgtgtctgtgtagcttgtcatcctcaataaaatctgcttgaatttgaaaaaaaaaat

SEQ ID NO: 243792 - DNA, 330 bp, Homo sapiens
ggctaatttttgtatccttagtagagacggggtttcaccatgttggccaggctggtcttgaactcctgacctcgtgatccacccgcctcagcctcccaaagtgctgggattacaggcgtgagccactgcacccagactggtttgggatttaaaaaacccaatatccactatggtggtgctgtgtggatgagagagcaaacactattgttctacttgcctgggctgtcctgtgtgaaaagagaaataaaacctgaacattttaatgacagcattgtgacattacagatgcttattgatgtctaataatgcaaccttcttcatacattaagt

SEQ ID NO: 243793 - DNA, 569 bp, Homo sapiens
tttttgagttaaaatttgcttttctttttcaaacttcttgaaatggatacttacatgattctatttccctaatgctttatttaagcctataaatttcccttgaatcatagactcggattcagcccacccattttgatatgttacatttttaatatattaaatataaaatgtcttctcattcctattgtgattttggtttgacctattgaatcatttagtagtacattattaacttctaaaactgggaggttttagtatggcatttttgttatttattgctcgtttaattatatgtggtcagaaagcatattccatattatttcagtttcttaatctttgttaaggcttcctttatggtcaagcatatggtcaaatttttaaataaaattctatagaacatgtacttgaaaaaaaattctagtctgctcttgttgggtatcagttttcaacatgcgtgtatcaattagatcaagtttgttaatcatgttcttcaaacccttatgtttttactattttttggtctattcattctatttatattctttactaaaagaggagtgccaaaatct

SEQ ID NO: 243794 - DNA, 783 bp, Homo sapiens
ccatttaaattttccatttaatttaaatgtattctctcatttgaccttcatactctgtggagaaatattcctattttggcttgtattgacaagttgttttcacacagcccccacatcacccaaccaaccagcagagatcctccttcccaagaaacagataaagaaactgaggcccaggaaggctaagagtcctgccaggattattcacctttcaagccaagcaagcactggctgtgagagatggctgtgagagaagattaaaacaattacaactcacccagttcacagatgctgagtaactgatctcctgccccactaaccttaacgacagctttctctggacaagggactgatttcagtaactttctcctgataagagaccatcctccatggactggttctggccagttttagaggctgtgcctttacgaggctgagtaccttcatgtccctgcttcactttttgatgtgtagggcctaattataatacatttaaatgtcaagtctccaccccagaatgaacatgcatgtttattgaatatgcatgtgttaggacctcttttatgagtattctcataaaatgatatagctcctctgatatcctattgagtatgtatatgtagccaactcatttggctcaaattcctgtcctctccctccctccctggaaatgcctgcctctggccttggctgtaggccacacttcccagcctgtcataatggccaccttgcagactgcaaacctttataagaaataaagctctcttttctaaatttataaaa

SEQ ID NO: 243795 - DNA, 418 bp, Homo sapiens
gtcacttctttgttcacagatgtcaggctaccttcttcctttctactcagtttccccttaaaaggtggtacttctgtggaactgtttgcagttagatggtatagattttcacttagctttctagccatcccacacttcttccactcatgtttttcactcaatgtgtgttgaaatttataacaaggaaagagtttcaaagattcatgtcccatgggagatgggctgaaatttcctggctatggtagtgagctattaataggagatagagttatgtcacgggggagaggttatcaggaaaataccattatataccatcagtgacccattctagaagccaaggatttggctctgggttctaagaggaacagatctcagtgacctttatataaggtcactggactttaatacaaggaccttt

SEQ ID NO: 243796 - DNA, 508 bp, Homo sapiens
taatctttattttcattcacatcttaattcattcagtagattcattgtgtttttcatatagaatacacacttcctatgaatattattaggtcatttaaatgctcccgtttcccactattgtgcctgtggtctctttttactatatatttttaacctcttgatgataaacagttgtggcttttcaaacggtgtatatcatttcgaggtattatatagtaaaattagcatgggatctaaactgctattagccaagtggcatttaggccaattcttaacccaagcccatgtcttcaactgtaaactgaagaggttctcagcttttgagatttcatggactagtcagaacaaagcaagaaagtgcttttctgcagaaataaagtggtaaggatattgtagattggaatgtaaaaagaaaagtaatgtctaggtaagacccattacttagtcttaatatttgaaatgtgaaatacccagtgtgatgtgaacatggtcatgatctcatattcat

SEQ ID NO: 243797 - DNA, 226 bp, Homo sapiens
  misc_feature (24)..(24): n is a, c, g, or t
  misc_feature (34)..(34): n is a, c, g, or t
gtgtttgtgctggaacctcatganagatatcccntgacccctattgatcatagctggaatatctttgaggtcgtccatgctctgatgatgtcactcttctttgcctgtctggaagacatctccccaagagcacaccaccaacatcaggggggtggaatccaactggtcactgcaagtttgctgcttacacaatgacaagcatagcaagatctgagactgggtaatt

SEQ ID NO: 243798 - DNA, 190 bp, Homo sapiens
tatttttcttacggttttcttgaccctgttttttccctaaacatgctcaaggtaccaactttgaatttcattgtttagttgtatgagaaaaacttgacagcttggcctcttcctattctctcattcacttctcaaaacttttttcttccatttttctcttttaacttcccattgctttacctttgacatt

SEQ ID NO: 243799 - DNA, 323 bp, Homo sapiens
caggtttttctgatcacttatagctaggatgatctattctagacaggtaggtctcacattattagaaaagctcatttttagcaggttgtaaagtatcatgttctacaaacagaaaatagggacagaaagaaagaaaacaacaaacaaatgaaaagatagagccatttttctctgaagttcatacatcagtaggctggcatataggttgctgttattttcttctgaagtttaagttgtgtagcttcagttcacagggttttaagaaagcacagcataacttttagtgatttcaaatcacaaaaaatggaaaaaaaggaaggaaa

SEQ ID NO: 243800 - DNA, 393 bp, Homo sapiens
gagatgtcactaggggatgaatgctgtaatacttcatatgctgcgagagagtcacatagcttgtgttgtctgcacgtggcaactagtagtctgtgaaacctttcattgccattttcacatcacatgacctggcagtgggaataagacatcagaatcagccactgttaagctactaaatcagtcggtgaggtgggggagggagaagacatcagcagaaagccgggaagagagcaagaacattcacattccactccaccaacaatacggcagttggtaaaaatcagcaggaaacgtgaaaaaaatcagaacccttgtacactgctagtgagattgtaaaatagggcagccactttggacaacagtctggcagttcatcaaacaaagagagttagc

SEQ ID NO: 243801 - DNA, 270 bp, Homo sapiens
gtgtggcatttagtggtgtcttcgcagttactaaaggtttaaaaacatcactatcttttttttaagcataatatagcaaatttttatttgacattcaagtgttgaaattaagcattttatgtaccatcatttggacactcaaatatattttcttaggtttataatttaggcattaaaaatacgtcctagtaaaagtttcaccatacaaagcctaggataggggcatcacagggctaattttaccaatcaaattaaaatatatatatattt

SEQ ID NO: 243802 - DNA, 270 bp, Homo sapiens
atcaagtttatcattactgtgtatgatccaaagaaccacaacaaattccaattattatcacttcatctatgtgtttcccctacatgctgagggtacagagcatgccttccttcctgaaaaaaatatgaatatgaatatttagttattttattttattgagtcaggaggctgaggcacgagagtcgcttgaacccgggaggtggaggttacagtaagctgagatcttcccactgcactccagcctgagcgacagagtgagactccatctca

SEQ ID NO: 243803 - DNA, 615 bp, Homo sapiens
tggactgagacgcggggagtctgcattttaacaagcttctcaaagtgattctgatatagatgagccaagatccacttactgactaatgcatagtatctaaacttgactaatgcttggtatccaaacattttctgcacgtcagtgtagcacacttagatttttacctaaagttttcttataaattgaatcatttagctcatgttaactgggtaagttagtggggcctgacttctgccttttgccactaggcaccatgatagtttggaatggattagtatttgtttatttttattttttatttatttatttattattttttgagatggagttttgctctgtcacccaggttggagtgcagtggcatggtctcagctcactgcaacatctgcctcctgggttcaaacaattctcttgcctcagcctctgggtagctgggactacaggcatgcaccaccacacccagctaatttttgtatttttagtagagacagggttttaccatgttgcccaggctggtcccaagctcctgacctcaggtgatctgcccgcctcggcctcccagagtgctgggattacaggcgtgagccaacgcacttggccaggaatggattagta
